(12) United States Patent
Liu et al.

(10) Patent No.: US 11,492,637 B2
(45) Date of Patent: Nov. 8, 2022

(54) RESISTANCE GENES ASSOCIATED WITH DISEASE RESISTANCE IN SOYBEANS

(71) Applicant: Syngenta Participations AG, Basel (CH)

(72) Inventors: Qingli Liu, Research Triangle Park, NC (US); Andrew David Farmer, Sante Fe, NM (US); Xiaoping Tan, Research Triangle Park, NC (US); Thomas Joseph Curley, Jr., Research Triangle Park, NC (US); Becky Welsh Breitinger, Research Triangle Park, NC (US); John Luther Dawson, Research Triangle Park, NC (US); John Daniel Hipskind, Research Triangle Park, NC (US); Robert Arthur Dietrich, Research Triangle Park, NC (US)

(73) Assignee: Syngenta Participations AG, Basel (CH)

( * ) Notice: Subject to any disclaimer, the term of this patent is extended or adjusted under 35 U.S.C. 154(b) by 19 days.

(21) Appl. No.: 16/765,717

(22) PCT Filed: Nov. 16, 2018

(86) PCT No.: PCT/US2018/061411
§ 371 (c)(1),
(2) Date: May 20, 2020

(87) PCT Pub. No.: WO2019/103918
PCT Pub. Date: May 31, 2019

(65) Prior Publication Data
US 2020/0354739 A1    Nov. 12, 2020

Related U.S. Application Data

(60) Provisional application No. 62/589,245, filed on Nov. 21, 2017.

(51) Int. Cl.
*C12N 15/82* (2006.01)
*C07K 14/415* (2006.01)

(52) U.S. Cl.
CPC ........ *C12N 15/8282* (2013.01); *C07K 14/415* (2013.01)

(58) Field of Classification Search
None
See application file for complete search history.

(56) References Cited

U.S. PATENT DOCUMENTS 9,029,636 B2 * 5/2015 Wu .................... C12N 15/8218
800/285

FOREIGN PATENT DOCUMENTS

| WO | 2013/092275 A2 | 6/2013 |
| WO | 2014/117988 A1 | 8/2014 |
| WO | 2016/183130 A1 | 11/2015 |

OTHER PUBLICATIONS

Kim et al. Plant Molecular Biology (1994), 24:105-117.*
Thornton et al. Nature structural Biology (2000), structural genomics supplement.*
Gao et al., MPMI, Oct. 2005, 18, 10, 1035-1045.
International Search Report for International Application No. PCT/US18/61411 dated Mar. 26, 2019.
GenBank Accession No. HN847611.1 GS_Ba154104.F GS_Ba Glycine syndetika genomic 5-, genomic survey sequence, Oct. 25, 2010 [online], [Retreived from the Internet: <URL: https://www.ncbi.nlm.nih.gov/nucgss/HN847811.
UniProtKB—K7KQN0 (K7KQN0_SOYBN), Jan. 9, 2013 (online), [Retreived on Jan. 31, 2019], Retrieved from the internet: <URL: https:www.uniprot.org/uniprot/K7KQN0.
Langenbach, Caspar, et al: "Fighting Asian Soybean Rust", Frontiers in Plant Science; vol. 7 Jun. 7, 2016.
Soria-Guerra, Ruth Elena, et al: "Transcriptome analysis of resistant & susceptible genotypes of Glycine tomentella during Phakopsora pachyrhizi infection reveals novel rust resistance genes", Theoretical & Applied Genetics; Int. Jour. of Plant Breeding Res., Springer, Berlin, DE; vol. 120(7), pp. 1315-1318, Jan. 8, 2010 (ISSN: 1432-2242).
Extended European Search Report for PCT/US2018/061411 dated Mar. 18, 2022.

* cited by examiner

*Primary Examiner* — Medina A Ibrahim
(74) *Attorney, Agent, or Firm* — Suparna Kanjilal

(57) ABSTRACT

The present invention relates to methods and compositions for identifying, selecting and/or producing a Disease resistant soybean plant or germplasm using markers, genes and chromosomal intervals derived from *Glycine tomentella* PI441001, PI441008, PI446958, PI583970, or PI483224. A soybean plant or germplasm that has been identified, selected and/or produced by any of the methods of the present invention is also provided. Disease resistant soybean seeds, plants and germplasms are also provided.

40 Claims, 9 Drawing Sheets
Specification includes a Sequence Listing.

FIGURE 4

$$\text{Log}_2\left(\begin{array}{l}\text{Fungal B-tubulin transcripts}\\\text{of construct of interest}\end{array}\right) - \text{Log}_2\left(\begin{array}{l}\text{Fungal B-tubulin transcripts}\\\text{of construct containing GUS}\end{array}\right)$$

RESISTANCE GENES ASSOCIATED WITH DISEASE RESISTANCE IN SOYBEANS

FIELD OF THE INVENTION

The present invention relates to compositions and methods for identifying, selecting and producing enhanced disease and/or pathogen resistant plants using novel resistance genes.

STATEMENT REGARDING ELECTRONIC SUBMISSION OF A SEQUENCE LISTING

An amended Sequence Listing in ASCII text format, submitted under 37 C.F.R. § 1.821, entitled—"81492-WO-L-ORG-NAT-1-Amended2SequenceList_ST25 17.1 MB in size, generated on Dec. 16, 2020 and filed via EFS-Web is provided in lieu of a paper copy. This Sequence Listing is hereby incorporated by reference into the specification for its disclosures.

BACKGROUND

Plant pathogens are known to cause considerable damage to important crops, resulting in significant agricultural losses with widespread consequences for both the food supply and other industries that rely on plant materials. As such, there is a long felt need to reduce the incidence and/or impact of agricultural pathogens on crop production.

Several pathogens have been associated with damage to soybeans, which individually and collectively have the potential to cause significant yield losses in the United States and throughout the world. Exemplary pathogens include, but are not limited to fungi (e.g., genus *Phytophthora* and Asian Soybean rust *Phakopsora pahyrhizi*), nematodes (e.g., genus *Meloidogyne*, particularly, *Meloidogyne javanica*), and soybean stem canker. Given the significant threat to global food supplies that these pathogens present as well as the time and expense associated with treating soybean crops to prevent yield loss, new methods for producing pathogen resistant soybean cultivars are needed. What is needed is novel resistance genes (herein, "R-Genes") that can be introduced into commercial soybean plants to control soybean pathogens.

SUMMARY OF THE INVENTION

This summary lists several embodiments of the presently disclosed subject matter, and in many cases lists variations and permutations of these embodiments.

Compositions and methods for identifying, selecting and producing *Glycine* plants (including wild Glycines (e.g. *Glycine tomentella*) and *Glycine max* lines) with enhanced disease resistance are provided. Disease resistant soybean plants and germplasms are also provided. In some embodiments, methods of producing a disease resistant soybean plant are provided.

In one aspect of the invention there is provided a DNA construct that comprises a promoter that functions in plant cells operably linked to a novel resistance gene ("herein R-Gene). In yet another aspect of the invention there is provided a transgenic plant that contains the DNA construct, wherein the transgenic plant is resistant to soybean pathogens, particularly Asian Soybean Rust.

In another aspect of the invention is a method of preparing a fertile transgenic plant comprising providing a plant expression cassette comprising an R-Gene and contacting recipient plant cells with the plant expression cassette under conditions permitting the uptake of the plant expression cassette by the recipient cells; and selecting the recipient plant cells that contain the plant expression cassette; and regenerating plants from the selected recipient plant cells; and identifying a fertile transgenic plant that is resistant to soybean pathogens, particularly Asian Soybean Rust.

In another aspect of the invention there is provided a fertile transgenic plant that comprises a plant expression cassette comprising an R-Gene and wherein the plant is resistant to soybean pathogens, particularly Asian Soybean Rust.

In another aspect of the invention there is provided a method of controlling ASR in a field comprising the step of planting the seed from a plant comprising an R-gene of the invention.

Thus, it is an object of the presently disclosed subject matter to provide methods for conveying pathogen resistance into non-resistant soybean germplasm or plant lines.

Further the presently disclosed subject matter provides novel *Glycine max* lines comprising in its genome a R-gene that is derived from *Glycine tomentella* and further confers Asian soybean rust resistance (herein, 'ASR') in said novel *Glycine max* line. Soybean plants and/or germplasms identified, produced or selected by the methods of this invention are also provided, as are any progeny and/or seeds derived from a soybean plant or germplasm identified, produced or selected by these methods.

As still a further aspect, the invention encompasses transgenic plants comprising a plant cell, plant part, nucleotide sequence, expression cassette, vector and/or R-genes of the invention.

As a further aspect are seeds that produce the transgenic plants of the invention and seeds produced by the transgenic plants of the invention.

Also provided are harvested products derived from the transgenic plants of the invention, wherein the harvested product optionally comprises a nucleotide sequence, expression cassette, vector and/or R-gene of the invention. Further provided are processed products derived from the harvested products of the invention, wherein the harvested product optionally comprises a nucleotide sequence, expression cassette, vector and/or R-gene of the invention.

Still further, the invention provides as an additional aspect a method of producing a transgenic plant with increased resistance to a soybean pathogen. In embodiments, the method comprises introducing into a plant a polynucleotide, expression cassette, or vector of the invention, wherein the R-gene is expressed in the plant, thereby producing a transgenic plant with increased resistance to a soybean pathogen. Optionally, the introducing step comprises: (i) transforming a plant cell with the polynucleotide, expression cassette or vector and regenerating a transgenic plant; or (ii) crossing a first plant comprising the polynucleotide, expression cassette or vector with a second plant. In embodiments, the method further comprises producing a seed from the transgenic plant. In embodiments, the method further comprises obtaining a progeny plant from the transgenic plant, wherein the progeny plant comprises the polynucleotide, the expression cassette or the vector, expresses the R-gene and has increased resistance to a soybean pathogen.

As yet another aspect, the invention provides a method of producing a transgenic plant with increased resistance to a soybean plant pathogen (e.g., Asian Soybean Rust), the method comprising: (a) planting a seed comprising a polynucleotide, expression cassette or vector of the invention; and (b) growing a transgenic plant from the seed, wherein the transgenic plant comprises the polynucleotide, expression cassette or vector and produces the R-gene and has increased resistance to a soybean pathogen. In embodiments, the method further comprises: (c) harvesting a seed from the transgenic plant of (b), wherein the harvested seed comprises the polynucleotide, expression cassette, vector and/or the R-gene.

Still further, as another aspect, the invention provides a method of producing a seed. In embodiments, the method comprises: (a) providing a transgenic plant that comprises a polynucleotide, expression cassette or vector of the invention; and (b) harvesting a seed from the transgenic plant of (a), wherein the harvested seed comprises the polynucleotide, expression cassette or vector and/or a R-gene of the invention.

The invention further contemplates a method of producing a hybrid plant seed. In representative embodiments, the method comprises: (a) crossing a first inbred plant, which is a transgenic plant comprising a polynucleotide, expression cassette or vector of the invention with a different inbred plant, which may or may not comprise a polynucleotide, expression cassette or vector of the invention; and (b) allowing a hybrid seed to form.

The invention is also drawn to methods of using the polynucleotides of the invention, for example, in DNA constructs or expression cassettes or vectors for transformation and expression in organisms, including plants. The nucleotide or amino acid sequences may be native or synthetic sequences that have been designed for expression in an organism such as a plant.

In embodiments, the invention provides a method of using a polynucleotide, expression cassette or vector of the invention to produce a transgenic seed, where the transgenic seed grows a transgenic plant with increased resistance to a soybean pathogen.

The foregoing and other objects and aspects of the present invention are explained in detail in the drawings and specification set forth below.

BRIEF DESCRIPTION OF THE SEQUENCE LISTING

SEQ ID NOs: 1 & 2 are chromosomal intervals derived from *Glycine tomentella* line accession PI441001 referred to herein as "Scaffold 46840" and "Scaffold 49652" respectively. Scaffold 49652 has been mapped to *G. tomentella* chromosome 5 and Scaffold 46840 has been mapped to *G. tomentella* chromosome 5. SEQ ID NO. 3 is a chromosomal interval derived from *Glycine tomentella* line accession PI 483224 referred to herein as "Scaffold 002687F". Scaffold 002687F has been mapped to *G. tomentella* chromosome 5. SEQ ID NO. 4 is a chromosomal interval derived from *Glycine tomentella* line accession PI 583970 referred to herein as "Scaffold 001084F". Scaffold 001084F has been mapped to *G. tomentella* chromosome 5. SEQ ID NO: 5 is a chromosomal interval derived from *Glycine tomentella* line accession PI583970 herein referred to "Contig 000819F". Contig (000819F has been mapped to *G. tomentella* chromosome 5. Genetic population mapping studies for PI441001, PI483224 and PI 583970 indicate that *Glycine tomentella* Chromosome 5 contains chromosomal intervals highly associated with ASR resistance (e.g. as corresponding to SEQ ID NOs: 1-5). Further data, also indicates that *Glycine tomentella* accessions PI446958, PI499939, PI505220, PI499933, PI441008, PI505256, PI446961 and PI483224 can be used as a source for said chromosomal intervals or genes corresponding to SEQ ID NOs 1-5. These chromosomal intervals or portions thereof may be introduced (i.e. introgressed through use of embryo rescue & marker assisted breeding (MAB)) into *Glycine max* lines to create *Glycine max* lines resistant to various diseases such as ASR. Single nucleotide polymorphisms (SNP) within SEQ ID NOs 1-5 that are associated with ASR resistance are described in PCT Application No. PCT/US2017/036712, published as WO 2017/222827, incorporated herein by reference in its entirety.

Further research into the intervals led to the discovery of causative genes and associated native promoters and terminator sequences were identified from the above interval(s) located or corresponding to on *Glycine tomentella* Chromosome 5.

Figure 1:
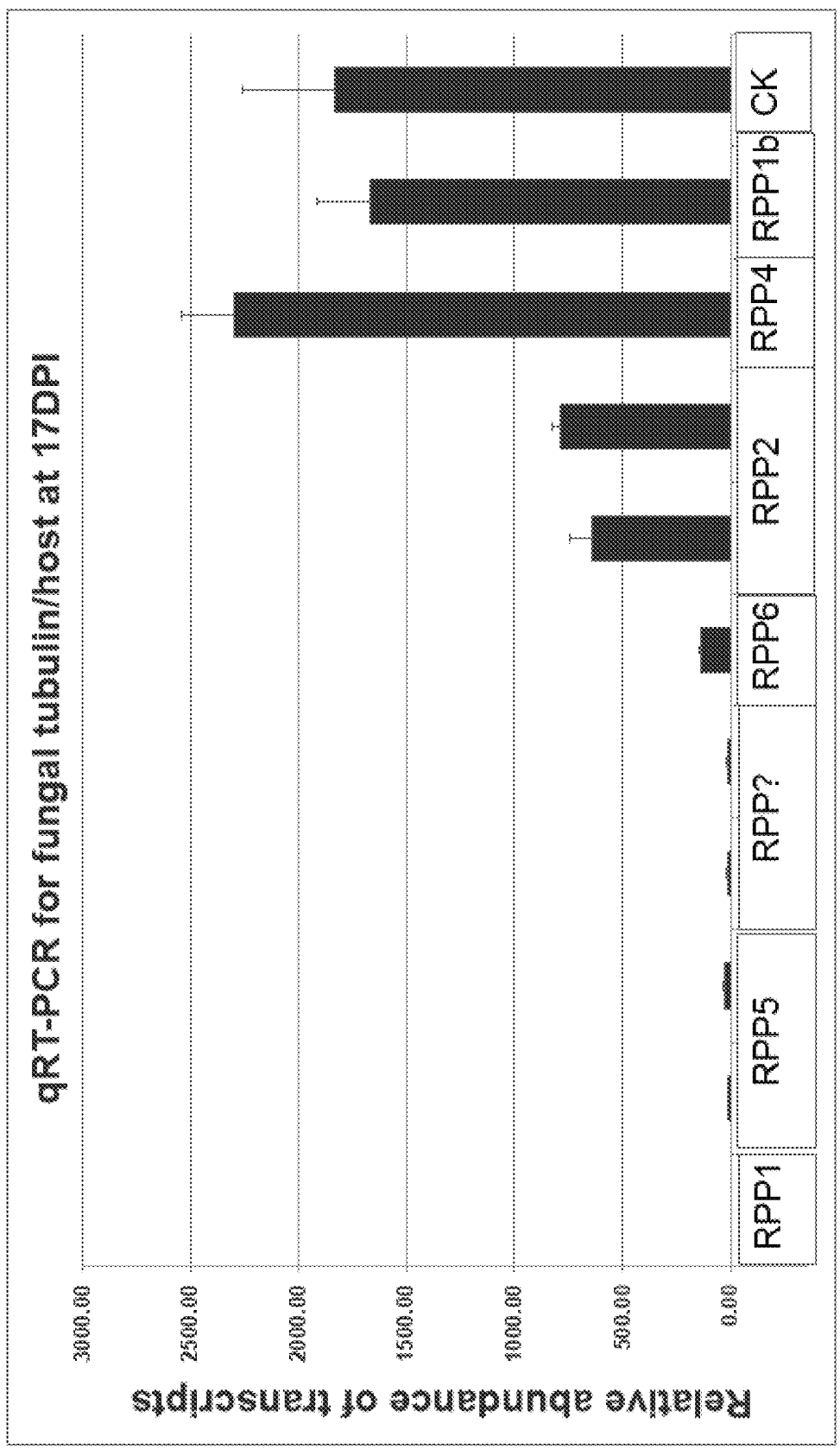
FIG. 1. qRT-PCR measurement of fungal b-tubulin of differential host panel. The measurement correlate well with the phenotypic ratings.
Figure 2:
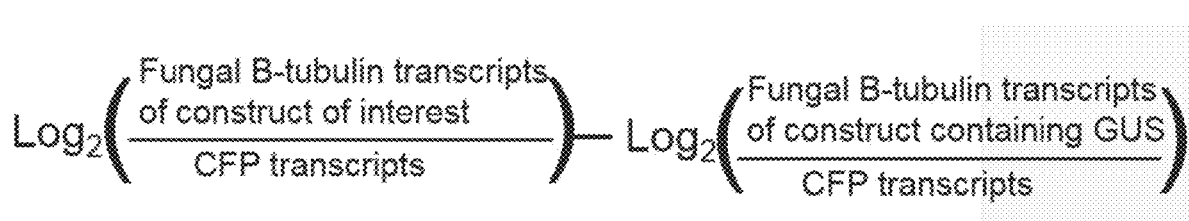
FIG. 2. Formula used to process the qRT-PCR raw reads.
Figure 3:
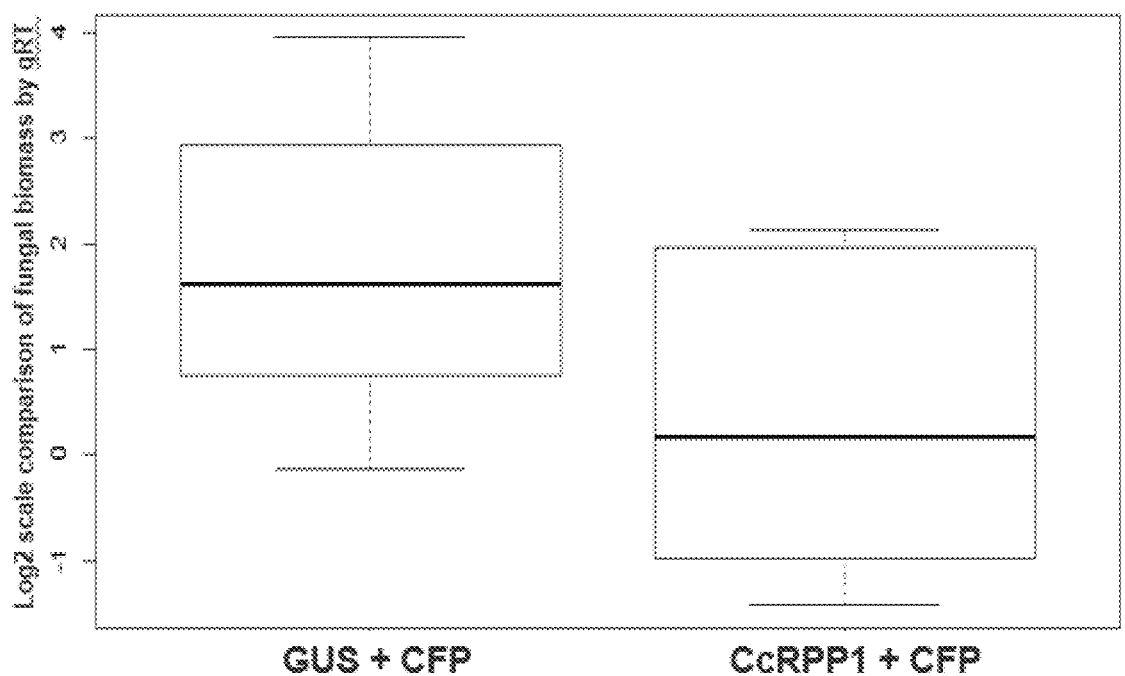
FIG. 3. Normalized fungal biomass with different constructs using known resistance gene CcRpp1 to validate the split leaf system FIG. 4. Alternate formula used to process the qRT-PCR raw reads.
Figure 5:
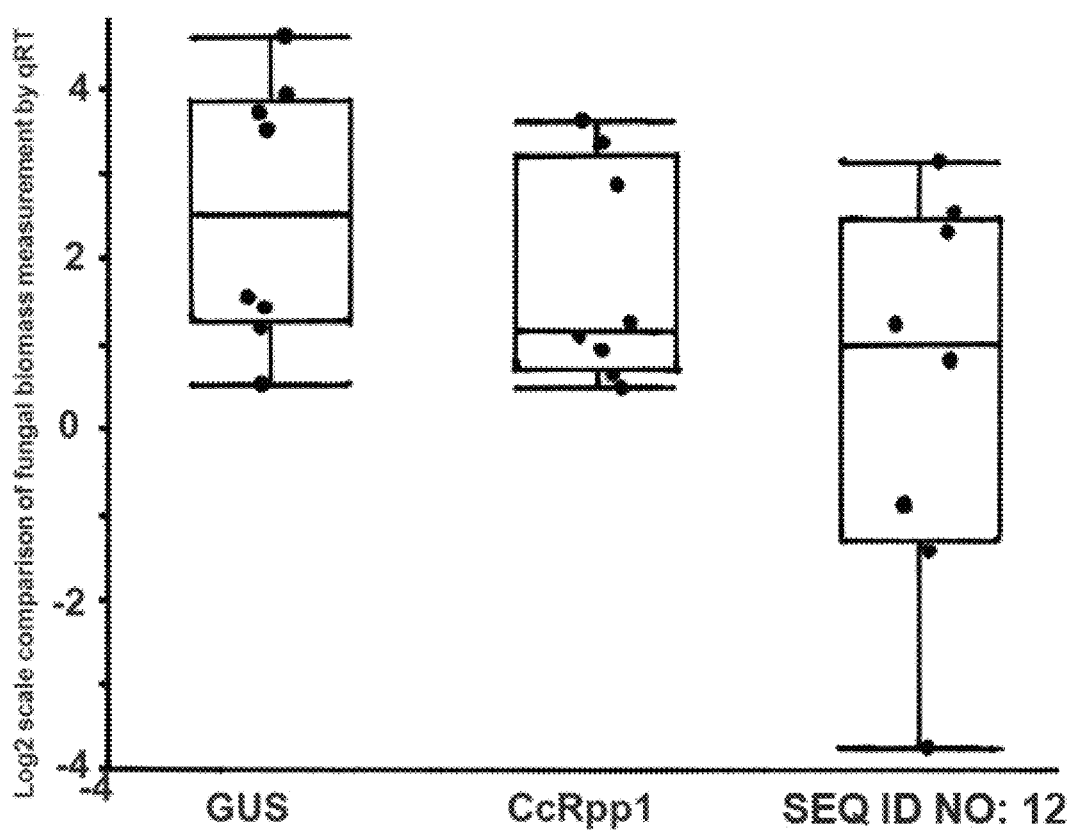
FIG. 5. Split leaf assay validation using CcRpp1, and a construct comprising SEQ ID NO: 12 showed significant disease reduction compared to the check.

SEQ ID NO: 6 is a soy rust resistance gene from PI441001 encoding a protein containing Toll/Interleukin-1 receptor (TIR), nucleotide-binding site (NBS), leucine rich-repeat (LRR), and WKRY domains syntenic to Glyma.05G165800 (Soy_william82_v2) (Herein, a "TNLW" R-gene motif); associated native promoter comprises SEQ ID NO: 7 and terminator sequence comprises SEQ ID NO: 8. SEQ ID NO: 6 encodes the protein of SEQ ID NO: 47.

SEQ ID NO: 9 is a soy rust resistance candidate gene from PI441001 that encodes a protein containing coiled-coiled (CC), nucleotide-binding site (NBS), and leucine rich repeat (LRR) domains. The gene is syntenic to Glyma.05G165600 (Soy_william82_v2) (Herein, a "CNL" R-gene motif); associated native promoter comprises SEQ ID NO: 10 and terminator sequence comprises SEQ ID NO: 11. SEQ ID NO: 9 encodes the protein of SEQ ID NO: 48.

SEQ ID NO: 12 is a soy rust resistance candidate gene from PI583970 that encodes a protein having a CNL R-gene motif; associated native promoter comprises SEQ ID NO: 13 and terminator sequence comprises SEQ ID NO: 14. SEQ ID NO. 12 encodes the protein of SEQ ID NO: 42.

SEQ ID NO: 15 is a soy rust resistance candidate gene from PI583970 that encodes a protein having a CNL R-gene motif; associated promoter used to validate comprises SEQ ID NO: 16 and terminator sequence comprises SEQ ID NO: 17. SEQ ID NO. 15 encodes the protein of SEQ ID NO: 43.

SEQ ID NO: 18 is a soy rust resistance candidate gene from PI583970 that encodes a protein having a CNL R-gene motif; associated promoter used to validate comprises SEQ ID NO: 19 and terminator sequence comprises SEQ ID NO: 20. SEQ ID NO. 18 encodes the protein of SEQ ID NO: 49.

SEQ ID NO: 21 is a soy rust resistance candidate gene from PI446958 that encodes a protein having a CNL R-gene motif; associated promoter used to validate comprises SEQ ID NO: 22 and terminator sequence comprises SEQ ID NO: 23. SEQ ID NO: 21 encodes the protein of SEQ ID NO: 44.

SEQ ID NO: 24 is a soy rust resistance candidate gene from PI446958 that encodes a protein having a CNL R-gene motif; associated native promoter comprises SEQ ID NO: 25 and terminator sequence comprises SEQ ID NO: 26. SEQ ID NO: 24 encodes the protein of SEQ ID NO: 45.

SEQ ID NO: 27 is a soy rust resistance candidate gene from PI446958 that encodes a protein having a CNL R-gene motif; associated promoter used to validate comprises SEQ ID NO: 28 and terminator sequence comprises SEQ ID NO: 29. SEQ ID NO: 27 encodes the protein of SEQ ID NO: 46. Vector Construction for the R-Gene comprising SEQ ID NO: 27 was done using a forward primer comprising SEQ ID NO: 51 and a reverse primer comprising SEQ ID NO: 52.

SEQ ID NO: 30 is a soy rust resistance candidate gene from PI583970 that encodes a protein having a TNLW R-gene motif; associated native promoter comprises SEQ ID NO: 31 and terminator sequence comprises SEQ ID NO: 32. SEQ ID NO: 30 encodes the protein of SEQ ID NO: 50.

Further intervals have been discovered in other *Glycine tomentella* lines as depicted Table 1 below that are associated with ASR resistance and correspond to the intervals described above having/comprising SEQ ID NOs 1-5 and also located on chromosome 5. Interval mapping indicates that ASR resistance can be found in both T1 and T2 *Glycine tomentella* lines. Further, it is contemplated that any of the source lines listed in Table 1 can be used to introduce ASR resistance into elite Soybean plants either by way of plant introgression through embryo rescue or via transgenic expression of genes encoding a protein having a CNL or TNLW R-gene motif or a gene having between 70-100% homology to any of SEQ ID NOs: 6, 9, 12, 15, 18, 21, 24, 27, or 30. Contig/Scaffolds 001082F, 000221F, 000342F, 003716F, 001879F, 001273F, 000866F, 000819F and 49562 are depicted in SEQ ID NOs: 33, 34, 35, 36, 37, 38, 49, 40, and 41 respectively. It is contemplated that homologous sequences with functional ASR resistance genes related to the R-Genes as depicted in SEQ ID NOs: 6, 9, 12, 15, 18, 21, 24, 27 and 30 can be located in the intervals and associated sequences of Table 1.

TABLE 1

Listing of others sources and scaffolds found to comprise intervals associated with increased resistance to Asian Soybean Rust.

| Genome type | Line | Contig/ Scaffold | begin | end |
|---|---|---|---|---|
| T1 | PI505220 | s49652 | 47,538 | 2,464,073 |
| T1 | PI499933 | s49652 | 42,441 | 2,481,008 |
| T1 | PI441008 | 000207F | 1,000,000 | 1,400,000 |
| T1 | PI441008 | 000819F | Whole Contig | Whole Contig |
| T1 | PI441008 | 000866F | Whole Contig | Whole Contig |
| T1 | PI441008 | 001273F | Whole Contig | Whole Contig |
| T1 | PI441008 | 001879F | Whole Contig | Whole Contig |
| T1 | PI441008 | 003716F | Whole Contig | Whole Contig |
| T2 | PI449658 | 000342F | 108,327 | End of contig |
| T2 | PI449658 | 000221F | Whole Contig | Whole Contig |
| T2 | PI449658 | 001082F | Beginning of Contig | 629,163 |

TABLE 1-continued

Listing of others sources and scaffolds found to comprise intervals associated with increased resistance to Asian Soybean Rust.

| Genome type | Line | Contig/ Scaffold | begin | end |
|---|---|---|---|---|
| T2 | PI446961 | 000342F | Whole Contig | Whole Contig |
| T2 | PI446961 | 000221F | Whole Contig | Whole Contig |
| T2 | PI446961 | 001082F | Beginning of Contig | 369,453 |
| T2 | PI505256 | 000342F | 203,123 | End of contig |
| T2 | PI505256 | 000221F | Whole Contig | Whole Contig |
| T2 | PI505256 | 001082F | Beginning of Contig | 326,515 |

DETAILED DESCRIPTION OF THE INVENTION

The presently disclosed subject matter relates to compositions and methods for introducing novel resistance genes (herein, "R-Genes") into commercial soybean plants to control soybean pathogens. The methods involve transforming organisms with nucleotide sequences encoding the R-genes of the invention. The nucleotide sequences of the invention are useful for preparing plants that show increased resistance to soybean pathogens, particularly Asian Soybean Rust (herein, "ASR"). Thus, transformed plants, plant cells, plant tissues and seeds are provided. Compositions include nucleic acids and proteins relating to soybean pathogen resistant plants as well as transformed plants, plant tissues and seeds. Nucleotide sequences of the R-genes and the amino acid sequences of the proteins encoded thereby are disclosed. The sequences find use in the construction of expression vectors for subsequent transformation into plants of interest, as probes for the isolation of other R-genes, and the like.

It is possible to produce soybean pathogen resistant plants by inserting into the plant genome a DNA molecule that provides for resistance (Cook et al, 2012 for SON resistance; Kawashima et al., 2016 for soy rust resistance from pigeon pea).

This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

All references listed below, as well as all references cited in the instant disclosure, including but not limited to all patents, patent applications and publications thereof, scientific journal articles, and database entries (e.g., GENBANK® database entries and all annotations available therein) are incorporated herein by reference in their entireties to the extent that they supplement, explain, provide a background for, or teach methodology, techniques, and/or compositions employed herein.

Nucleotide sequences provided herein are presented in the 5' to 3' direction, from left to right and are presented using the standard code for representing nucleotide bases as set forth in 37 CFR §§ 1.821-1.825 and the World Intellectual Property Organization (WIPO) Standard ST.25, for example: adenine (A), cytosine (C), thymine (T), and guanine (G).

Amino acids are likewise indicated using the WIPO Standard ST.25, for example: alanine (Ala; A), arginine (Arg; R), asparagine (Asn; N), aspartic acid (Asp; D), cysteine (Cys; C), glutamine (Gln; Q), glutamic acid (Glu; E), *glycine* (Gly; G), histidine (His; H), isoleucine (Ile; 1), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

Definitions

Unless defined otherwise, all technical and scientific terms used herein have the same meaning as commonly understood to one of ordinary skill in the art to which the presently disclosed subject matter belongs.

Although the following terms are believed to be well understood by one of ordinary skill in the art, the following definitions are set forth to facilitate understanding of the presently disclosed subject matter.

As used in the description of the invention and the appended claims, the singular forms "a," "an" and "the" are intended to include the plural forms as well, unless the context clearly indicates otherwise.

As used herein, "and/or" refers to and encompasses any and all possible combinations of one or more of the associated listed items, as well as the lack of combinations when interpreted in the alternative ("or").

The term "about," as used herein when referring to a measurable value such as a dosage or time period and the like, is meant to encompass variations of ±20%, ±10%, ±5%, ±1%, ±0.5%, or even ±0.1% of the specified amount. As used herein, phrases such as "between about X and Y" mean "between about X and about Y" and phrases such as "from about X to Y" mean "from about X to about Y."

As used herein, phrases such as "between about X and Y", "between about X and about Y", "from X to Y" and "from about X to about Y" (and similar phrases) should be interpreted to include X and Y, unless the context indicates otherwise.

A "coding sequence" is a nucleic acid sequence that is transcribed into RNA such as mRNA, rRNA, tRNA, snRNA, sense RNA or antisense RNA. In embodiments, the RNA is then translated to produce a protein.

As used herein, a "codon optimized" nucleotide sequence means a nucleotide sequence of a recombinant, transgenic, or synthetic polynucleotide wherein the codons are chosen to reflect the particular codon bias that a host cell or organism may have. This is typically done in such a way so as to preserve the amino acid sequence of the polypeptide encoded by the codon optimized nucleotide sequence. In certain embodiments, a nucleotide sequence is codon optimized for the cell (e.g., an animal, plant, fungal or bacterial cell) in which the construct is to be expressed. For example, a construct to be expressed in a plant cell can have all or parts of its sequence codon optimized for expression in a plant. See, for example, U.S. Pat. No. 6,121,014. In embodiments, the polynucleotides of the invention are codon-optimized for expression in a plant cell (e.g., a dicot cell or a monocot cell) or bacterial cell.

The term "comprise", "comprises" or "comprising," when used in this specification, indicates the presence of the stated features, integers, steps, operations, elements, or components, but does not preclude the presence or addition of one or more other features, integers, steps, operations, elements, components, and/or groups thereof.

As used herein, the transitional phrase "consisting essentially of" (and grammatical variants) means that the scope of a claim is to be interpreted to encompass the specified materials or steps recited in the claim "and those that do not materially alter the basic and novel characteristic(s)" of the claimed invention. Thus, the term "consisting essentially of" when used in a claim of this invention is not intended to be interpreted to be equivalent to "comprising."

"Expression cassette" as used herein means a nucleic acid molecule capable of directing expression of at least one polynucleotide of interest, such as a R-gene polynucleotide that encodes protein of the invention, in an appropriate host cell, comprising a promoter operably linked to the polynucleotide of interest which is operably linked to a termination signal. An "expression cassette" also typically comprises additional polynucleotides to facilitate proper translation of the polynucleotide of interest. The expression cassette may also comprise other polynucleotides not related to the expression of a polynucleotide of interest but which are present due to convenient restriction sites for removal of the cassette from an expression vector. In embodiments, at least one of the components in the expression cassette may be heterologous (i.e., foreign) with respect to at least one of the other components (e.g., a heterologous promoter operatively associated with a polynucleotide of interest). The expression cassette may also be one that is naturally occurring but has been obtained in a recombinant form useful for heterologous expression. Typically, however, the expression cassette is heterologous with respect to the host, i.e., the expression cassette (or even the polynucleotide of interest) does not occur naturally in the host cell and has been introduced into the host cell or an ancestor cell thereof by a transformation process or a breeding process. The expression of the polynucleotide(s) of interest in the expression cassette is generally under the control of a promoter. In the case of a multicellular organism, such as a plant, the promoter can also be specific or preferential to a particular tissue, or organ, or stage of development (as described in more detail herein). An expression cassette, or fragment thereof, can also be referred to as "inserted polynucleotide" or "insertion polynucleotide" when transformed into a plant.

A "gene" is defined herein as a hereditary unit comprising one or more polynucleotides that occupies a specific location on a chromosome or plasmid and that contains the genetic instruction for a particular characteristic or trait in an organism.

The term "introduced" as used herein, in connection to a plant, means accomplished by any manner including but not limited to; introgression, transgenic, Clustered Regularly Interspaced Short Palindromic Repeats modification (CRISPR), Transcription activator-like effector nucleases (TALENs) (Feng et al. 2013, Joung & Sander 2013), meganucleases, or zinc finger nucleases (ZFNs).

As used herein, the term "wild *glycine*" refers to a perennial *Glycine* plant, for example any one of *G. canescens, G. argyrea, G. clandestine, G. latrobeana, G. albicans, G. aphyonota, G. arenaria, G. curvata, G. cyrtoloba, G. dolichocarpa, G. falcate, G. gracei, G. hirticaulis, G. lactovirens, G. latifolia, G. microphylla, G. montis-douglas,*

*G. peratosa, G. pescadrensis, G. pindanica, G. pullenii, G. rubiginosa, G. stenophita, G. syndetika,* or *G. tomentella.*

As used herein, the term "allele" refers to one of two or more different nucleotides or nucleotide sequences that occur at a specific locus.

A marker is "associated with" a trait when it is linked to it and when the presence of the marker is an indicator of whether and/or to what extent the desired trait or trait form will occur in a plant/germplasm comprising the marker. Similarly, a marker is "associated with" an allele when it is linked to it and when the presence of the marker is an indicator of whether the allele is present in a plant/germplasm comprising the marker. For example, "a marker associated with enhanced pathogen resistance" refers to a marker whose presence or absence can be used to predict whether and/or to what extent a plant will display a pathogen resistant phenotype (e.g. any favorable SNP allele as described in Tables 1-5 are "associated with" ASR resistance in a soybean plant).

As used herein, the terms "backcross" and "backcrossing" refer to the process whereby a progeny plant is repeatedly crossed back to one of its parents. In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. For example, see Ragot, M. et al. *Marker-assisted Backcrossing: A Practical Example*, in TECHNIQUES ET UTILISATIONS DES MARQUEURS MOLECULAIRES LES COLLOQUES, Vol. 72, pp. 45-56 (1995); and Openshaw et al., *Marker-assisted Selection in Backcross Breeding*, in PROCEEDINGS OF THE SYMPOSIUM "ANALYSIS OF MOLECULAR MARKER DATA," pp. 41-53 (1994). The initial cross gives rise to the F1 generation. The term "BC1" refers to the second use of the recurrent parent, "BC2" refers to the third use of the recurrent parent, and so on.

A centimorgan ("cM") is a unit of measure of recombination frequency. One cM is equal to a 1% chance that a marker at one genetic locus will be separated from a marker at a second locus due to crossing over in a single generation.

As used herein, the term "chromosomal interval defined by and including," used in reference to particular loci and/or alleles, refers to a chromosomal interval delimited by and encompassing the stated loci/alleles.

As used herein, the terms "cross" or "crossed" refer to the fusion of gametes via pollination to produce progeny (e.g., cells, seeds or plants). The term encompasses both sexual crosses (the pollination of one plant by another) and selfing (self-pollination, e.g., when the pollen and ovule are from the same plant). The term "crossing" refers to the act of fusing gametes via pollination to produce progeny.

As used herein, the terms "cultivar" and "variety" refer to a group of similar plants that by structural or genetic features and/or performance can be distinguished from other varieties within the same species.

As used herein, the terms "desired allele", "favorable allele" and "allele of interest" are used interchangeably to refer to an allele associated with a desired trait (e.g. ASR resistance).

As used herein, the terms "enhanced pathogen resistance" or "enhanced disease resistance" refers to an improvement, enhancement, or increase in a plant's ability to endure and/or thrive despite being infected with a disease (e.g. Asian soybean rust) as compared to one or more control plants (e.g., one or both of the parents, or a plant lacking a marker associated with enhanced pathogen resistance to respective pathogen/disease). Enhanced disease resistance includes any mechanism (other than whole-plant immunity or resistance) that reduces the expression of symptoms indicative of infection for a respective disease such as Asian soybean rust, soybean cyst nematode, Pytophthora, etc.

An "elite line" or "elite strain" is an agronomically superior line that has resulted from many cycles of breeding and selection for superior agronomic performance. Numerous elite lines are available and known to those of skill in the art of soybean breeding. An "elite population" is an assortment of elite individuals or lines that can be used to represent the state of the art in terms of agronomically superior genotypes of a given crop species, such as soybean. Similarly, an "elite germplasm" or elite strain of germplasm is an agronomically superior germplasm, typically derived from and/or capable of giving rise to a plant with superior agronomic performance, such as an existing or newly developed elite line of soybean.

An "elite" plant is any plant from an elite line, such that an elite plant is a representative plant from an elite variety. Non-limiting examples of elite soybean varieties that are commercially available to farmers or soybean breeders include: AG00802, A0868, AG0902, A1923, AG2403, A2824, A3704, A4324, A5404, AG5903, AG6202 AG0934; AG1435; AG2031; AG2035; AG2433; AG2733; AG2933; AG3334; AG3832; AG4135; AG4632; AG4934; AG5831; AG6534; and AG7231 (Asgrow Seeds, Des Moines, Iowa, USA); BPR0144RR, BPR 4077NRR and BPR 4390NRR (Bio Plant Research, Camp Point, Ill., USA); DKB17-51 and DKB37-51 (DeKalb Genetics, DeKalb, Ill., USA); DP 4546 RR, and DP 7870 RR (Delta & Pine Land Company, Lubbock, Tex., USA); JG 03R501, JG 32R606C ADD and JG 55R503C (JGL Inc., Greencastle, Ind., USA); NKS 13-K2 (NK Division of Syngenta Seeds, Golden Valley, Minn., USA); 90M01, 91M30, 92M33, 93M11, 94M30, 95M30, 97652, P008T22R2; PI6T17R2; P22T69R; P25T51R; P34T07R2; P35T58R; P39T67R; P47T36R; P46T21R; and P56T03R2 (Pioneer Hi-Bred International, Johnston, Iowa, USA); 5G4771NRR and SG5161NRR/STS (Soygenetics, LLC, Lafayette, Ind., USA); S00-K5, S11-L2, S28-Y2, S43-61, S53-A1, S76-L9, S78-G6, S0009-M2; S007-Y4; S04-D3; S14-A6; S20-T6; S21-M7; S26-P3; S28-N6; S30-V6; S35-C3; S36-Y6; S39-C4; S47-K5; S48-D9; S52-Y2; S58-Z4; S67-R6; S73-S8; and S78-G6 (Syngenta Seeds, Henderson, Ky., USA); Richer (Northstar Seed Ltd. Alberta, Calif.); 14RD62 (Stine Seed Co. Ia., USA); or Armor 4744 (Armor Seed, LLC, Ar., USA).

The terms "agronomically elite" as used herein, means a genotype that has a culmination of many distinguishable traits such as emergence, vigor, vegetative vigor, disease resistance, seed set, standability, yield and threshability which allows a producer to harvest a product of commercial significance.

As used herein, the term "commercially significant yield" or "agronomically acceptable yield" refers to a grain yield of at least 100% of a commercial check variety such as AG2703 or DKB23-51.

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type mRNA" is an mRNA that is naturally occurring in or endogenous to the organism.

The terms "nucleic acid," "nucleic acid molecule," "nucleotide sequence," "oligonucleotide" and "polynucleotide" are used interchangeably herein, unless the context indicates otherwise, and refer to a heteropolymer of nucleotides. These terms include without limitation DNA and RNA molecules, including cDNA, genomic DNA, synthetic (e.g., chemically synthesized) DNA and RNA, plasmid DNA, mRNA, antisense RNA, and RNA/DNA hybrids, any of which can be linear or branched, single stranded or double stranded, or a combination thereof. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made. In embodiments, the "nucleic acid," "nucleic acid molecule,", "nucleotide sequence,", "oligonucleotide" or "polynucleotide" refer to DNA.

By "operably linked" or "operably associated" as used herein, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence, means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, sequences can be present between a promoter and a nucleotide sequence, and the promoter can still be considered "operably linked" to or "operatively associated" with the nucleotide sequence.

As used herein, the terms "disease tolerance" and "disease resistant" refer to a plant's ability to endure and/or thrive despite being infected with a respective disease. When used in reference to germplasm, the terms refer to the ability of a plant that arises from that germplasm to endure and/or thrive despite being infected with a respective disease. In some embodiments, infected Disease resistant soybean plants may yield as well (or nearly as well) as uninfected soybean plants. In general, a plant or germplasm is labeled as "Disease resistant" if it displays "enhanced pathogen resistance."

As used herein, the term "endogenous" refers to materials originating from within an organism or cell. "Exogenous" refers to materials originating from outside of an organism or cell. This typically applies to nucleic acid molecules used in producing transformed or transgenic host cells and plants.

As used herein, the terms "exotic," "exotic line" and "exotic germplasm" refer to any plant, line or germplasm that is not elite. In general, exotic plants/germplasms are not derived from any known elite plant or germplasm, but rather are selected to introduce one or more desired genetic elements into a breeding program (e.g., to introduce novel alleles into a breeding program).

As used herein, a "genetic map" is a description of genetic linkage relationships among loci on one or more chromosomes within a given species, generally depicted in a diagrammatic or tabular form. For each genetic map, distances between loci are measured by the recombination frequencies between them. Recombinations between loci can be detected using a variety of markers. A genetic map is a product of the mapping population, types of markers used, and the polymorphic potential of each marker between different populations. The order and genetic distances between loci can differ from one genetic map to another.

As used herein, the term "genome" as it applies to plant cells encompasses not only chromosomal DNA found within the nucleus, but organelle DNA found within subcellular components of the cell. The term "gene" refers to polynucleic acids that comprise chromosomal DNA, plasmid DNA, cDNA, an artificial DNA polynucleotide, or other DNA that is transcribed into an RNA molecule, wherein the RNA may encode a peptide, polypeptide, or protein, and the genetic elements flanking the coding sequence that are involved in the regulation of expression of the mRNA or polypeptide of the present invention. A "fragment" of a gene is a portion of a full-length polynucleic acid molecule that is of at least a minimum length capable of transcription into a RNA, translation into a peptide, or useful as a probe or primer in a DNA detection method.

As used herein, the term "genotype" refers to the genetic constitution of an individual (or group of individuals) at one or more genetic loci, as contrasted with the observable and/or detectable and/or manifested trait (the phenotype). Genotype is defined by the allele(s) of one or more known loci that the individual has inherited from its parents. The term genotype can be used to refer to an individual's genetic constitution at a single locus, at multiple loci, or more generally, the term genotype can be used to refer to an individual's genetic make-up for all the genes in its genome. Genotypes can be indirectly characterized, e.g., using markers and/or directly characterized by nucleic acid sequencing.

As used herein, the term "germplasm" refers to genetic material of or from an individual (e.g., a plant), a group of individuals (e.g., a plant line, variety or family), or a clone derived from a line, variety, species, or culture. The germplasm can be part of an organism or cell, or can be separate from the organism or cell. In general, germplasm provides genetic material with a specific molecular makeup that provides a physical foundation for some or all of the hereditary qualities of an organism or cell culture. As used herein, germplasm may refer to seeds, cells (including protoplasts and calli) or tissues from which new plants may be grown, as well as plant parts that can be cultured into a whole plant (e.g., stems, buds, roots, leaves, etc.).

As used herein, a "Heterologous DNA" sequence refers to a polynucleotide sequence that originates from a foreign source or species or, if from the same source, is modified from its original form.

As used herein, a "Homologous DNA" refers to DNA from the same source as that of the recipient cell.

As used herein, the term "hybrid" refers to a seed and/or plant produced when at least two genetically dissimilar parents are crossed.

As used herein, the term "Identity" refers to the degree of similarity between two polynucleic acid or protein sequences. An alignment of the two sequences is performed by a suitable algorithm. One widely used and accepted computer program for performing sequence alignments is CLUSTALW v1.6 (Thompson, et al. Nucl. Acids Res., 22: 4673-4680, 1994), although others are commonly used. The number of matching bases or amino acids is divided by the total number of bases or amino acids, and multiplied by 100 to obtain a percent identity. For example, if two 580 base pair sequences had 145 matched bases, they would be 25 percent identical. If the two compared sequences are of different lengths, the number of matches is divided by the shorter of the two lengths. For example, if there are 100 matched amino acids between 200 and 400 amino acid proteins, they are 50 percent identical with respect to the shorter sequence. If the shorter sequence is less than 150 bases or 50 amino acids in length, the number of matches are divided by 150 (for nucleic acid bases) or 50 (for amino acids), and multiplied by 100 to obtain a percent identity. In addition to identity positions, consensus positions are also commonly scored. Consensus amino acids are those known to have similar amino acid properties such as charge, size, polarity, and aromaticity.

As used herein, the term "inbred" refers to a substantially homozygous plant or variety. The term may refer to a plant or variety that is substantially homozygous throughout the entire genome or that is substantially homozygous with respect to a portion of the genome that is of particular interest.

As used herein, the term "indel" refers to an insertion or deletion in a pair of nucleotide sequences, wherein a first sequence may be referred to as having an insertion relative to a second sequence or the second sequence may be referred to as having a deletion relative to the first sequence.

As used herein, the terms "introgression," "introgressing" and "introgressed" refer to both the natural and artificial transmission of a desired allele or combination of desired alleles of a genetic locus or genetic loci from one genetic background to another. For example, a desired allele at a specified locus can be transmitted to at least one progeny via a sexual cross between two parents of the same species, where at least one of the parents has the desired allele in its genome. Alternatively, for example, transmission of an allele can occur by recombination between two donor genomes, e.g., in a fused protoplast, where at least one of the donor protoplasts has the desired allele in its genome. The desired allele may be a selected allele of a marker, a QTL, a transgene, or the like. Offspring comprising the desired allele can be repeatedly backcrossed to a line having a desired genetic background and selected for the desired allele, with the result being that the desired allele becomes fixed in the desired genetic background. For example, a marker associated with enhanced ASR tolerance may be introgressed from a donor into a recurrent parent that is not disease resistant. The resulting offspring could then be repeatedly backcrossed and selected until the progeny possess the ASR tolerance allele(s) in the recurrent parent background.

As used herein, an "isolated" nucleic acid molecule is substantially separated away from other nucleic acid sequences with which the nucleic acid is normally associated, such as, from the chromosomal or extrachromosomal DNA of a cell in which the nucleic acid naturally occurs. A nucleic acid molecule is an isolated nucleic acid molecule when it comprises a transgene or part of a transgene present in the genome of another organism. The term also embraces nucleic acids that are biochemically purified so as to substantially remove contaminating nucleic acids and other cellular components. The term "transgene" refers to any polynucleic acid molecule normative to a cell or organism transformed into the cell or organism. "Transgene" also encompasses the component parts of a native plant gene modified by insertion of a normative polynucleic acid molecule by directed recombination or site specific mutation.

A polypeptide is "isolated" if it has been separated from the cellular components (nucleic acids, lipids, carbohydrates, and other polypeptides) that naturally accompany it or that is chemically synthesized or recombinant. A polypeptide molecule is an isolated polypeptide molecule when it is expressed from a transgene in another organism. A monomeric polypeptide is isolated when at least 60% by weight of a sample is composed of the polypeptide, preferably 90% or more, more preferably 95% or more, and most preferably more than 99%. Protein purity or homogeneity is indicated, for example, by polyacrylamide gel electrophoresis of a protein sample, followed by visualization of a single polypeptide band upon staining the polyacrylamide gel; high pressure liquid chromatography; or other conventional methods. Proteins can be purified by any of the means known in the art, for example as described in Guide to Protein Purification, ed. Deutscher, Meth. Enzymol. 185, Academic Press, San Diego, 1990; and Scopes, Protein Purification: Principles and Practice, Springer Verlag, New York, 1982.

Using well-known methods, the skilled artisan can readily produce nucleotide and amino acid sequence variants of genes and proteins that provide a modified gene product. Chemical synthesis of nucleic acids can be performed, for example, on automated oligonucleotide synthesizers. Such variants preferably do not change the reading frame of the protein-coding region of the nucleic acid. The present invention also encompasses fragments of a protein that lacks at least one residue of a full-length protein, but that substantially maintains activity of the protein.

A "locus" is a position on a chromosome where a gene or marker or allele is located. In some embodiments, a locus may encompass one or more nucleotides.

A "non-naturally occurring variety of soybean" is any variety of soybean that does not naturally exist in nature. A "non-naturally occurring variety of soybean" may be produced by any method known in the art, including, but not limited to, transforming a soybean plant or germplasm, transfecting a soybean plant or germplasm and crossing a naturally occurring variety of soybean with a non-naturally occurring variety of soybean. In some embodiments, a "non-naturally occurring variety of soybean" may comprise one of more heterologous nucleotide sequences. In some embodiments, a "non-naturally occurring variety of soybean" may comprise one or more non-naturally occurring copies of a naturally occurring nucleotide sequence (i.e., extraneous copies of a gene that naturally occurs in soybean). In some embodiments, a "non-naturally occurring variety of soybean" may comprise a non-natural combination of two or more naturally occurring nucleotide sequences (i.e., two or more naturally occurring genes that do not naturally occur in the same soybean, for instance genes not found in *Glycine max* lines).

As used herein, the terms "phenotype," "phenotypic trait" or "trait" refer to one or more traits and/or manifestations of an organism. The phenotype can be a manifestation that is observable to the naked eye, or by any other means of evaluation known in the art, e.g., microscopy, biochemical analysis, or an electromechanical assay. In some cases, a phenotype or trait is directly controlled by a single gene or genetic locus, i.e., a "single gene trait." In other cases, a phenotype or trait is the result of several genes. It is noted that, as used herein, the term "disease resistant phenotype" takes into account environmental conditions that might affect the respective disease such that the effect is real and reproducible.

As used herein, the term "plant" may refer to a whole plant, any part thereof, or a cell or tissue culture derived from a plant. Thus, the term "plant" can refer to any of: whole plants, plant components or organs (e.g., roots, stems, leaves, buds, flowers, pods, etc.), plant tissues, seeds and/or plant cells. A plant cell is a cell of a plant, taken from a plant, or derived through culture from a cell taken from a plant. Thus, the term "soybean plant" may refer to a whole soybean plant, one or more parts of a soybean plant (e.g., roots, root tips, stems, leaves, buds, flowers, pods, seeds, cotyledons, etc.), soybean plant cells, soybean plant protoplasts and/or soybean plant calli.

A "plant cell" is a structural and physiological unit of a plant, comprising a protoplast and a cell wall. The plant cell may be in the form of an isolated single cell or a cultured cell, or as a part of a higher organized unit such as, for example, plant tissue, a plant organ, or a whole plant. In embodiments, the plant cell is non-propagating and/or cannot regenerate a whole plant.

A "plant cell culture" means a culture of plant units such as, for example, protoplasts, cell culture cells, cells in plant tissues, pollen, pollen tubes, ovules, embryo sacs, zygotes and embryos at various stages of development.

"Plant material" refers to leaves, stems, roots, flowers or flower parts, fruits, pollen, egg cells, zygotes, seeds, cuttings, cell or tissue cultures, or any other part or product of a plant.

A "plant organ" is a distinct and visibly structured and differentiated part of a plant such as a root, stem, leaf, flower bud, or embryo.

As used herein, the term "plant part" includes but is not limited to embryos, pollen, ovules, seeds, leaves, flowers, branches, fruit, stalks, roots, root tips, anthers, and/or plant cells including plant cells that are intact in plants and/or parts of plants, plant protoplasts, plant tissues, plant cell tissue cultures, plant calli, plant clumps, and the like.

"Plant tissue" as used herein means a group of plant cells organized into a structural and functional unit. Any tissue of a plant in planta or in culture is included. This term includes, but is not limited to, whole plants, plant organs, plant seeds, tissue culture and any groups of plant cells organized into structural or functional units. The use of this term in conjunction with, or in the absence of, any specific type of plant tissue as listed above or otherwise embraced by this definition is not intended to be exclusive of any other type of plant tissue.

"Polyadenylation signal" or "polyA signal" refers to a nucleic acid sequence located 3' to a coding region that causes the addition of adenylate nucleotides to the 3' end of the mRNA transcribed from the coding region.

"Polymerase chain reaction (PCR)" refers to a DNA amplification method that uses an enzymatic technique to create multiple copies of one sequence of nucleic acid (amplicon). Copies of a DNA molecule are prepared by shuttling a DNA polymerase between two amplimers. The basis of this amplification method is multiple cycles of temperature changes to denature, then re-anneal amplimers (DNA primer molecules), followed by extension to synthesize new DNA strands in the region located between the flanking amplimers. Nucleic-acid amplification can be accomplished by any of the various nucleic-acid amplification methods known in the art, including the polymerase chain reaction (PCR). A variety of amplification methods are known in the art and are described, inter alia, in U.S. Pat. Nos. 4,683,195 and 4,683,202 and in PCR Protocols: A Guide to Methods and Applications, ed. Innis et al., Academic Press, San Diego, 1990. PCR amplification methods have been developed to amplify up to 22 kb of genomic DNA and up to 42 kb of bacteriophage DNA (Cheng et al., Proc. Natl. Acad. Sci. USA 91:5695-5699, 1994). These methods as well as other methods known in the art of DNA amplification may be used in the practice of the present invention.

As used herein, the term "primer" refers to an oligonucleotide which is capable of annealing to a nucleic acid target and serving as a point of initiation of DNA synthesis when placed under conditions in which synthesis of a primer extension product is induced (e.g., in the presence of nucleotides and an agent for polymerization such as DNA polymerase and at a suitable temperature and pH). A primer (in some embodiments an extension primer and in some embodiments an amplification primer) is in some embodiments single stranded for maximum efficiency in extension and/or amplification. In some embodiments, the primer is an oligodeoxyribonucleotide. A primer is typically sufficiently long to prime the synthesis of extension and/or amplification products in the presence of the agent for polymerization. The minimum length of the primer can depend on many factors, including, but not limited to temperature and composition (A/T vs. G/C content) of the primer. In the context of amplification primers, these are typically provided as a pair of bi-directional primers consisting of one forward and one reverse primer or provided as a pair of forward primers as commonly used in the art of DNA amplification such as in PCR amplification. As such, it will be understood that the term "primer," as used herein, can refer to more than one primer, particularly in the case where there is some ambiguity in the information regarding the terminal sequence(s) of the target region to be amplified. Hence, a "primer" can include a collection of primer oligonucleotides containing sequences representing the possible variations in the sequence or includes nucleotides which allow a typical base pairing. Primers can be prepared by any suitable method known in the art. Methods for preparing oligonucleotides of specific sequence are known in the art, and include, for example, cloning and restriction of appropriate sequences and direct chemical synthesis. Chemical synthesis methods can include, for example, the phospho di- or tri-ester method, the diethylphosphoramidate method and the solid support method disclosed in U.S. Pat. No. 4,458,066. Primers can be labeled, if desired, by incorporating detectable moieties by for instance spectroscopic, fluorescence, photochemical, biochemical, immunochemical, or chemical moieties. Primers diagnostic (i.e. able to identify or select based on presence of ASR resistant alleles) for ASR resistance can be created to any favorable SNP as described in any one of Tables 1-5. The PCR method is well described in handbooks and known to the skilled person. After amplification by PCR, target polynucleotides can be detected by hybridization with a probe polynucleotide, which forms a stable hybrid with the target sequence under stringent to moderately stringent hybridization and wash conditions. If it is expected that the probes are essentially completely complementary (i.e., about 99% or greater) to the target sequence, stringent conditions can be used. If some mismatching is expected, for example if variant strains are expected with the result that the probe will not be completely complementary, the stringency of hybridization can be reduced. In some embodiments, conditions are chosen to rule out non-specific/adventitious binding. Conditions that affect hybridization, and that select against non-specific binding are known in the art, and are described in, for example, Sambrook & Russell (2001). Molecular Cloning: A Laboratory Manual, Third Edition, Cold Spring Harbor Laboratory Press, Cold Spring Harbor, N.Y., United States of America. Generally, lower salt concentration and higher temperature hybridization and/or washes increase the stringency of hybridization conditions.

As used herein, the terms "progeny" and "progeny plant" refer to a plant generated from a vegetative or sexual reproduction from one or more parent plants. A progeny plant may be obtained by cloning or selfing a single parent plant, or by crossing two parental plants.

The term "promoter" or "promoter region" refers to a polynucleic acid molecule that functions as a regulatory element, usually found upstream (5') to a coding sequence, that controls expression of the coding sequence by controlling production of messenger RNA (mRNA) by providing the recognition site for RNA polymerase and/or other factors necessary for start of transcription at the correct site. As contemplated herein, a promoter or promoter region includes variations of promoters derived by means of ligation to various regulatory sequences, random or controlled mutagenesis, and addition or duplication of enhancer sequences. The promoter region disclosed herein, and biologically functional equivalents thereof, are responsible for driving the transcription of coding sequences under their control when introduced into a host as part of a suitable recombinant DNA construct, as demonstrated by its ability to produce mRNA.

A "recombinant" nucleic acid is made by a combination of two otherwise separated segments of nucleic acid sequence, for example, by chemical synthesis or by the manipulation of isolated segments of polynucleic acids by genetic engineering techniques. The term "recombinant DNA construct" refers to any agent such as a plasmid, cosmid, virus, autonomously replicating sequence, phage, or linear or circular single-stranded or double-stranded DNA or RNA nucleotide sequence, derived from any source, capable of genomic integration or autonomous replication, comprising a DNA molecule that one or more DNA sequences have been linked in a functionally operative manner. Such recombinant DNA constructs are capable of introducing a 5' regulatory sequence or promoter region and a DNA sequence for a selected gene product into a cell in such a manner that the DNA sequence is transcribed into a functional mRNA that is translated and therefore expressed. Recombinant DNA constructs may be constructed to be capable of expressing antisense RNAs, or stabilized double stranded antisense RNAs.

The phrase "substantially identical," in the context of two nucleic acids or two amino acid sequences, refers to two or more sequences or subsequences that have at least about 50% nucleotide or amino acid residue identity when compared and aligned for maximum correspondence as measured using a sequence comparison algorithm or by visual inspection. In certain embodiments, substantially identical sequences have at least about 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or more nucleotide or amino acid residue identity. In certain embodiments, substantial identity exists over a region of the sequences that is at least about 50 amino acid residues, 100 amino acid residues, 150 amino acid residues, 200 amino acid residues, 250 amino acid residues, 300 amino acid residues, 350 amino acid residues, 400 amino acid residues, 450 amino acid residues, 500 amino acid residues, 525 amino acid residues, 526, amino acid residues 527 amino acid residues, 528 amino acid residues, 529 amino acid residues, 530 amino acid residues, 531 amino acid residues, 532 amino acid residues, 533 amino acid residues, 534 amino acid residues, 535 amino acid residues, 536 amino acid residues or more with respect to the protein sequence or the nucleotide sequence encoding the same. In further embodiments, the sequences are substantially identical when they are identical over the entire length of the coding regions.

"Identity" or "percent identity" refers to the degree of identity between two nucleic acid or amino acid sequences. For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2: 482 (1981), by the homology alignment algorithm of Needleman & Wunsch, J. Mol. Biol. 48: 443 (1970), by the search for similarity method of Pearson & Lipman, Proc. Nat'l. Acad. Sci. USA 85: 2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally,).

One example of an algorithm that is suitable for determining percent sequence identity and sequence similarity is the BLAST algorithm, which is described in Altschul et al., J. Mol. Biol. 215: 403-410 (1990). Software for performing BLAST analyses is publicly available through the National Center for Biotechnology Information (on the world wide web at ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., J. Mol. Biol. 215: 403-410 (1990)). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see, Henikoff & Henikoff, Proc. Natl. Acad. Sci. USA 89: 10915 (1989)).

In addition to calculating percent sequence identity, the BLAST algorithm also performs a statistical analysis of the similarity between two sequences (see, e.g., Karlin & Altschul, Proc. Nat'l. Acad. Sci. USA 90: 5873-5787 (1993)). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleic acid sequence to the reference nucleic acid sequence is less than about 0.1, more preferably less than about 0.01, and most preferably less than about 0.001.

Another widely used and accepted computer program for performing sequence alignments is CLUSTALW v1.6 (Thompson, et al. Nuc. Acids Res., 22: 4673-4680, 1994). The number of matching bases or amino acids is divided by the total number of bases or amino acids, and multiplied by 100 to obtain a percent identity. For example, if two 580 base pair sequences had 145 matched bases, they would be 25 percent identical. If the two compared sequences are of different lengths, the number of matches is divided by the shorter of the two lengths. For example, if there were 100 matched amino acids between a 200 and a 400 amino acid proteins, they are 50 percent identical with respect to the shorter sequence. If the shorter sequence is less than 150 bases or 50 amino acids in length, the number of matches are divided by 150 (for nucleic acid bases) or 50 (for amino acids), and multiplied by 100 to obtain a percent identity.

Two nucleotide sequences can also be considered to be substantially identical when the two sequences hybridize to each other under stringent conditions. In representative embodiments, two nucleotide sequences considered to be substantially identical hybridize to each other under highly stringent conditions.

The terms "stringent conditions" or "stringent hybridization conditions" include reference to conditions under which a nucleic acid will selectively hybridize to a target sequence to a detectably greater degree than other sequences (e.g., at least 2-fold over a non-target sequence), and optionally may substantially exclude binding to non-target sequences. Stringent conditions are sequence-dependent and will vary under different circumstances. By controlling the stringency of the hybridization and/or washing conditions, target sequences can be identified that can be up to 100% complementary to the reference nucleotide sequence. Alternatively, conditions of moderate or even low stringency can be used to allow some mismatching in sequences so that lower degrees of sequence similarity are detected. For example, those skilled in the art will appreciate that to function as a primer or probe, a nucleic acid sequence only needs to be sufficiently complementary to the target sequence to substantially bind thereto so as to form a stable double-stranded structure under the conditions employed. Thus, primers or probes can be used under conditions of high, moderate or even low stringency. Likewise, conditions of low or moderate stringency can be advantageous to detect homolog, ortholog and/or paralog sequences having lower degrees of sequence identity than would be identified under highly stringent conditions.

The terms "complementary" or "complementarity" (and similar terms), as used herein, refer to the natural binding of polynucleotides under permissive salt and temperature conditions by base-pairing. For example, the sequence "A-G-T" binds to the complementary sequence "T-C-A." Complementarity between two single-stranded molecules may be partial, in which only some of the nucleotides bind, or it may be complete when total complementarity exists between the single stranded molecules. The degree of complementarity between nucleic acid strands has significant effects on the efficiency and strength of hybridization between the molecules. As used herein, the term "substantially complementary" (and similar terms) means that two nucleic acid sequences are at least about 50%, 60%, 70%, 75%, 80%, 85%, 90%, 95%, 96%, 97%, 98%, 99% or more complementary. Alternatively, the term "substantially complementary" (and similar terms) can mean that two nucleic acid sequences can hybridize together under high stringency conditions (as described herein).

As used herein, "specifically" or "selectively" hybridizing (and similar terms) refers to the binding, duplexing, or hybridizing of a molecule to a particular nucleic acid target sequence under stringent conditions when that sequence is present in a complex mixture (e.g., total cellular DNA or RNA) to the substantial exclusion of non-target nucleic acids, or even with no detectable binding, duplexing or hybridizing to non-target sequences. Specifically or selectively hybridizing sequences typically are at least about 40% complementary and are optionally substantially complementary or even completely complementary (i.e., 100% identical).

For DNA-DNA hybrids, the $T_m$ can be approximated from the equation of Meinkoth and Wahl, Anal. Biochem., 138: 267-84 (1984): $T_m=81.5°$ C.$+16.6$ (log M)$+0.41$ (% GC)$-0.61$ (% formamide)$-500/L$; where M is the molarity of monovalent cations, % GC is the percentage of guanosine and cytosine nucleotides in the DNA, % formamide is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired degree of identity. For example, if sequences with >90% identity are sought, the $T_m$ can be decreased 10° C. Generally, stringent conditions are selected to be about 5° C. lower than the thermal melting point ($T_m$) for the specific sequence and its complement at a defined ionic strength and pH. However, highly stringent conditions can utilize a hybridization and/or wash at the thermal melting point ($T_m$) or 1, 2, 3 or 4° C. lower than the thermal melting point ($T_m$); moderately stringent conditions can utilize a hybridization and/or wash at 6, 7, 8, 9 or 10° C. lower than the thermal melting point ($T_m$); low stringency conditions can utilize a hybridization and/or wash at 11, 12, 13, 14, 15 or 20° C. lower than the thermal melting point ($T_m$). If the desired degree of mismatching results in a $T_m$ of less than 45° C. (aqueous solution) or 32° C. (formamide solution), optionally the SSC concentration can be increased so that a higher temperature can be used. An extensive guide to the hybridization of nucleic acids is found in Tijssen, Laboratory Techniques in Biochemistry and Molecular Biology-Hybridization with Nucleic Acid Probes, part I, chapter 2, "Overview of principles of hybridization and the strategy of nucleic acid probe assays," Elsevier, New York (1993); Current Protocols in Molecular Biology, chapter 2, Ausubel, et al., eds, Greene Publishing and Wiley-Interscience, New York (1995); and Green & Sambrook, In: Molecular Cloning, A Laboratory Manual, 4th Edition, Cold Spring Harbor Press, Cold Spring Harbor, N.Y. (2012).

Typically, stringent conditions are those in which the salt concentration is less than about 1.5 M Na ion, typically about 0.01 to 1.0 M Na ion concentration (or other salts) at about pH 7.0 to pH 8.3 and the temperature is at least about 30° C. for short probes (e.g., 10 to 50 nucleotides) and at least about 60° C. for longer probes (e.g., greater than 50 nucleotides). Stringent conditions may also be achieved with the addition of destabilizing agents such as formamide or Denhardt's (5 g Ficoll, 5 g polyvinylpyrrolidone, 5 g bovine serum albumin in 500 ml of water). Exemplary low stringency conditions include hybridization with a buffer solution of 30% to 35% formamide, 1 M NaCl, 1% SDS (sodium dodecyl sulfate) at 37° C. and a wash in 1× to 2×SSC (20×SSC=3.0 M NaCl/0.3 M trisodium citrate) at 50° C. to 55° C. Exemplary moderate stringency conditions include hybridization in 40% to 45% formamide, 1 M NaCl, 1% SDS at 37° C. and a wash in 0.5× to 1×SSC at 55° C. to 60° C. Exemplary high stringency conditions include hybridization in 50% formamide, 1 M NaCl, 1% SDS at 37° C. and a wash in 0.1×SSC at 60° C. to 65° C. A further non-limiting example of high stringency conditions include hybridization in 4×SSC, 5×Denhardt's, 0.1 mg/ml boiled salmon sperm DNA, and 25 mM Na phosphate at 65° C. and a wash in 0.1×SSC, 0.1% SDS at 65° C. Another illustration of high stringency hybridization conditions includes hybridization in 7% SDS, 0.5 M NaPO$_4$, 1 mM EDTA at 50° C. with washing in 2×SSC, 0.1% SDS at 50° C., alternatively with washing in 1×SSC, 0.1% SDS at 50° C., alternatively with washing in 0.5×SSC, 0.1% SDS at 50° C., or alternatively with washing in 0.1×SSC, 0.1% SDS at 50° C., or even with washing in 0.1×SSC, 0.1% SDS at 65° C. Those skilled in the art will appreciate that specificity is typically a function of post-hybridization washes, the relevant factors being the ionic strength and temperature of the final wash solution.

Nucleic acids that do not hybridize to each other under stringent conditions are still substantially identical if the proteins that they encode are substantially identical (e.g., due to the degeneracy of the genetic code).

A further indication that two nucleic acids or proteins are substantially identical is that the protein encoded by the first nucleic acid is immunologically cross reactive with the protein encoded by the second nucleic acid. Thus, a protein is typically substantially identical to a second protein, for example, where the two proteins differ only by conservative substitutions.

The term "vector" refers to a composition for transferring, delivering or introducing a nucleic acid (or nucleic acids) into a cell. A vector comprises a nucleic acid molecule comprising the nucleotide sequence(s) to be transferred, delivered or introduced.

Expression of an R-Gene Coding Sequence in Plants

DNA constructs are made that contain various genetic elements necessary for the expression of the R-Gene coding sequence in plants. "DNA construct" refers to the heterologous genetic elements operably linked to each other making up a recombinant DNA molecule and may comprise elements that provide expression of a DNA polynucleotide molecule in a host cell and elements that provide maintenance of the construct in the host cell. A plant expression cassette comprises the operable linkage of genetic elements that when transferred into a plant cell provides expression of a desirable gene product. "Plant expression cassette" refers to chimeric DNA segments comprising the regulatory elements that are operably linked to provide the expression of a transgene product in plants. Promoters, leaders, introns, transit peptide encoding polynucleic acids, 3' transcriptional termination regions are all genetic elements that may be operably linked by those skilled in the art of plant molecular biology to provide a desirable level of expression or functionality to an R-gene of the present invention. A DNA construct can contain one or more plant expression cassettes expressing the DNA molecules of the present invention or other DNA molecules useful in the genetic engineering of crop plants.

A variety of promoters specifically active in vegetative tissues, such as leaves, stems, roots and tubers, can be used to express the R-gene polynucleic acid molecules of the present invention.

The translation leader sequence means a DNA molecule located between the promoter of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences include maize and petunia heat shock protein leaders, plant virus coat protein leaders, plant rubisco gene leaders among others (Turner and Foster, Molecular Biotechnology 3:225, 1995).

The "3' non-translated sequences" means DNA sequences located downstream of a structural polynucleotide sequence and include sequences encoding polyadenylation and other regulatory signals capable of affecting mRNA processing or gene expression. The polyadenylation signal functions in plants to cause the addition of polyadenylate nucleotides to the 3' end of the mRNA precursor. The polyadenylation sequence can be derived from the natural gene, from a variety of plant genes, or from T-DNA. An example of the polyadenylation sequence is the nopaline synthase 3' sequence (nos 3'; Fraley et al., Proc. Natl. Acad. Sci. USA 80: 4803-4807, 1983). The use of different 3' non-translated sequences is exemplified by Ingelbrecht et al., Plant Cell 1:671-680, 1989.

The laboratory procedures in recombinant DNA technology used herein are those well-known and commonly employed in the art. Standard techniques are used for cloning, DNA and RNA isolation, amplification and purification. Generally enzymatic reactions involving DNA ligase, DNA polymerase, restriction endonucleases and the like are performed according to the manufacturer's specifications. These techniques and various other techniques are generally performed according to Sambrook et al. (1989).

The DNA construct of the present invention may be introduced into the genome of a desired plant host by a variety of conventional transformation techniques that are well known to those skilled in the art. "Transformation" refers to a process of introducing an exogenous polynucleic acid molecule (for example, a DNA construct, a recombinant polynucleic acid molecule) into a cell or protoplast and that exogenous polynucleic acid molecule is incorporated into a host cell genome or an organelle genome (for example, chloroplast or mitochondria) or is capable of autonomous replication. "Transformed" or "transgenic" refers to a cell, tissue, organ, or organism into which a foreign polynucleic acid, such as a DNA vector or recombinant polynucleic acid molecule. A "transgenic" or "transformed" cell or organism also includes progeny of the cell or organism and progeny produced from a breeding program employing such a "transgenic" plant as a parent in a cross and exhibiting an altered phenotype resulting from the presence of the foreign polynucleic acid molecule.

Methods of transformation of plant cells or tissues include, but are not limited to Agrobacterium mediated transformation method and the Biolistics or particle-gun mediated transformation method. Suitable plant transformation vectors for the purpose of Agrobacterium mediated transformation include-those elements derived from a tumor inducing (Ti) plasmid of Agrobacterium tumefaciens, for example, right border (RB) regions and left border (LB) regions, and others disclosed by Herrera-Estrella et al., Nature 303:209 (1983); Bevan, Nucleic Acids Res. 12:8711-8721 (1984); Klee et al., Bio-Technology 3(7):637-642 (1985). In addition to plant transformation vectors derived from the Ti or root-inducing (Ri) plasmids of Agrobacterium, alternative methods can be used to insert the DNA constructs of this invention into plant cells. Such methods may involve, but are not limited to, for example, the use of liposomes, electroporation, chemicals that increase free DNA uptake, free DNA delivery via microprojectile bombardment, and transformation using viruses or pollen.

DNA constructs can be prepared that incorporate the R-gene coding sequences of the present invention for use in directing the expression of the sequences directly from the host plant cell plastid. Examples of such constructs suitable for this purpose and methods that are known in the art and are generally described, for example, in Svab et al., Proc. Natl. Acad. Sci. USA 87:8526-8530, (1990) and Svab et al., Proc. Natl. Acad. Sci. USA 90:913-917 (1993) and in U.S. Pat. No. 5,693,507.

When adequate numbers of cells containing the exogenous polynucleic acid molecule encoding polypeptides from the present invention are obtained, the cells can be cultured, then regenerated into whole plants. "Regeneration" refers to the process of growing a plant from a plant cell (for example, plant protoplast or explant). Such regeneration techniques rely on manipulation of certain phytohormones in a tissue culture growth medium, typically relying on a biocide and/or herbicide marker that has been introduced together with the desired nucleotide sequences. Choice of methodology for the regeneration step is not critical See, for example, Ammirato et al., Handbook of Plant Cell Culture—Crop Species. Macmillan Publ. Co. (1984); Shimamoto et al., Nature 338:274-276 (1989); Fromm, UCLA Symposium on Molecular Strategies for Crop Improvement, Apr. 16-22, 1990. Keystone, Colo. (1990); Vasil et al., Bio/Technology 8:429-434 (1990); Vasil et al., Bio/Technology 10:667-674 (1992); Hayashimoto, Plant Physiol. 93:857-863 (1990); and Datta et al., Bio-technology 8:736-740 (1990). Such regeneration techniques are described generally in Klee et al., Ann. Rev. Plant Phys. 38:467-486 (1987).

The development or regeneration of transgenic plants containing the exogenous polynucleic acid molecule that encodes a polypeptide of interest is well known in the art. Preferably, the regenerated plants are self-pollinated to provide homozygous transgenic plants, as discussed above. Otherwise, pollen obtained from the regenerated plants is crossed to seed-grown plants of agronomically important lines. Conversely, pollen from plants of these important lines is used to pollinate regenerated plants.

Disease Resistant Soybean Plants and Germplasms

The present invention provides disease resistant soybean plants and germplasms. A Disease resistant soybean plant or germplasm may be produced by any method whereby an R-gene is introduced into the soybean plant or germplasm, including, but not limited to, transformation, protoplast transformation or fusion, a double haploid technique, embryo rescue, gene editing and/or by any other nucleic acid transfer system.

In some embodiments, the soybean plant or germplasm comprises a non-naturally occurring variety of soybean. In some embodiments, the soybean plant or germplasm is at least about 50%, 55%, 60%, 65%, 70%, 75%, 80%, 85%, 90%, 95%, 97%, 99% or 100% identical to that of an elite variety of soybean.

The disease resistant soybean plant or germplasm may be the progeny of a cross between an elite variety of soybean and a variety of soybean that comprises an R-gene for enhanced Disease tolerance (e.g. ASR) wherein the R-gene is selected from the group consisting of genes encoding a protein having a CNL or TNLW R-gene motif or a gene having between 70-100% homology to any of SEQ ID NOs: 6, 9, 12, 15, 18, 21, 24, 27, or 30.

The disease resistant soybean plant or germplasm may be the progeny of an introgression wherein the recurrent parent is an elite variety of soybean and the donor comprises an R-gene associated with enhanced disease tolerance and/or resistance wherein the donor carries a gene encoding a protein having a CNL or TNLW R-gene motif or a gene having between 70-100% homology to any of SEQ ID NOs: 6, 9, 12, 15, 18, 21, 24, 27, or 30.

The disease resistant soybean plant or germplasm may be the progeny of a cross between a first elite variety of soybean (e.g., a tester line) and the progeny of a cross between a second elite variety of soybean (e.g., a recurrent parent) and a variety of soybean that comprises an R-gene.

A disease resistant soybean plant and germplasm of the present invention may comprise one or R-genes of the present invention (e.g. any any of SEQ ID NOs: 6, 9, 12, 15, 18, 21, 24, 27, or 30).

Disease Resistant Soybean Seeds

The present invention provides disease resistant soybean seeds. As discussed above, the methods of the present invention may be utilized to identify, produce and/or select a disease resistant soybean seed. In addition to the methods described above, a disease resistant soybean seed may be produced by any method whereby an R-gene is introduced into the soybean seed, including, but not limited to, transformation, protoplast transformation or fusion, a double haploid technique, embryo rescue, genetic editing (e.g. CRISPR or TALEN or MegaNucleases) and/or by any other nucleic acid transfer system.

In some embodiments, the disease resistant soybean seed comprises a non-naturally occurring variety of soybean. In some embodiments, the soybean seed is at least about 50%, 55%, 60%, 65%, 70%, 75%, 80%, 85%, 90%, 95%, 97%, 99% or 100% identical to that of an elite variety of soybean.

The disease resistant soybean seed may be produced by a disease resistant soybean plant identified, produced or selected by the methods of the present invention.

A disease resistant soybean seed of the present invention may comprise, be selected by or produced by use of one or more R-genes of the present invention.

The embodiments of the invention include the following:

EXAMPLES

The following examples are not intended to be a detailed catalog of all the different ways in which the present invention may be implemented or of all the features that may be added to the present invention. Persons skilled in the art will appreciate that numerous variations and additions to the various embodiments may be made without departing from the present invention. Hence, the following descriptions are intended to illustrate some particular embodiments of the invention, and not to exhaustively specify all permutations, combinations and variations thereof.

Example 1 Identification of ASR Resistant Wild Glycine Lines

Multiple wild glycine (Glycine tomentella) lines were evaluated for ASR resistance against sixteen rust strains collected across a diverse range of environments. The rust data were generated using single pustule derived isolates from USDA-ARS (FL Q09, FL Q12, LABR13, FLQ11) and field populations (FL Q15, FLQ16, RTP1, RTP2, Vero, BR01, BR02 and BR03), the screening was carried out in contained facilities. Of the Glycine tomentella lines screened for ASR resistance, the following Glycine tomentella lines showed broad resistance against all ASR strains tested: PI441001, PI483224, PI583970, PI446958, PI499939, PI505220, PI499933, PI441008, PI505256 or PI446961.

Figure 6:
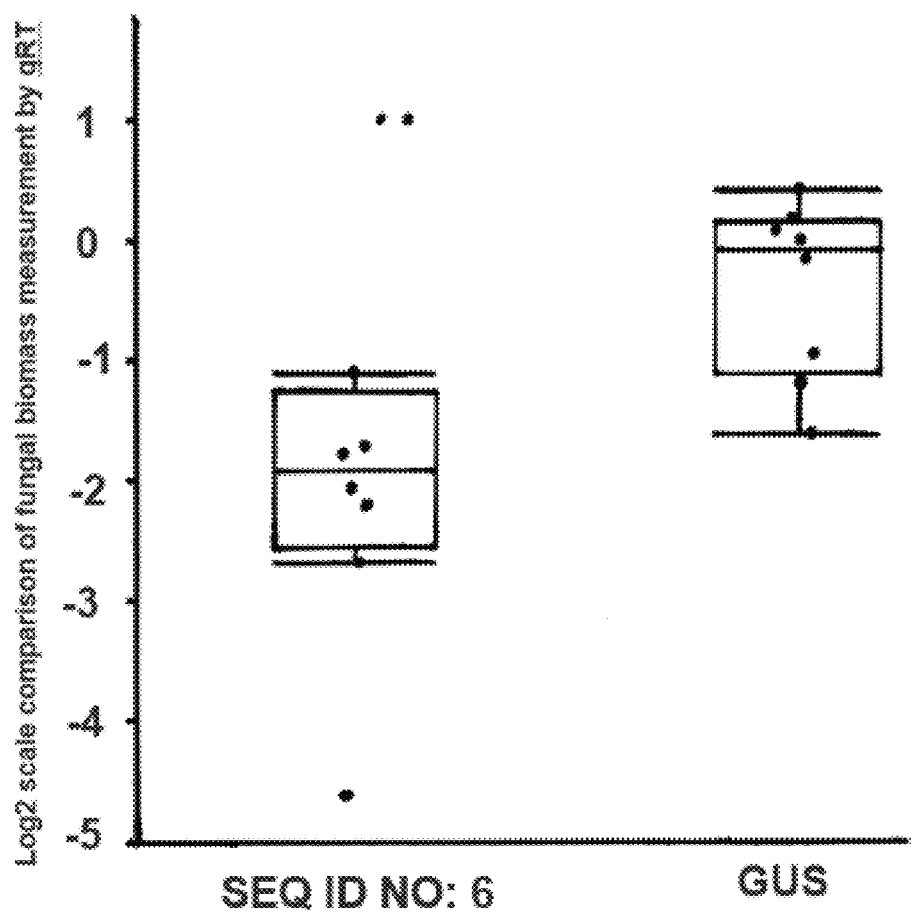
FIG. 6. Split leaf assay validation of SEQ ID NO: 6 showing significant disease reduction compared to check.

Each Glycine tomentella line was evaluated over a multiple day course of infection and rated at various time points using a rust rating scale based on groupings modified from Burdon and Speer, T A G, 1984 (see FIG. 6). Each Glycine tomentella accession was screened >2 times with ~4 plants each time in using a large diverse panel of rust isolates.

Figure 7:
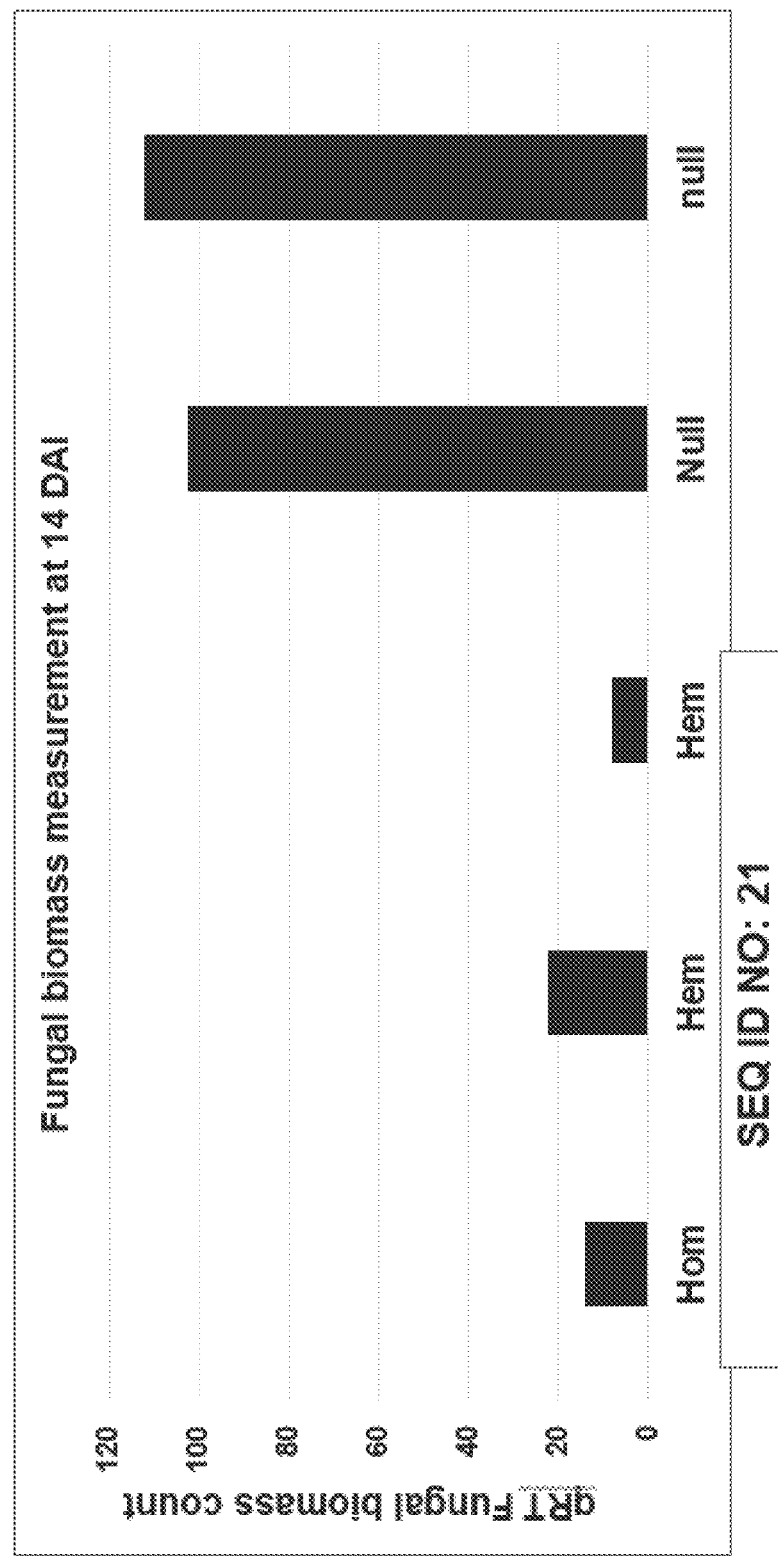
FIG. 7. Stable transformation (T1 events) results showing three events carrying SEQ ID NO: 21 delivering about 80% disease control. The bar is graphed as average of fungal b-tubulin transcripts FIG. 8. Stable transformation (T0 events) results showing two events carrying SEQ ID NO: 27 conferring resistance to soybean rust.
Figure 8:
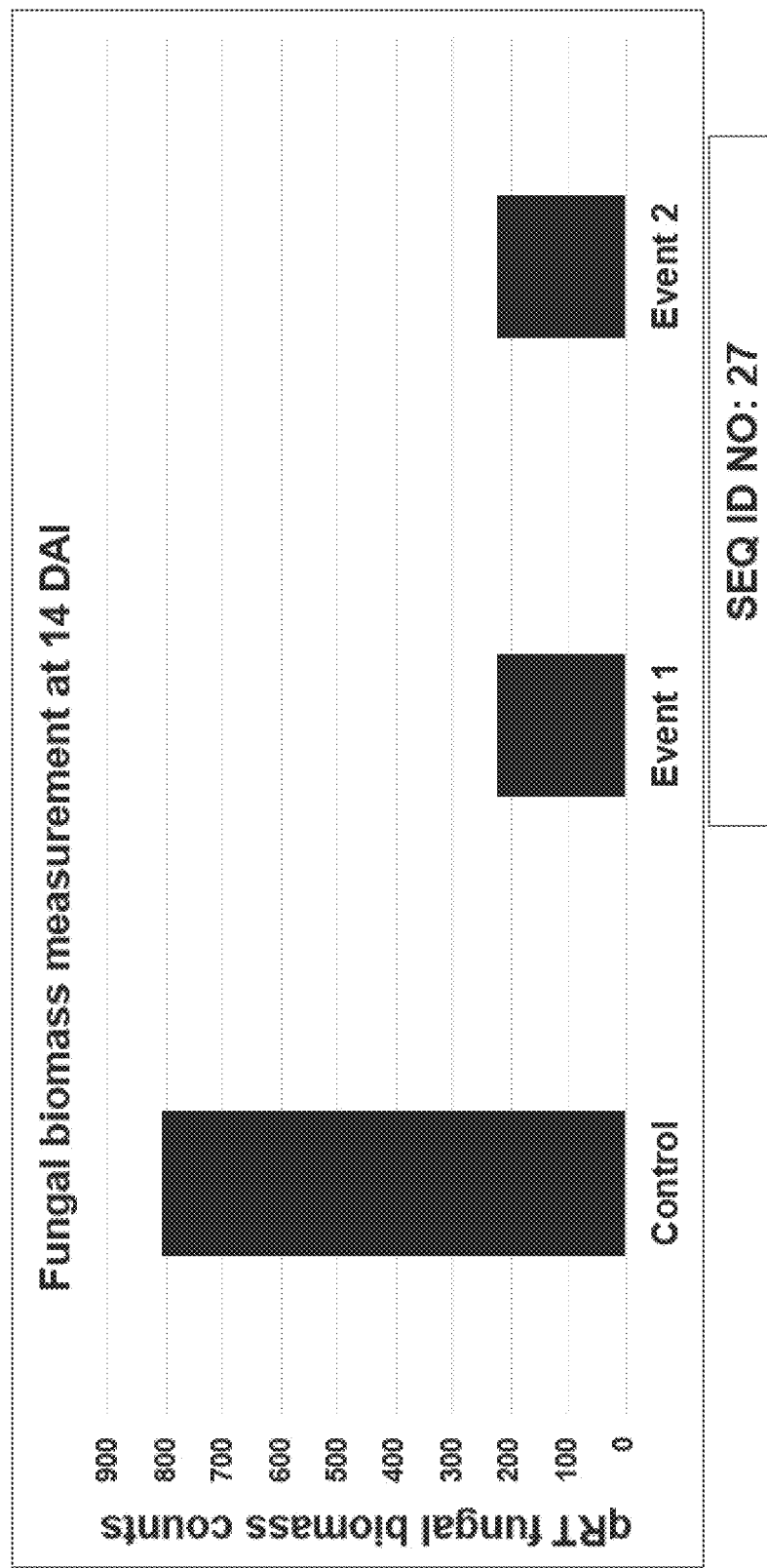
Figure 9:
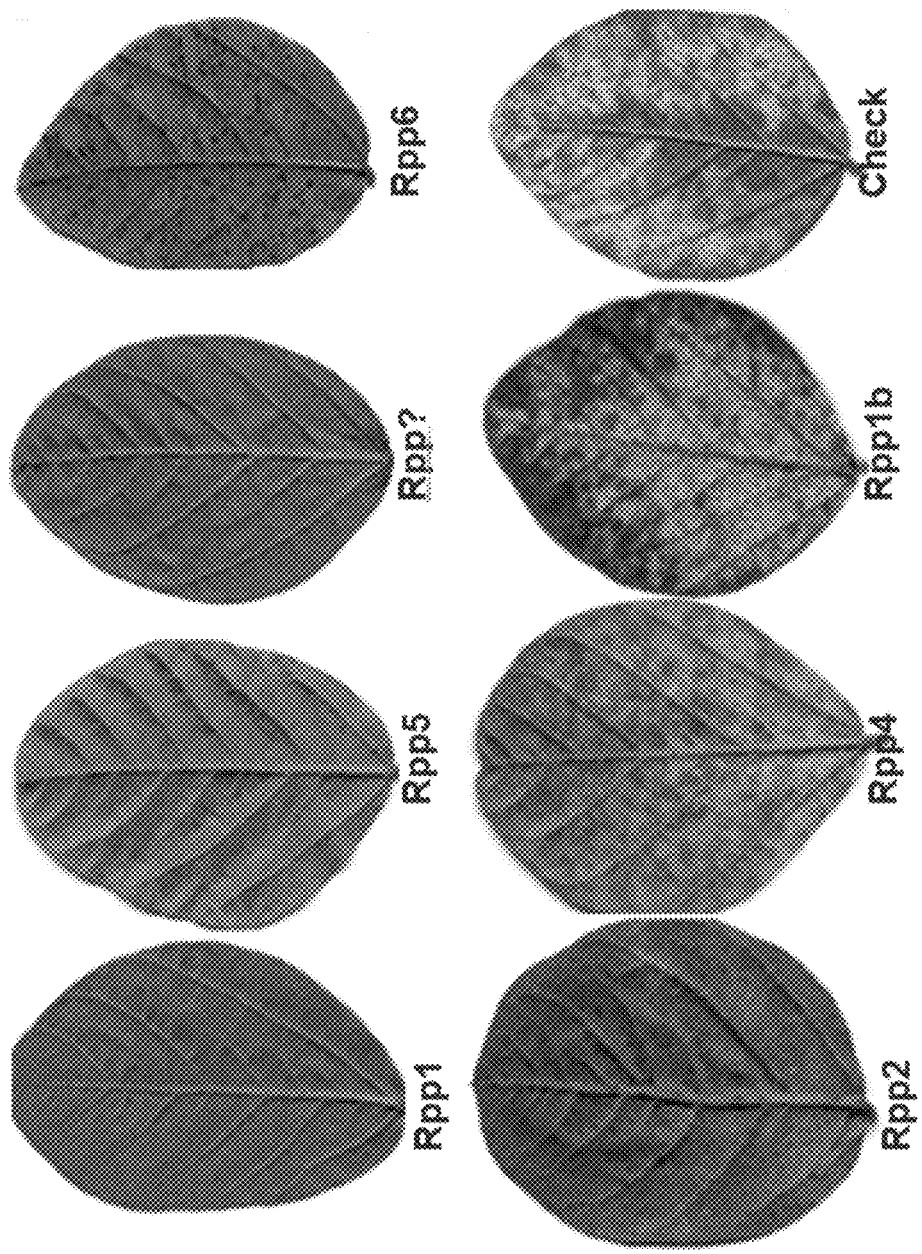
FIG. 9. Foliar symptoms correlating to qRT assay.

Example 2 Allele Mining & Associations to PI441001, PI441008, PI446958, PI583970, or PI483224 ASR Loci Resistant parent lines (i.e. PI441001, PI441008, PI446958, PI583970, and PI483224) were crossed with a susceptible Glycine tomentella line and F1 plants were generated (See Table 2). F1 plants were self-fertilized to generate F2 seed. F2 seed was harvested from the selfed F1 plant. Around 200 F2 seed were sown and leaf tissue from each plant was collected for genotyping studies. Each line was inoculated with Phakopsora pachyrhizi to determine the resistance/susceptible phenotype of each F2 individual. Tissue from 50 resistant F2s and 50 susceptible F2s were combined in separate pools and genomic DNA was prepared from each pool. Illumina sequencing libraries were prepared from DNA for each of the pools and each library was sequenced in two Illumina HiSeq2000 2×100 bp Paired-End (PE) lanes. The average yield per sample was 383 million read pairs, which equals 77 gigabases of sequence per library. The sequencing reads were trimmed to remove bases with PHRED quality scores of <15.

Quality trimmed reads were aligned to the PI441001, PI441008, PI583970, and PI483224 reference genome sequence using GSNAP (WU and NACU 2010) as paired-end fragments. If a pair of reads could not be aligned together, they were treated as singletons for alignment. Reads were used in subsequent analyses if they mapped uniquely to the reference (≤2 mismatches every 36 bp and less than 5 bases for every 75 bp as tails).

SNPs were filtered prior to BSA analysis based on read depth, with SNPs having between 40 and 200× read depth being retained. A Chi-square test was used to select SNPs with significantly different read counts between the two alleles in the two pools. An empirical Bayesian approach (LIU et al. 2012) was used to estimate the conditional probability that there is no recombination between each SNP marker and the causal locus in both the resistant pool and in the susceptible pool. The probability of the linkage between the SNP and the causal gene is the geometric mean of these two conditional probabilities. Around 1000 SNPs were found to have possible linkage to the target locus. A subset of these putatively linked SNPs were used to fine map the locus using phenotyped F2 individuals. See references: LIU, S., C.-T. YEH, H. M. TANG, D. NETTLETON AND P. S. SCHNABLE, 2012 Gene Mapping via Bulked Segregant RNA-Seq (BSR-Seq). PLoS ONE 7: e36406 & Wu, T. D., and S. Nacu, 2010 Fast and SNP-tolerant detection of complex variants and splicing in short reads. Bioinformatics 26: 873-881.

TABLE 2

| Plant Crossings and Study Type | | | | |
|---|---|---|---|---|
| Species | PI# (male) | PI # (female) | Genome Size (Gb) | F2: Resistant to Susceptible Ratio |
| *G. tomentella* | PI441001 | PI441010 | 2 | 3:1 |
| *G. tomentella* | PI441001 | PI441011 | 2 | 3:1 |
| *G. tomentella* | PI441001 | PI441010 | 2 | 3:1 |
| *G. tomentella* | PI583970 | PI441007 | 2 | 3:1 |
| *G. tomentella* | PI583970 | PI441010 | 2 | 3:1 |
| *G. tomentella* | PI583970 | PI441011 | 2 | 3:1 |
| *G. tomentella* | PI448224 | PI441010 | 2 | 3:1 |
| *G. tomentella* | PI441008 | PI441010 | 2 | 7:9 |

1. PI441001 Data2Bio LLC (Ames, Iowa) Lab Methodology for gBSA-Seq Analysis for Tetraploid Soybean.

Chromosome discovery for causal loci in the tetraploid soybean population, PI441001 was carried out using Data2Bio's Genomic Bulked Segregant Analysis (gBSA) technology. It was theorized that ASR resistance is controlled by a single dominant allele. Four libraries were generated from DNA samples extracted from two susceptible tissue pools and two resistant tissue pools. These pools were then sequenced in eight (8) Illumina HiSeq2000 2×100 bp Paired-End (PE) lanes. A summary of the reference genomes used for subsequent analyses, read processing from raw data to quality trimming, alignment, SNP discovery and SNP impact are demonstrated in FIGS. 1-5 for population 441001. After various filtering steps 110,503 informative SNPs were identified in the PI441001 genome as being significantly associated with ASR resistance. A Bayesian approach was then used to calculate trait-associated probabilities. Next, physical maps of trait-associated SNPs (probability cutoff at 0.01) for the top contigs were created (FIG. 1). Two scaffolds, 46840 and 49652, were identified in PI441001 (SEQ ID NOs: 1 and 2 respectively). SNPs from these enriched scaffolds were mapped to the public *Glycine max* genome. In both populations, most of the SNPs from the top scaffolds clustered on small portions of Chr05 and Chr08 (see FIG. 4).

2. PI583970 Data2Bio LLC (Ames, Iowa) Lab Methodology for gBSA-Seq Analysis for Tetraploid Soybean Chromosome discovery for loci in the tetraploid soybean population, PI583970 was carried out using Data2Bio's Genomic Bulked Segregant Analysis (gBSA) technology. Two libraries were created from RNA samples extracted from one susceptible tissue pool and one resistant tissue RNA pool. After various filtering steps 59,014 informative SNPs were identified in the PI583970 genome that were significantly associated with ASR resistance. A Bayesian approach was then used to calculate trait-associated probabilities. Next, a physical map of trait-associated SNPs on contigs was created. The clustering of these SNPs suggests that the resistance loci is located in or near scaffold 000819F (see FIG. 7; Scaffold 001084F is SEQ ID NO: 4). The context sequences associated with these SNPs were also aligned to the public *Glycine max* genome to create a chromosome-level understanding of the mapping interval. The chromosomal positions of the trait-associated (ASR resistance) SNPs were then displayed graphically. Most of the SNPs from scaffold 001084F mapped and clustered on a small region of Chr05 (see FIG. 8). The data suggest that the loci responsible for ASR resistance maps within or near the interval 0.11 to 0.30 Mbp on scaffold 001084F (FIG. 9).

3. PI483224 Data2Bio LLC (Ames, Iowa) Lab Methodology for gBSA-Seq Analysis for Tetraploid Soybean Chromosome discovery for causal loci in the tetraploid soybean population, PI483224 was carried out using Data2Bio's Genomic Bulked Segregant Analysis (gBSA) technology. Two libraries were created from DNA samples extracted from one susceptible tissue pool and one resistant tissue pool (PI483224). After various filtering steps 428,263 informative SNPs were identified in the PI483224 genome to be significantly associated with ASR resistance. A Bayesian approach was then used to calculate trait-associated probabilities. Next, a physical map of trait-associated SNPs on contigs was created. The clustering of these SNPs indicates that the ASR resistance loci is located on or near scaffold 002687F (see FIG. 10). The context sequences associated with these SNPs were also aligned to the public *Glycine max* genome to create a chromosome-level understanding of the mapping interval. The chromosomal positions of the trait-associated (ASR resistant) SNPs were displayed graphically. Most of the SNPs from scaffold 002687F mapped to a small region of Chr05 (See FIG. 11). Data indicates that the ASR loci may map within or near the interval 0.17 to 0.36 MB on scaffold 002687F (see FIG. 12 and SEQ ID NO: 3).

Example 3 Embryo Rescue & Introgression of R Gene Intervals into *Glycine max* Lines Embryo rescue is performed (as described below) and chemical treatment to induce chromosome doubling is applied in order to generate amphidiploid shoots. If the amphidiploid plants are fertile they will be used to backcross with *Glycine max*. Backcrossing with *Glycine max* and subsequent embryo rescue will need to be performed for several generations in order to gradually eliminate the perennial *Glycine tomentella* chromosomes eventually resulting in ASR resistant *Glycine max* plant Wide crosses were carried out using Elite Syngenta soybean (*Glycine max*) lines (RM 3.7 to 4.8). The elite soybean lines are used as the females (pollen recipients) and multiple accessions of *Glycine tomentella* are used as the males or pollen donors. Selecting flowers from the *Glycine tomentella* plant containing anthers at the proper developmental stage is important. New, fully-opened, brightly colored flowers hold anthers with mature pollen. The pollen should appear as loose, yellow dust. These flowers are removed from the *Glycine tomentella* plant and crossed with the elite *Glycine max* plant for pollination. Pollen from the *Glycine tomentella* plants should be used within 30 minutes of flower removal. It is also important to identify and select elite soybean flower buds that are ready for pollination. A soybean flower bud is generally ready when it is larger in size when compared to an immature bud. The sepals of the soybean blossoms are lighter in color and the petals are just beginning to appear. First, use a pair of fine-tipped tweezers to carefully detach the sepals from the flower bud to expose the outer set of petals. Then, gently grasp and remove the petals (5 in total) from the flower exposing the ring of stamens surrounding the pistil. Since the stigma is receptive to pollen 1 day before the anthers begin shedding pollen it is important to recognize the stage development of "female ready, male not ready". When pollinating soybean flowers at this developmental stage it is not necessary to emasculate the female flower. Locate the stigma on the elite soybean flower. Then using 1 male flower, carefully peel off the petals to expose the anthers and gently dust the pollen grains onto the stigma of the soybean flower. Care should be taken not to damage the stigma at any time during this process. Starting the day after pollination a hormone mixture is sprayed onto the pollinated flower and eventual developing F1 pod 1× every day until harvest. The pollinated flower or pod is saturated with a light mist of the hormone mixture, taking care not to cause the flower/pod to prematurely detach from the plant. The mixture contains 100 mg GA3, 25 mg 1-Naphthaleneacetic acid (NAA) and 5 mg kinetin/L distilled water. Application of these hormones aid in the retention of the developing pod and in increased pod growth. The above described wide cross methodology results in success rates significantly higher than that reported in the literature. Further, no emasculation of female flowers is necessary, which saves time and reduces risk of damage to the stigma.

Harvest: Pods from wide crosses are harvested at approximately 14 to 16 days post pollination. (Harvest dates in the literature suggest 19 to 21 days, however the above method allows for faster harvest time and more robust pods.). Pods are collected and counted according to wide cross combination to determine crossing success. The average crossing success across multiple soybean females and 5 different accessions of *Glycine tomentella* is approximately 40%. The wide cross pods can contain 1 to 3 seeds but generally 2 seeds are found in each F1 pod. The above described methodology allows for pod harvest at 14 to 16 days after pollination, ~5 days earlier than described in literature.

Embryo rescue: Harvested pods are collected and brought back to the lab to be sterilized. The pods are first rinsed with 70% EtOH for 2 to 3 minutes and then placed in 10% Clorox bleach for an additional 30 minutes on a platform shaker at approximately 130 RPM. Finally, the pods are rinsed multiple times with sterile water to remove any residual bleach. Embryo isolation can begin immediately following pod sterilization or pods can be stored at 4° C. for up to 24 hours prior to embryo isolation. The sterilized pods are next taken to a laminar flow hood where the embryos can be rescued. Individual pods are placed in a sterile petri dish and opened using a scalpel and forceps. An incision is made along the length of the wide cross pod away from the seed. The pod can then be easily opened to expose the seed. Alternatively, two pair of forceps can be used to separate the pod shell. Carefully remove the seed from the pod and place in a sterile petri dish under a dissection microscope. Very fine forceps are needed to isolate the embryo from the seed. With forceps in one hand, gently hold the side of the seed away from the embryo, with the hilum facing up. Use another pair of forceps in the other hand to remove the seed coat from the side of the seed containing the embryo. Peel off the membrane surrounding the embryo and push the embryo up from its bottom side. Embryos should be past the globular developmental stage and preferably past the early heart developmental stage (middle to late heart stage, cotyledon stage and early maturation stage embryos are desired). Isolated embryos are transferred to embryo rescue medium such as Soy ER1-1 (i.e. 3.1 g B5 basal salt, Gamborg's, 1 ml B5 vitamins 1000×, 40 g sucrose [C12H22O11], 0.25 g casein hydrolysate, 0.25 ml BAP, 0.75 g MgCl2*6H2O, 20 ml glutamine 25 mg/ml, 0.1 g serine [C3H7NO3], 4 ml Asparagine 25 mg/ml and 0.05 ml of IBA 1 mg/ml) Murashige and Skoog Medium (MS) and Gamborg's B-5 media (Bridgen, 1994) may also be used as embryo rescue medium. Embryos can be treated to induce chromosome doubling at this time. (See below for chromosome doubling details.) Isolated embryos remain on embryo rescue medium for 21 to 30 days at 24° C. Embryos may remain in the dark for the entire incubation on ER1-1, they also can be incubated in the dark and later completed in the light, or may spend the entire incubation in the light. There is not a callus induction stage in this protocol, shoots are developed directly from the embryos which allows for faster turnaround time, plantlet survival and better quality results. The above described embryo rescue method involves direct shoot regeneration from embryos, rather than regeneration through embryogenesis, thus making plant recovery quicker (shoot recovery in approximately 2-3 months, compared to reported up to 1 year timeline in the literature). Further, the following protocol does not require culture in the dark following transfer to germination medium nor does the above protocol require a transfer to rooting medium.

Chromosome doubling treatments: Either colchicine of trifluralin can be used to induce chromosome doubling. Ideally, late heart stage wide cross embryos (or larger) are chemically treated to induce chromosome doubling at any time from immediately following isolation up to 1 week post isolation. The doubling agent can be mixed in either solid or liquid medium and applied for several hours or up to a few days. Trifluralin is used at a concentration of 10-40 uM in either solid or liquid media. Alternatively, colchicine is used at a concentration of 0.4-1 mg/ml in either solid or liquid media. Following chemical treatment, embryos are transferred to fresh embryo rescue medium.

Shoot regeneration: Developing embryos are transferred from rescue medium to germination medium such as Soy ER GSMv2 (i.e. 3.2 g Schenk and Hilderbrandt Basal salt mixture, 1 g Myo-inositol [C6H12O6], 5 ml Thiamine 1 mg/ml, 0.5 ml pyridoxine 1 mg/ml, 10 g sucrose [C12H22O11], and 7.5 g purified agar) for approximately 3 to 5 weeks in the light at 24° C. Alternatively, developing embryos may be transferred from rescue medium to elongation medium such as Soy E1 0 No TCV (i.e. 4.3 g MS Basal salt Mixture [MSP01], 5 ml MS iron 200×, 30 g Sucrose [C12H22O11], 1 g MES [C6H13NO4S], 8 g purified agar, 1 ml B5 vitamins 100×, 2 ml glutamine 25 mg/ml, 0.50 ml zeatin riboside, trans isomers 1 mg/ml, 0.1 ml IAA 1 mg/ml, 0.2 ml GA3 5 mg/ml, 1.5 ml timentin 100 mg/ml, 0.3 ml cefotaxime 250 mg/ml, 0.5 ml vancomycin 100 mg/ml) Shoots can be kept on medium for approximately 3 to 5 weeks in the light at 24° C. Developing shoots may be transferred from media plates to Phytocons containing either germination or elongation medium for further shoot development. Established shoots having suitable roots are moved to soil.

Ploidy Analysis: Ploidy analysis is conducted using a flow cytometer. Leaf tissue for ploidy analysis is collected from small shoots either in culture or after establishment in soil. Tissue is collected on dry ice and stored at −80° C. until analysis, or collected on wet ice and analyzed the same day. A sample size of 0.5 cm$^2$ is sufficient. Samples are prepared according to the instructions in the Sysmex kit (Sysmex Inc., Kobe Japan). Each sample set contains an untreated F1 plant (not treated to induce chromosome doubling) as a control.

Example 4 ASR Resistance Trait Introgression

Amphidiploid lines generated from the wide cross (i.e. *Glycine tomentella* crossed with *Glycine max*) followed by embryo rescue as described in Example 3 were backcrossed multiple times with a recurrent elite *Glycine max* lines. It is known in the art that multiple backcrosses are needed to generate fertile hybrid lines, in particular the literature suggests that a BC3 generation is necessary. In this case it was determined that an additional backcrosses are necessary, BC4 in the case of *G. tomentella x G. max* to generate fertile hybrid plants. F1 hybrid plants produced by the methods as described above were created from wide crosses comprising PI441001, PI441008, PI446958, PI583970, and PI483224. F1 plants were next crossed as a female with a male recurrent *G. max* plant to perform a first backcross (BC1 progeny). BC1 Progeny were further backcrossed for multiple generations (e.g. BC2). BC plants are evaluated for ASR resistance, chromosome numbers and in some cases lines are genotyped through use of molecular markers as described herein to detect the presence of chromosome intervals corresponding to SEQ ID NOs 1-5 or any marker identified in Tables 1-5.

Example 5 Identification of Two Causative Genes Located within *G. tomentella* Chromosome 5 Intervals Further genotyping of the various *G. tomentella* intervals led to the discovery of two causative genes for ASR resistance located on chromosome 5 within the disclosed intervals. A first gene type encodes a TNLW R-gene motif and is depicted in SEQ ID NOs 6 and 30 located from PI441001 and PI583970 respectively. A second gene type located in the discovered intervals encodes a CNL R-gene motif and is depicted in SEQ ID NOs 9, 12, 15, 18, 21, 24, and 27. It is contemplated that any of these genes or homologs thereof can be employed in a transgenic, gene editing or breeding method utilizing embryo rescue as described above to generate plants having increased resistance to ASR.

Example 6 Construction of Vectors Comprising R-Genes

Constructs were generated comprising each of the R-genes described in Example 5 above.

a) Vector Construction for R-Gene Comprising SEQ ID NO: 6

Vector type: Binary Vector

Construct Size (bp): 30,982

Functional description: A binary vector for soybean transformation with ALS selection, harboring gGtoRG1-01, a candidate soy rust resistance gene encoding a protein containing Toll/Interleukin-1 receptor (TIR), nucleotide-binding site (NBS), leucine rich-repeat (LRR), and WKRY domains syntenic to Glyma.05G165800 (Soy_william82_v2).

Cloning methods: GenScript synthesized RG1 as four fragments RG1-PartI, -PartII, -PartIII and -PartIV [U9490BJ270-1 (23950), U9490BJ270-2 (23952), U9490BJ270-3 (23953), and U9490BJ270-4 (23954)]. The first and last 2 fragments were cloned into the bridge vector 21177 through SanDI/ScaI, ScaI/RsrII, respectively to obtain the intermediates 21177-PartI+II and 21177 Part-III+

IV. Then the PartI+II (SanDI/ScaI), PartIII+IV (ScaI/RsrII) in the two intermediates were all cloned into 22296 at once through three way ligation at SanDI site of 22296. The positive clone was confirmed by digestion with Alw44I/NheI/SalI and by sequencing over the cloning junctions (SYN04455:65-78).

Sequences used include SEQ ID NO. 6 (coding sequence), SEQ ID NO. 7 (promoter) and SEQ ID NO. 8 (terminator). SEQ ID NO: 6 encodes the protein of SEQ ID NO: 47.

b) Vector Construction for R-Gene Comprising SEQ ID NO: 9

Vector type: Binary Vector
Construct Size (bp): 17,713
Functional description: A binary vector for soybean transformation with the ALS selection harboring a soy rust resistance candidate gene that encodes a protein containing coiled-coiled (CC), nucleotide-binding site (NBS), and leucine rich repeat (LRR) domains. The gene is syntenic to Glyma.05G165600 (Soy_william82_v2).

Cloning methods: GenScript synthesized RG2 as two fragments PartI (SanDI/SacI, U1935CD120-1, 24076) and PartII (SacI/RsrII, U1935CD120-2, 24077), and ligated into 22296 at SanDI. The positive clone was confirmed by digestion with Alw44I/EcoRI and by sequencing over the cloning junctions (SYN04455:151-153)

Sequences used include SEQ ID NO. 9 (coding sequence), SEQ ID NO. 10 (promoter) and SEQ ID NO. 11 (terminator). SEQ ID NO: 9 encodes the protein of SEQ ID NO: 48.

c) Vector Construction for R-Gene Comprising SEQ ID NO: 12

Vector type: Binary Vector
Functional Description A binary vector for soybean transformation with glyphosate (EPSPS) selection harboring a soy rust resistance candidate gene from G. tomentella PI583970 that encodes a protein containing coiled-coiled (CC), nucleotide-binding site (NBS), and leucine rich repeat (LRR) domains expressed with native G. tomentella promoter and terminator (genomic DNA). The gene is syntenic to Glyma.05G165600 (Soy_william82_v2).

Sequences used include SEQ ID NO. 12 (coding sequence), SEQ ID NO. 13 (promoter) and SEQ ID NO. 14 (terminator). SEQ ID NO. 12 encodes the protein of SEQ ID NO: 42.

d) Vector Construction for R-Gene Comprising SEQ ID NO: 15

Vector type: Binary Vector
Construct Size (bp): 14,706
Functional description: Binary vector for soybean transformation with glyphosate selection (EPSPS), harboring a soy rust resistance candidate gene from Glycine tomentella (PI583970), cGtoRG13-01, encoding a protein containing coiled-coiled (CC), nucleotide-binding site (NBS), and leucine rich repeat (LRR) domains and driven by a soybean GmUbi promoter and Arabidopsis terminator plus a soybean kozak. The candidate gene is syntenic to Glyma.05G165600 (Soy_william82_v2).

Cloning methods: Site mutagenized U3962BF220-1 (prGmUBI1) so that the promoter fragment can be cut out using SanDI and BamHI (U1466CH300_6 by Genscript). Synthesized cGtoRG13 as a BamHI-SacI fragment (G519921, U1466CH300_6 by Genscript), cut out the fragment. Three way ligation into 23899 between SanDI and SacI sites to get VC21449 New (SYN03277: 183). Verified the construct by digestion using SalI and ApaLI as well as by HincII alone, followed by sequencing (SYN03277:184-185).

Sequences used include SEQ ID NO. 15 (coding sequence), SEQ ID NO. 16 (prGmUbi1-01 Native Ubiquitin 1 promoter from soybean; Accession D16248.1) and SEQ ID NO. 8 (Terminator tAtUBQ3-02 A at 328 bp from tAtUbq3-01 (Arabidopsis Ubq3 3'-UTR). SEQ ID NO: 15 encodes the protein of SEQ ID NO: 43.

e) Vector Construction for R-Gene Comprising SEQ ID NO: 18

Vector type: Binary Vector
Functional Description A binary vector for soybean transformation with glyphosate (EPSPS) selection harboring a soy rust resistance candidate gene from G. tomentella PI583970 that encodes a protein containing coiled-coiled (CC), nucleotide-binding site (NBS), and leucine rich repeat (LRR) domains expressed with Medicago truncatula promoter and Arabidopsis termintor plus a soybean kozak. The gene is syntenic to Glyma.05G165600 (Soy_william82_v2).

Cloning Instructions See VC21449 . . . replace prGmUbi1-01 with prMt51186-03 promoter. Ligate as SanDI/RsrII gene cassette to the SanDI site of 23614. Or if possible swap promoter directly from binary (SanDI/BamHI) vector made in VC21449.

Sequences used include SEQ ID NO. 18 (coding sequence), SEQ ID NO. 19 (Promoter prMt51186-03 The promoter from the Medicago truncatula gene identified by the GeneChip probe ID Mtr.51186.1.S1) and SEQ ID NO. 20 (Terminator Arabidopsis Ubiquitin UTR). SEQ ID NO: 18 encodes the protein of SEQ ID NO: 49.

f) Vector Construction for R-Gene Comprising SEQ ID NO: 21

Vector type: Binary Vector
Construct Size (bp): 16,801
Functional description: Binary vector for soybean transformation with Glyphosate selection (cmEPSPS), harboring a genomic fragment derived from Glycine tomentella (PI446958), gGtoRG11-01, to express a soy rust resistance candidate gene encoding a protein containing a coiled-coil, nucleotide binding site, and leucine-rich repeat domain (CC-NBS-LRR) The soy rust resistance gene is syntenic to Glyma.05G65600 (Soy_williams82_v2).

Cloning methods: Digested U8867CG170-1 with SanDI/SacI to obtain RG11-PartI fragment (4899 bp), Digested U8867CG170-2 with SacI/RsrII/Eam1105I to obtain RG11-PartII fragment (2609 bp), ligated these two fragments onto 20660 at SanDI site. The resulting construct VC21209 was confirmed by digestion with Alw44I/EcoRI/Bsp119I and by sequencing over the cloning junctions. (SYN04456:102-105). The resulting construct is 24160.

Sequences used include SEQ ID NO. 21 (coding sequence), SEQ ID NO. 22 (promoter) and SEQ ID NO. 23 (terminator). SEQ ID NO: 21 encodes the protein of SEQ ID NO: 44.

a) Vector Construction for R-Gene Comprising SEQ ID NO: 24

Vector type: Binary Vector
Functional Description Binary vector for soybean transformation to express the soy rust resistance candidate gene, cGtoRG11Ver221F, which encodes a protein containing a coiled-coil, nucleotide binding site, and leucine-rich repeat domain (CC-NBS-LRR). This gene is syntenic to Glyma.05G65600 (Soy_williams82_v2) and is derived from Glycine tomentella (PI446958) contig 221F allele, gGtoRG11-01. Expression is driven by the soybean Ubi1 promoter and *Arabidopsis* Ubq3 terminator. Vector utilizes Glyphosate selection (cmEPSPS).

Cloning Instructions Digest synthetic coding sequence (remove internal SacI site) with BamHI/SacI and ligate to the BamHI/SacI site of binary vector 24171 to replace the current CNL gene.

Note: promoter and terminator are the same as construct 24171

Sequences used include SEQ ID NO. 24 (coding sequence), SEQ ID NO. 25 (promoter) and SEQ ID NO. 26 (terminator). SEQ ID NO: 24 encodes the protein of SEQ ID NO: 45.

h) Vector Construction for R-Gene Comprising SEQ ID NO: 27

Vector type: Binary Vector

Allelic to CNL found in construct 24160. Identified by High Fidelity PCR amplification from PI446958 genomic DNA. Notebook Ref. SY04474:53

```
Forward Primer:
GGATTATGTTTATATTCGAGTACATGCTATTGC

Reverse Primer:
GGGATTCAAAGGCATCTTAGATTAGTCAAACATCC
```

Melting Temp: 98° C.
Annealing Temp: 58° C.
Elongation Temp: 72° C.
35 Cycles

PCR product was purified by agarose gel electrophoresis then sub-cloned into TOPO clone (PCR Blunt) vectors. Individual *E. coli* colonies were isolated on Kanamycin-LB selection media. Plasmid preps were prepared and the inserts sequenced.

Functional Description Binary vector for soybean transformation to express a soy rust resistance candidate gene, cGtoRG11Ver1F, which encodes a protein containing a coiled-coil, nucleotide binding site, and leucine-rich repeat domain (CC-NBS-LRR). This gene is syntenic to Glyma.05G65600 (Soy_williams82_v2) and is derived from *Glycine tomentella* (PI446958) contig 1F allele, similar to that of gGtoRG11-01. Expression is driven by the soybean Ubi1 promoter and *Arabidopsis* Ubq3 terminator. Vector utilizes Glyphosate selection (cmEPSPS).

Sequences used include SEQ ID NO. 27 (coding sequence), SEQ ID NO. 28 (promoter) and SEQ ID NO. 29 (terminator). SEQ ID NO: 27 encodes the protein of SEQ ID NO: 46.

i) Vector Construction for R-Gene Comprising SEQ ID NO: 30

Vector type: Binary Vector

Functional description: A binary vector for soybean transformation with ALS selection, haboring a candidate soy rust resistance gene encoding a protein containing a Toll-interleukin-like receptor (TIR), nucleotide binding site (NBS), leucine-rich repeat (LRR), WKRY domains syntenic to Glyma.05G165800 (Soy_william82_v2).

Cloning methods: GenScript synthesized RG5 as four fragments RG5-PartI, -PartII, -PartIII and -PartIV [U9490BJ270-5 (23955), U9490BJ270-6 (23956), U9490BJ270-7 (23957), and U9490BJ270-8 (23958)]. The first 3 fragments were cloned into the bridge vector 21177 as SanDI+Kpn2I respectively to obtain the intermediate 21177-PartI+II+III. Then the PartI+II+III (SanDI/Kpn2I) from this intermediate vector and PartIV (Kpn2I/RsrII) were all cloned into 22296 at once through three way ligation at SanDI site of 22296. The positive clone was confirmed by digestion with NcoI/HindIII and by sequencing over the cloning junctions (SYN04455:65-78).

Sequences used include SEQ ID NO. 30 (coding sequence), SEQ ID NO. 31 (promoter) and SEQ ID NO. 32 (terminator). SEQ ID NO: 30 encodes the protein of SEQ ID NO: 50.

Example 7 Validation of R-Genes Against ASR

Validation of Molecular Assay Using Fungal b-Tubulin's Transcripts as Measurement of Resistance In our phenotyping work, we have used both symptom evaluation and molecular assays for rust resistance or susceptibility ratings. The symptom evaluation is a modified version of a rust rating scale from Burdon and Speer, T A G, 1984. The molecular assay is based on a fungal housekeeping gene, b-tubulin, identified by a Syngenta scientist, the probe for b-tubulin targets a specific region in soy rust but not in other pathogens or plant species. Further we validated this molecular assay coupled with phenotypic symptomatic observations as shown in FIG. 9 and FIG. 1. FIG. 9, from left to right, top to bottom, depicts complete resistance (Rpp1 line), a few lesions without sporulation (Rpp5 lines), lots of lesions with little sporulations (Rpp6 line), many lesions with some Tan lesions plus sporulations (Rpp2 lines), to many Tan lesions with profuse sporulations (Rpp4, Rpp1b and Jack). Because the rust used in this example is virulent on Rpp4 and Rpp1b, these 2 lines show susceptibility as severe as the susceptible check, Jack.

Consistent with these observations, measurements taken using fungal b-tubulin transcripts shown in the graph of FIG. 1, from left to right, no detection of the transcripts (complete resistance, Rpp1 line), barely detectable level of transcripts (a few lesion without sporulation, Rpp5 and Rpp6 lines), low level of transcripts (lots of lesions with little sporulations, Rpp6 line), intermediate level of transcripts (many lesions with some Tan lesions/sporulations, Rpp2 lines), high level of transcripts (many Tan lesions with profuse sporulations, Rpp4, Rpp1b and Jack (CK) lines).

From these data sets, we have shown that a molecular assay using fungal b-tubulin or other housekeeping genes is as reliable and indicative as phenotypic symptomatic ratings, and provides higher resolution than phenotypic ratings based on symptoms.

Validation of Transient Foliar Gene Expression System Using Known Soy Rust R Gene A transient detached split-leaf assay was developed to validate rust resistance. This was accomplished by using a susceptible soybean, or its wild relatives, leaf and transiently expressing a GUS control vector on one side of the leaf and transiently expressing a vector containing an R-gene on the other side of the leaf (i.e. the leaf midrib being the divider, further the control and experimental vectors being similar except for the respective CDS (GUS or R-gene)). After 2-3 days of infiltration, leaves were sprayed with rust. At about 10-17 days, infiltrated leaves were selected and cut in half by the mid-vein divider. Left side (top view) of each leaf with only infiltrated area was cut out and filled in 1 well in a 96 well block, labeled as construct left-1. The right side (top view) of the leaf was cut out and filled in one well, the right half leaf filled the other, 8 pair of wells per construct. In each experiment, the right side of the leaves was infiltrated with construct containing GUS, while the left side was infiltrated with the constructs of interests. For GUS check, it means both sides of the leaf were infiltrated with constructs containing GUS. All of them were analyzed for fungal biomass measurement using quantitative polymerase chain reaction of fungal b-tubulin transcripts.

First we validated the system with GUS (in construct 17282) as negative check and CcRpp1 (soy rust R gene from *Cajanus cajan* in construct 23677). The CcRpp1 showed near 100% disease control in stable transgenic soybean when in homozygous state and protein level reach certain level (Kawashima et al., 2016 for soy rust resistance from pigeon pea). It is appropriate to be used as positive control for system validation. Both GUS and CcRpp1 constructs were co-infiltrated with construct 18515, a CFP construct for transformation efficiency measurement.

In quantitative reverse transcript polymerase chain reactions, three ways to process the data using transcripts of fungal b-tubulin and CFP. One could use CFP as transformation efficiency measurement. In this setting, the formula in FIG. 2 was used.

As shown in FIG. 3, construct containing CcRpp1 has significant less normalized fungal biomass accumulation compared to construct containing GUS at 95% confidence, while GUS check is not significant different from 1 which means amount of fungal biomass accumulated from two sides infiltrated with GUS are not statistically different. While the construct containing CcRpp1 infiltrated half leaves produced significantly less amount compared to the side infiltrated with construct containing GUS. This experiment was repeated once, and similar results obtained. In all experiments, a Syngenta elite line or *Glycine canescens* line was used. From this experiment, one with ordinary skill could argue that other soybean lines or close related legumes could be used as well.

We also tested the system without CFP transformation efficiency control. In this experiment, we compared constructs containing GUS, CcRpp1, and CNL from 583970 (construct 24230). 24230 is derived from genomic DNA amplied using primers designed from contigs 819F containing coiled-coiled nucleotide binding and leucine rich repeat (CNL). In this experiment, we tested if CFP transformation efficiency check can be skipped or not. Because there is not CFP in this experiment, the formula in FIG. 4 was used to process the transcript data for any given constructs.

As shown in FIG. 5, both CcRpp1 and 24230 (SEQ ID NO: 12) showed efficacy in rust resistance when compared to GUS negative check. But surprisingly, the 24230 appears more efficacious than CcRpp1. This may be due to the fact that CcRpp1 expression level is not sufficiently high to confer full resistance as it does in stable transgenics. However, it does reinforce the observation that the split leaf foliar expression is sufficient to detect resistance function.

We further tested other GUS construct as negative control. In this experiment, construct 21349 (GUS), and 24230 (CNL R gene from PI 583970, SEQ ID NO: 12) were used. As shown in FIG. 6, two sets of samples derived from 24230 are lower in fungal biomass than 21349. In this setting, we compared fungal b-tubulin from the side infiltrated with construct of interest directly to the other side infiltrated with construct containing GUS without normalization, except the value of transcript reads were processed by Log 2. Again the side infiltrated with construct 24230 showed significantly lower fungal biomass than the side infiltrated with construct containing GUS.

We also tested another construct, 23969 together with GUS check. 23969 contains another candidate gene in the chr 5 interval, encoding Toll inter-leukin nucleotide binding and leucine rich repeat protein with WRKY domain (TNLW). This resistance conferred by the gene in this construct is evident as indicated by significantly lower level of fungal biomass than GUS negative check (FIG. 6).

Stable Transformation with ASR Candidate Gene Vectors

*Agrobacterium tumefaciens* strains containing individual binary vector with PAT, ALS or EPSPS selectable marker gene and one or more of the soybean rust resistance candidate genes was transformed into explants prepared from imbibed soybean seeds as prepared by method described here (Khan 2004, U.S. Patent Application Publication No. 20040034889). Soybean seeds were selected from Jack, Williams 82 or a Syngenta elite variety such as 06KG 218440. FIGS. 7 and 8 show the data for stable transformants at the T1 (SEQ ID NO: 21) and T0 stage (SEQ ID NO: 27).

From the above data set, we have a reason to believe that both genes in the interval, CNL and TNLW, confer resistance to soybean rust. It would be reasonable to stack them to examine the resistance conferred by both genes together, a stronger resistance could be expected.

The above examples clearly illustrate the advantages of the invention. Although the present invention has been described with reference to specific details of certain embodiments thereof, it is not intended that such details should be regarded as limitations upon the scope of the invention except as and to the extent that they are included in the accompanying claims.

Throughout this application, various patents, patent publications and non-patent publications are referenced. The disclosures of these patents, patent publications and non-patent publications in their entireties are incorporated by reference herein into this application in order to more fully describe the state of the art to which this invention pertains.

From the above data set, we have a reason to believe that both genes in the interval, CNL and TNLW, confer resistance to soybean rust. It would be reasonable to stack them to examine the resistance conferred by both genes together, a stronger resistance could be expected.

The above examples clearly illustrate the advantages of the invention. Although the present invention has been described with reference to specific details of certain embodiments thereof, it is not intended that such details should be regarded as limitations upon the scope of the invention except as and to the extent that they are included in the accompanying claims.

Throughout this application, various patents, patent publications and non-patent publications are referenced. The disclosures of these patents, patent publications and non-patent publications in their entireties are incorporated by reference herein into this application in order to more fully describe the state of the art to which this invention pertains.

SEQUENCE LISTING (52 sequences)

SEQ ID NO: 1 - DNA, 1251375 bp, Glycine tomentella
  misc_feature (3743)..(3743): n is a, c, g, or t
  misc_feature (6487)..(6487): n is a, c, g, or t
  misc_feature (6714)..(6843): n is a, c, g, or t
  misc_feature (13645)..(13654): n is a, c, g, or t
  misc_feature (18350)..(18350): n is a, c, g, or t
  misc_feature (18754)..(18802): n is a, c, g, or t
  misc_feature (24574)..(24583): n is a, c, g, or t
  misc_feature (25088)..(25097): n is a, c, g, or t
  misc_feature (32135)..(32193): n is a, c, g, or t
  misc_feature (35152)..(35152): n is a, c, g, or t
  misc_feature (43433)..(43433): n is a, c, g, or t
  misc_feature (44013)..(44022): n is a, c, g, or t
  misc_feature (65324)..(65956): n is a, c, g, or t
  misc_feature (73652)..(73758): n is a, c, g, or t
  misc_feature (74056)..(74065): n is a, c, g, or t
  misc_feature (83516)..(83655): n is a, c, g, or t
  misc_feature (96213)..(96223): n is a, c, g, or t
  misc_feature (98450)..(98461): n is a, c, g, or t
  misc_feature (100615)..(100751): n is a, c, g, or t
  misc_feature (104079)..(104158): n is a, c, g, or t
  misc_feature (105730)..(105730): n is a, c, g, or t
  misc_feature (137451)..(137456): n is a, c, g, or t
  misc_feature (149132)..(149203): n is a, c, g, or t
  misc_feature (161633)..(161642): n is a, c, g, or t
  misc_feature (162469)..(162911): n is a, c, g, or t
  misc_feature (163331)..(163331): n is a, c, g, or t
  misc_feature (165117)..(165210): n is a, c, g, or t
  misc_feature (165516)..(165569): n is a, c, g, or t
  misc_feature (189362)..(189372): n is a, c, g, or t
  misc_feature (189972)..(189981): n is a, c, g, or t
  misc_feature (190341)..(190350): n is a, c, g, or t
  misc_feature (207000)..(207000): n is a, c, g, or t
  misc_feature (245708)..(247592): n is a, c, g, or t
  misc_feature (249191)..(249200): n is a, c, g, or t
  misc_feature (250659)..(251395): n is a, c, g, or t
  misc_feature (253730)..(253989): n is a, c, g, or t
  misc_feature (262458)..(262458): n is a, c, g, or t
  misc_feature (270839)..(270949): n is a, c, g, or t
  misc_feature (275550)..(281035): n is a, c, g, or t
  misc_feature (281436)..(283402): n is a, c, g, or t
  misc_feature (293342)..(293767): n is a, c, g, or t
  misc_feature (295911)..(295920): n is a, c, g, or t
  misc_feature (296558)..(296726): n is a, c, g, or t
  misc_feature (302530)..(302530): n is a, c, g, or t
  misc_feature (314836)..(314915): n is a, c, g, or t
  misc_feature (315503)..(317023): n is a, c, g, or t
  misc_feature (326664)..(326850): n is a, c, g, or t
  misc_feature (340015)..(340015): n is a, c, g, or t
  misc_feature (360998)..(361007): n is a, c, g, or t
  misc_feature (363072)..(363100): n is a, c, g, or t
  misc_feature (368600)..(368911): n is a, c, g, or t
  misc_feature (369248)..(369294): n is a, c, g, or t
  misc_feature (370605)..(370649): n is a, c, g, or t
  misc_feature (378006)..(378736): n is a, c, g, or t
  misc_feature (379037)..(379046): n is a, c, g, or t
  misc_feature (383621)..(383630): n is a, c, g, or t
  misc_feature (384720)..(384729): n is a, c, g, or t
  misc_feature (390771)..(390952): n is a, c, g, or t
  misc_feature (409988)..(409997): n is a, c, g, or t
  misc_feature (410222)..(410222): n is a, c, g, or t
  misc_feature (415207)..(415207): n is a, c, g, or t
  misc_feature (428722)..(428731): n is a, c, g, or t
  misc_feature (429005)..(429014): n is a, c, g, or t
  misc_feature (431398)..(431647): n is a, c, g, or t
  misc_feature (432669)..(432678): n is a, c, g, or t
  misc_feature (446511)..(446511): n is a, c, g, or t
  misc_feature (447589)..(447604): n is a, c, g, or t
  misc_feature (447908)..(447917): n is a, c, g, or t
  misc_feature (448306)..(448315): n is a, c, g, or t
  misc_feature (448873)..(448882): n is a, c, g, or t
  misc_feature (450596)..(450605): n is a, c, g, or t
  misc_feature (453870)..(453901): n is a, c, g, or t
  misc_feature (454222)..(454467): n is a, c, g, or t
  misc_feature (454683)..(454820): n is a, c, g, or t
  misc_feature (457674)..(457733): n is a, c, g, or t
  misc_feature (470043)..(470052): n is a, c, g, or t
  misc_feature (470602)..(470602): n is a, c, g, or t
  misc_feature (493592)..(493605): n is a, c, g, or t
  misc_feature (502875)..(502989): n is a, c, g, or t
  misc_feature (511381)..(511381): n is a, c, g, or t
  misc_feature (523112)..(523158): n is a, c, g, or t
  misc_feature (527058)..(527523): n is a, c, g, or t
  misc_feature (543294)..(543303): n is a, c, g, or t
  misc_feature (544118)..(544127): n is a, c, g, or t
  misc_feature (546836)..(546845): n is a, c, g, or t
  misc_feature (547275)..(547284): n is a, c, g, or t
  misc_feature (567418)..(567477): n is a, c, g, or t
  misc_feature (569163)..(569163): n is a, c, g, or t
  misc_feature (572499)..(572508): n is a, c, g, or t
  misc_feature (573364)..(573373): n is a, c, g, or t
  misc_feature (574731)..(574741): n is a, c, g, or t
  misc_feature (578302)..(578967): n is a, c, g, or t
  misc_feature (587637)..(587646): n is a, c, g, or t
  misc_feature (588256)..(588265): n is a, c, g, or t
  misc_feature (590249)..(590249): n is a, c, g, or t
  misc_feature (592172)..(592177): n is a, c, g, or t
  misc_feature (595059)..(595068): n is a, c, g, or t
  misc_feature (597493)..(597547): n is a, c, g, or t
  misc_feature (599073)..(599455): n is a, c, g, or t
  misc_feature (601068)..(601077): n is a, c, g, or t
  misc_feature (602150)..(602334): n is a, c, g, or t
  misc_feature (606659)..(606659): n is a, c, g, or t
  misc_feature (612248)..(612656): n is a, c, g, or t
  misc_feature (619059)..(619091): n is a, c, g, or t
  misc_feature (628824)..(629230): n is a, c, g, or t
  misc_feature (633011)..(633057): n is a, c, g, or t
  misc_feature (634196)..(634283): n is a, c, g, or t
  misc_feature (634585)..(634658): n is a, c, g, or t
  misc_feature (635865)..(636221): n is a, c, g, or t
  misc_feature (644747)..(644747): n is a, c, g, or t
  misc_feature (655918)..(656003): n is a, c, g, or t
  misc_feature (661088)..(661088): n is a, c, g, or t
  misc_feature (678040)..(678097): n is a, c, g, or t
  misc_feature (678825)..(678834): n is a, c, g, or t
  misc_feature (686932)..(686955): n is a, c, g, or t
  misc_feature (687863)..(687872): n is a, c, g, or t
  misc_feature (691642)..(691651): n is a, c, g, or t
  misc_feature (702555)..(703199): n is a, c, g, or t
  misc_feature (714512)..(714512): n is a, c, g, or t
  misc_feature (715825)..(715825): n is a, c, g, or t
  misc_feature (718065)..(718732): n is a, c, g, or t
  misc_feature (721041)..(721050): n is a, c, g, or t
  misc_feature (721388)..(721397): n is a, c, g, or t
  misc_feature (723554)..(724707): n is a, c, g, or t
  misc_feature (745125)..(745138): n is a, c, g, or t
  misc_feature (749380)..(749432): n is a, c, g, or t
  misc_feature (754527)..(754707): n is a, c, g, or t
  misc_feature (761330)..(761515): n is a, c, g, or t
  misc_feature (768966)..(770481): n is a, c, g, or t
  misc_feature (770845)..(771375): n is a, c, g, or t
  misc_feature (774465)..(774465): n is a, c, g, or t
  misc_feature (783479)..(783488): n is a, c, g, or t
  misc_feature (793021)..(793515): n is a, c, g, or t
  misc_feature (795231)..(795231): n is a, c, g, or t
  misc_feature (804966)..(805735): n is a, c, g, or t
  misc_feature (809268)..(809287): n is a, c, g, or t
  misc_feature (812169)..(812366): n is a, c, g, or t
  misc_feature (813540)..(813789): n is a, c, g, or t
  misc_feature (818473)..(818473): n is a, c, g, or t
  misc_feature (823670)..(823679): n is a, c, g, or t
  misc_feature (824379)..(827421): n is a, c, g, or t
  misc_feature (836107)..(836116): n is a, c, g, or t
  misc_feature (836874)..(836877): n is a, c, g, or t
  misc_feature (846128)..(846239): n is a, c, g, or t
  misc_feature (846480)..(846627): n is a, c, g, or t
  misc_feature (854333)..(854411): n is a, c, g, or t
  misc_feature (855187)..(855187): n is a, c, g, or t
  misc_feature (875776)..(875938): n is a, c, g, or t
  misc_feature (877463)..(877586): n is a, c, g, or t
  misc_feature (887712)..(887721): n is a, c, g, or t
  misc_feature (888022)..(888031): n is a, c, g, or t
  misc_feature (888428)..(888438): n is a, c, g, or t
  misc_feature (903022)..(903047): n is a, c, g, or t
  misc_feature (912811)..(912830): n is a, c, g, or t
  misc_feature (913156)..(913627): n is a, c, g, or t
  misc_feature (926097)..(926119): n is a, c, g, or t
  misc_feature (929073)..(929120): n is a, c, g, or t
  misc_feature (931777)..(931873): n is a, c, g, or t
  misc_feature (935381)..(935535): n is a, c, g, or t
  misc_feature (936097)..(936097): n is a, c, g, or t
  misc_feature (942845)..(942858): n is a, c, g, or t
  misc_feature (947497)..(947497): n is a, c, g, or t
  misc_feature (947620)..(948264): n is a, c, g, or t
  misc_feature (956184)..(956184): n is a, c, g, or t
  misc_feature (962446)..(962890): n is a, c, g, or t
  misc_feature (963186)..(963202): n is a, c, g, or t
  misc_feature (980050)..(980059): n is a, c, g, or t
  misc_feature (981369)..(981378): n is a, c, g, or t
  misc_feature (982731)..(982740): n is a, c, g, or t
  misc_feature (986698)..(987669): n is a, c, g, or t
  misc_feature (1000301)..(1000310): n is a, c, g, or t
  misc_feature (1001080)..(1001089): n is a, c, g, or t
  misc_feature (1008462)..(1008488): n is a, c, g, or t
  misc_feature (1008895)..(1008904): n is a, c, g, or t
  misc_feature (1010738)..(1010754): n is a, c, g, or t
  misc_feature (1022521)..(1022530): n is a, c, g, or t
  misc_feature (1024016)..(1024161): n is a, c, g, or t
  misc_feature (1031659)..(1031738): n is a, c, g, or t
  misc_feature (1032206)..(1032252): n is a, c, g, or t
  misc_feature (1036936)..(1037070): n is a, c, g, or t
  misc_feature (1044647)..(1045077): n is a, c, g, or t
  misc_feature (1045394)..(1045403): n is a, c, g, or t
  misc_feature (1049870)..(1050527): n is a, c, g, or t
  misc_feature (1066869)..(1066879): n is a, c, g, or t
  misc_feature (1069789)..(1069789): n is a, c, g, or t
  misc_feature (1070584)..(1070712): n is a, c, g, or t
  misc_feature (1085567)..(1085567): n is a, c, g, or t
  misc_feature (1087330)..(1087330): n is a, c, g, or t
  misc_feature (1095614)..(1096508): n is a, c, g, or t
  misc_feature (1100946)..(1100946): n is a, c, g, or t
  misc_feature (1108127)..(1108174): n is a, c, g, or t
  misc_feature (1119361)..(1119499): n is a, c, g, or t
  misc_feature (1127353)..(1127548): n is a, c, g, or t
  misc_feature (1155325)..(1155359): n is a, c, g, or t
  misc_feature (1162753)..(1162762): n is a, c, g, or t
  misc_feature (1163179)..(1163188): n is a, c, g, or t
  misc_feature (1163475)..(1163484): n is a, c, g, or t
  misc_feature (1168942)..(1168942): n is a, c, g, or t
  misc_feature (1170213)..(1170436): n is a, c, g, or t
  misc_feature (1170864)..(1170989): n is a, c, g, or t
  misc_feature (1171415)..(1171424): n is a, c, g, or t
  misc_feature (1173346)..(1173355): n is a, c, g, or t
  misc_feature (1175182)..(1175191): n is a, c, g, or t
  misc_feature (1177365)..(1177826): n is a, c, g, or t
  misc_feature (1183611)..(1183620): n is a, c, g, or t
  misc_feature (1185130)..(1185188): n is a, c, g, or t
  misc_feature (1190399)..(1190399): n is a, c, g, or t
  misc_feature (1192503)..(1192599): n is a, c, g, or t
  misc_feature (1192893)..(1193051): n is a, c, g, or t
  misc_feature (1194932)..(1195230): n is a, c, g, or t
  misc_feature (1195546)..(1195555): n is a, c, g, or t
  misc_feature (1199449)..(1199456): n is a, c, g, or t
  misc_feature (1201520)..(1201520): n is a, c, g, or t
  misc_feature (1202167)..(1202176): n is a, c, g, or t
  misc_feature (1205971)..(1205980): n is a, c, g, or t
  misc_feature (1206280)..(1206289): n is a, c, g, or t
  misc_feature (1211089)..(1211518): n is a, c, g, or t
  misc_feature (1212969)..(1212979): n is a, c, g, or t
  misc_feature (1214399)..(1215631): n is a, c, g, or t
  misc_feature (1216477)..(1217124): n is a, c, g, or t
  misc_feature (1225086)..(1225303): n is a, c, g, or t
  misc_feature (1226695)..(1226695): n is a, c, g, or t
  misc_feature (1229361)..(1229520): n is a, c, g, or t
  misc_feature (1232721)..(1232730): n is a, c, g, or t
  misc_feature (1233169)..(1233178): n is a, c, g, or t
  misc_feature (1241251)..(1241844): n is a, c, g, or t
  misc_feature (1242127)..(1242171): n is a, c, g, or t
  misc_feature (1247914)..(1248947): n is a, c, g, or t
tcggaaatgctaaaattaccgacagaattttgtccgtcggaaatttccgacggataattccgtgggtaatttccgacggaaatatccgtcggaaattaccgacggccatatccgtcggaaattacccacggaaatatccgtcggaaatgctaaaattaccgacggaattttgtccgtcgaaaattttcgacggataattccgtgggtaattttcgacggaaatatccgtcggaaaatccgtcagaaattgaattattttccacggtataattaccgacggccatttccgtcggtaatataaatatttccgatggaatttttccgacggaaaataatctgtcggaaattactttccgtcggaaaaatccgtcggaaatgctgaaatttccgacggatttttgtccgtcggaaaaattccgtcggaaatagctttattttttgtagtgaaatggtggttagcaatgatagacatctattgcaatcagtaagtgtttgaggtctaccatatgctatatcattaatggacaggatttagctagcattccttataaagtgaccatgattttgacttctctctgttgccttgtgatgatacttttttcatgcaagcatgtggaagcaattattgttgctattatagtcgaaaagaaattatgttagatttgtggcctcaaaacaacatcctaattatgtctcttttagaagtataatgttgagcagtctcgcagaattatttcgtatatatgcatgtctaagaatatgatgtaaacacactgtctaattactttgcagcacaaaaatgttttttttataacagatttacattgataacaatatttttttaaacattgagataaacattttctattggttgttatataataactgatttcgaaaacacttaaattttagattgattgtattaaaaatttgacatagaaagtacattgatctagaatgtggacactctttacaactttcgaattttttggcaagaatttataatatggtggtatagtaaaccaattttggaaaaaacttttcacatccattcttcgtataaccaatttagattgttgataatttttttcatatttttcattttttacaaaactttttaagtcgattgtgctaagaactaatttagattttttttttctttttaaattgattattagtccagccaatccacaaaatccaatataagttttatgatttcagtaacaaattcctattttcactccaattttttaaccctcttctctagtacgtaagacgaatccaagtttctttggcaaaagtattttcaaacttacattgaagatctacgccccaacaacattgatcatcttcttatatatgattatgattccttcattggctgatacaagtattgtagggtgggatgaaaggatagtaatgtttatagatttgaacaggtgatgttgtgggttctttgatgcaagggttggggtactccttgtaccctctatccatttgtctaataaaattattatttgctgataaaaaaaatataagtatgactccaatacttgttttttttttatatatacatttctccattttcatttttctgaatgtttactgttcttgggtgaatttgtattttaaaacctgacctcattcattaggtgttattatatatgcaactgtatgagataatcttctctctctctgattctataattataacttcactttcaaattatagcctttctctttgtttcaaaccctgaccttgttatatgtttctctcttttaaatttaattttaatttaagagagaagtatgattttttatttttatttttttccttctataactaattaagtgctttttgagaaatttaagaaaactaatccatagcgtatttatgataataaattccttgaaatgggggtccaatatatttaaatttttaaacacgttttttttttctcttttaaaaatcccatttaaattgagttcgtacatttatggcttgcatttcaactccattcttgcattgcatggtcctttcgtttcttgtcttggttgcggagtcaacaagtaaagacgtgctgggtaatgggcatgattgacttgtgtgggagaaagaaaaatactctctcggtgactagtgtgttcatgttctgaagtactaaattatgcaacatttggttgatatcatgtacaatggttttgccaaacctctaaaaagctaagattattttgtcggcttcctggtaagttggccccctaaagtttatcattctgttttttcagttcatattctaagcctttattacacggtcacatgctgctatgggcaattttgcttccaaaggttagtataagatttctagcttttattaaaacatgatcatgaacgcaattcctatgccactaatgaacaagtttaaagtttgtgagtgcaatgcaagaatgtcaaaatttggttagattttcaatttgctcttcaatttgtggccacaaacacacatttgctatgatgatggccccaaatatacctaaactgtcagagaccctattggggattgtctttggatgtgggtgcaattcttgacagcccctgtttagagagcattcttttttattttctaattttcattctgatcaggtgagaatgaattttcttggaccacagcttaaagtgaatatccggccaagttatacataacccttcttttcttgactcatcaattttctttttaaaaagtctcaaactagcattcccaaacaataatttattaatttttcatgcttcaaaataattggtattcttaaaatttagttttttaaaattattttgacaaaaaataataataatatacacttcatgtacattcacacacacacaaaaaaaatccttccgattcttttgagttttgatggtacggtcgccaatttgacccggctcggcccattcaagacattcctaatgcgaaacatacttttagttttaggttgggtcaatttaaattaatttaattgtgcgggttagcatttttttatagctaaatctacttttctttttttacagattttgaaccaaaggttctactttatggacttatattttttaaccaaatgttacatggctataatttaatttatatatatataaataaataaataaataaataataaatagagaatatcaagtgaatttttttttttcattgtcagagagattgaatccaaatgaaattttgtaaatataaatatgaaaaagcaacgtttaattcaacaataactttttaaaaatcaaattacactcatataacttatactcacaatcatatcagtcaattatatggatagtttcatttcaaaacctattgttggattaatttatttattttacatatggatcatatctacaaaaataaccatactaattgtatataaaaaaaacatactaattaaaaaatatgtagttcaattttcattgttctaatacttgagttataatttatattatctttagtgttcttttaagtattgtcaaaattaatatataatcaaatggtttttttcgtatttttcaagtatgtatttaattaattttgatgtttataagttatgtattaaataacttaaattaatatgatttaattataatctatataataagaatttcaacccagtgataaattttggtaaatgcaaattatccaataaaaagttgtttaaaaatgtgagaatttccttaaaaaaantagaatttcctcactgctatcaattttatttatttctcatgatatattttcatttttaacttaattaatatactatcatttttatgataaaataatcttagctcgtgtatattttgtttcaaatgtgacaaatattaatagttactgtaatgtaatattttacacttttatggcatcttactaatttattagaaggaacaaagcaggtaacttttatgtgtgagagactgaaaggtcatagtttacgaataaatttttaaaggaatgccaagcaaagactggggaaaatatcccatctatgatggtacccaaccccatagaaaagctaaggccaacatgaatttattaaagaaagatgagaacaaaatatcatgggaggactaggtcaagacccatgctagagaaatttcaatctatactgagggagtccttgcagatcgtagacaaaaaaatagaaacaaaagaaagggacaccatcccaccaaaaagattgatggatagaaaccgtgaagttagcagtgtaatcttgtaaacgggacaaatattttcttctctagaaatgtgaaaagctttgaaaggaattaaaaaatatatatttattgtgaagatcataaaaaaaaacgtaaaaaatattatgaataatataattttatattttttaatattttttttatttttttaactaatgatctaagaatgttggttagcatttatcataaaagaagattattcaacatttcgttcagatttgttttgatacaaaatttaatatttctttcatttcaaaataaatattatcctaagttgttttatattccttcgtctcattataattggtattctagattatttggcataaacacaaaaaatcactaaatagatgaaagaaaatgacaatttttaaaaaaatattcataccatcattaactatttttgtttttgtaatccatataattaatatcataacagataagtcaaaaaagtaattaatgttgcatttaaaaattaatataaaattattttgagacaattttgtctttttagataacattttttatgggaccaagagactaatagatagataaaagtgaataataattttacacattaaactaatcttaatattaatattatattaaaaaattaaagtaacatttattaaaagtattagttggaagaaaacaactgacattatattaaaaaattaaataaaacacatattttagggaaaaagtatataactgaacacaagtccaatacaatttcccgtcaattagttactgttgaaaaacagtgacgctacccgaaaatgcagaagtctcgtctctttggtaaagatccatacatatataatcaggataaggtaccgaccaagcatcataattttgtttgtatgaacctaaatgatcgctaacaaaacctaatcttcctaattctatgaaatgggtgtacagccatgttcattagtcttcgatggccatatatgacatatctgtcttcctttctaatcactaaccagcagcaactgcactcaccattaagaatttaatttggttaattacagccacatcctggttcgttgtaattatcaattattactttatctcatacactgccaaatcattttgtggcgtaatcagatagaaagtaagtctcaacggtgacgtatagcttgttatacatttgtcgagatgcatgcatacacagtgtaagttacaacatttgaagccgaaactcaacaatacatgaaacatgttcgtcatttttaaattatgataatgatgcgatgaaaatgaaaaggcctcgataatctgtcttcggtttgtggttggctgttatttattttttctttttcttgtttaggtaggaaagtgtgctacatccttctagtattggttgtcatgctttcttgttattttatgtactgacgtgggttagcatgctgccttgaaaaataatgtataacgaaaacaaaagcaggtacaaatattgtgatcacttctagaaggctataaccggttacatctaaggctaatttgaggttaccatattttaattgagacctaatcacagtgtcaacaaaacattttctttaaatgaagaaaaaacctatatataaactcattattcggtaaaaaaaatatgaaaaaagacatcattgtataagttaccaagcattcattttgctacagcggaaattttaaaatttatgtcaacaaattaatttaatttttcaatcacaaatatctaacatatattttaatttttggataagccaattaaaatattttgtagtattttagttgttctggtataaattaaatttacaaaattaagaatatttacagtctaaaattgtatctcaaatttaaatttgtactaatcagtttttatatgagtatgtatgtaatttcatagttacatatatgttacataagaaattaagtaaagtaaaaataaaaattaatattttaatttactttgacttgttaacaaattcttttcataacatgaaaaaatggtataatctttttcatttttatttaataaattctattatgatcttttgctcaattttatttatataattagtatttaataatatattgaaagttgaaacaatgatattttattaattttaataaattaaattttttttatatcactaattgttcttatggtatttttagtaaaggctttttctttgaattctataatattttattattttatatgcataatanaaaaattatatctcaaattgaaatttgtactaatcattttttatatgagtatgtatgtaatttcatagttacatatatgttacataagaaattaagtaaagtaaaaataaaaattaatattttaatttactttgacttgttaacaaattcttttcataacatgaaaaaatggtataatctttttcatttttatttaataaattctattatgatcttttgctcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctttgaattctataatattttattattttatatgcataatatatatttatatatatatatatatatatatattattcgtttcattctctaataatgaaaatattaaaatggttattcagggttattttttgttataccgaattgctcctatttcttttttacagattatttgatttctttattattttaaaaatgatactaattaatcacacacatttatctttagagaagtaaagtagtgtgttattatacttaacgtacgtaaacaactaatcgacttaacttagtaagaaatttaaacctaatcgcctcttgacagaagtacttcatcttaattcaattaaagatgaagttaacccttccaaatttatttttaaaaaaaataaaggtaaaccataacttacctgtaaatgtgaagcccaaaaaatcatgttaaaccctttgttcttaaaaaacccagctgttaacacttgcatgataagataattgcggtgaggttaacttcacttaccattcacgtaaagggtgtcccaagaattgccagcactaagcaattcaagttacagcacatcgcattggtttctcaaatttgaactgccaaagctttttgcttatacttgtggaaataattagttgacgcctccgaatcaacatcctagtaagcaaaattcaaatggaaatacttttaactttacccttcattattatccaactttcagattttcttcctttactaagttttgtcgacaccgaaattattctctgttgactatgaatcatgacagttaaaaagagaagcattagtgggtgtaggtatagccataagccaattttgcacatttgacttttgaccatctattgctcatggtaggcctttttttgttatttataattattattattctcattttagtagtattttattagtatcatacaataatagtggtagcaataaaaggaaaatgtttttgagtgaactgacataatataataattaattcttggaagtgaaaataacagagaaggttagatggcttcaaaattactcaaaacactgggccagaagtccagcacgtgtagggctcagtgggatatgtgctcgatatacgaggaatgaaagggacccaaagcagaagctaaaatgcgtttaagcaacataataactctaacattggttccctctccttaatcccatttttggttcgttacgctaaaatctcactaatcccaattacttgttagtatagtttattggtaagtaagagcatattcagaaacgagaatgacgcaaatttacgctacttgttgctgccatcacgttttaattcaaccattattttttctcttaaatactacaatattagttaattatattattcaattaggaactagtagcttattctcacagttttttttattgctttgtctcctttagttgtaatatttgctttgacttgcaaaaataagcattaataagtatagtactggcaaatattaagggatgaaagtgtgacgcagggaactcctcggataacttagttaattaaaactgacgttaaagcttaaaagaaatatgaataatagaaaacgtgaataatcagataaatattagttagaacatgtagaaagaagatagggatggcaacaagaattaggagtaggaagacctcttttttttttttcgaatgaaattggacttctaatagcaggatggcgtgccaccaaccatgcattaaagtataaatttaaagtcataataaataaaaaggaaaactaaccaatatattacaaagtgtatttatagtgccatgccaatagcgggatctttggtaagggttagtcacagactatgcgttatgaaacattttctgcgtattttcgaacttagtttgctcaacgagtacaattaattaataaaaggacccgttattcctgtataatgcttgaaactttagcctttgttttcatcgctaaaactagcatcgcctaatcgaatccgactttgttggtcgtcaattttgttattttctaataactgaaattgtttttaagtacccgtttgccaccttattaaataacttggtaattaaaactcaataataagcctatagtaacatgcatttttttttttgtgaaggaacaacttatttagagcctagaaaccctttggaaagcttacacaagcttgatcccacctaaaatagcttatttagcaataatgtatacacaccttacataaatagtgatacaatgtatatacataaatagtgatgcctaatgactatgtgtgtggtcatgtattttttttacttgtttaattttctattcttttcctttacctactttgaaataggtagtgagcttgagatacacatgtgatatatattccccaccattcacaatacactggactgtgtggggatgagatttgaattgcaatgattgtgttccacccactcgccatcttaaccttatctattttctttcgcaaatttttccagatccgttaaaataaatctatggggaatggtgctattagctcgcttcaattgcaaaattgtacaattgaaaccccaggttaatatgcttctacgtggcttaaaagaattggctcaagtagtcaaatagtactatcgtttttgtccctttaaaacaaaagcgtaaaagttgtgggaacataatgactagggtcgcatttggttaagagccagcaggttccaactttccaagttcactaagagacctttttttttgtgttttgtttttttattttctcttttttttagggcgcttcctccgtttgtctgcgtgtgtttgtagttaaatttggccaagttcacttaccatgcacgtaaagttgaaggaaagcatggaatggtagtttgtcctaggactgggaggcataaagcaacttcttgcttacacggccaaagtcgtgagaattgatcaactcaattcaattggcaagaaattgaagaaaaccacatgttctatagtttatttatccaagctatggattcagattcgccaattgataacatgatatctgtctgattcgccccatcaagttactctaagttgggcacaaaattaataatgaatgggtaaaaaaatctcttaccacttcactgccaataactttttttttttttcagtatagagtaaagtggacgaatcaacaattaatatgatgagattgctagtatttgcttgccgctaaatgccaatatgtagaatctgaggatttaggtaggtggcgtcagtagtatacatcctcgcaacttttcaaaccaagaaaccacggtcacatgcttgttgtacggtgtagtaataaatttgcccttttgaccgcttctcttacctagagtgaacaagaaaattgtaactaacaaatacttcggaatttttttttatcgtttaatcatccatcccataaattcaaaaatatatatatatatatctaaataagaaaatactagtttttttttaacaaaagtaagaaaatactacttaatattatgttataattaatttaaaaaaatgatagataaggataaatatttttcttttctacaacaagtgagagagtacatattaattgcactacgcctccgctttctttctggagaaaatgttagaaaaggggaaaagggtagggccgaagataatttgagaaaaaaataaaggctaaattataccttcgatttattatgttttagtgttattttatttagtacatataatttaagaaatttattttaatcatttatatttttaaaagtttcatattattcaatgttaaaaatcttaagttttttaacactgtcaagacccgatgtttcaaatttatgtcggtgataaattacagtgtgactataaaatgtcatgataatattatttagtggatggaggttacaaatttaagtgttaacaagacactaatatttgttaaaagaaaaaaatttgaaacttttttgaaaaattaaaagatcaaaatataattttttaaaaatataaataatcaaaataaaccattttaaaacataaaggtttaaaataaaaactttcaaaacatacaaaatcgaaatgaaacttaaaacataaaaaactaaataaaatttttaaaatttaatgtattaaaataaaataacactaaatatgatgaaacaaaaataacatttaaccaaaaataaaaaggtaaaaagtatgacctaaataattaatttgactcatcttagtaataattaggtcattcacaactcgatttcagtttaataaaaattttacacttgggtttaacttataatctcaaattgcatgagttactagtcaaaattacttaaatcttggacagttttaaattaaacatttttcgaaaaatcaaaatatgaactagaaattaaacagaatgcagttcaagtttagttcatatccttattcagtagggaaacagggaaagatgagattcttaattaaacttaatacagttcaagtttagttcatatcatcattcagtagggaaactgggaaagatgggattcttaattattgctctctttttcctaaataataatgtgagaagagaaaggtgtgcaacacgaaagactatctgtaggtaggctgcataatatacatacgtacgtgtacgttatacatatatggttataataaattgtcggttgtacattttttatacatatattgtcggtgtgactcgtttttcagctgagagcaaattaatctacaagggctaaagtgcagtagttcctgattaaaaaagttacattacaatgaagagtctttggctgcatgcagcatgggaaccgacaactctgccgtccttcgcgttgacctcaatctgactattgtagctgtatattactattagtaagtatacgttgttcataataataaaataataaccatgattttaaattgtgatcacaattatagttatagttgtgttattgtgagtcgaaaaaaaattatattataaatatacaattaatatgacgacaattacaattatgatgagtcaaaatatatatatatatatatatattaaaattgtaaccttaacgacaaattgtaattgcgaaacgttatttaaaatcataacaataattatattaatattttgatttcattactttacaacttaatatttgaataaaataaataagttggtttattatttaggtggcttaccacaatctgaaccaaccaggtaggctcaaaggaaaggatatatatagttacaagtttgaattgaagttgaagtggttttatagtaaatgatatgatatgacactcgtacataacacatgtgcatgtaacactagttaaacaagcaatatgtagcttagaccatactcaactcaactcaaccgtcgtttttgctttggtttagtttagatggtgtatcacgtgcacatgctctcacacaccagtcaccaaagggatccttacgaacaagtgtagtatttggcaaatgcgttaagcaacatcctctgcatttgtctccaaattcctctcacttatttcagtgatgagatatagatatatatggaggcatgcaccgtgcagtggtttataaatgaagtgatctttgttgcttcacttgttagtttaatccttttttaaataatttattagtaccgaatcgatcaatctctgcatcgtacggattgagtaatgagattgacatatttgtacgtcaacccatgatccccatcacacagactctaaaaatatctcaacctccttccaactcgcaaatcgcaattctcattacccgcattcgtggacgcgatcatagcacaaattaaccttttctctttggtacgttaactttatgtttaactttggccaaacgttgcatgtgcttggggatttatatactaattaaattatgactaatactatttctacataaatttctcacagttatttttaaaataaaataaaataaaataagtaacatttttttaaaatttgaatcacatgtattctttattaaagataattttatttaagttaaataagattatagtggacgataaaaattttctctgattaatatgaaaacaataaaaaatactattcttaaattggcgcacagtgattcaaaacaccaattgagtttgaagttggtgcatgcatggtgtgcgctacttcttccatgactggcaattataggggctaattatttaaaataatacaaattaaatcaataattagcaaaatggtgcaagatggaaaatatttagcaaaatggggctgccattcacgcccaattggggcgtgtttaaacacgcccaattggggcgtgtttggcccaaatggtgacacgtggcagggaaaaatgggggtgcagggttttcgcgatttttttcgtaagttatggaaggtcataacttttgactgggacgtccgattgacgcgaaaccggtggccacgcgctcgaaatcgagaggagaaggcctgggcaagtcccaaaggggacttgcccaaaaatttttcccaaacgaggcctctaagtgcctcaaaattgcgatttaagttttggagtcccgaaaatttttttgttttctgatattttatctactcaatcagtgaactgcaagctattctttgtttatctaattactcctctcaatttcgagcgttctgacatagaatacgtcttcatcggacattgctacgagaaattacgatctagggtatcaaatttagggtttcagatttagggattactgttgacgatttagggtgtagggtggcttattctttaggattnnnnnnnnnntgggtttagggtttagggtttagggtttagggtttagggtttagggtttaggggttacggtttgggggttgatggtttagggttttggggtttagggtttaggggtttagggttttggggttttgggttttggggtttggagttggaatgggtccatgtagctgctgcgtccgcccccttcttagtcaatggggcagcaggttcggcatctactaaaaaagagagaatccacttgagtttagggagcaatcctttaatgcccgcaaactgctctctagaagtagcgaaactactgcagcaaagcacttgttacaattgtgatcagcaagggcattggtcttattactgtcattccaaatctcccttgcccacgcgcctaaaccctcgaactggaacccttactttgcccactgcgcctctaagtgcccaccgtgccaccatggcttactagtctctacgtcgagttcgggaagagatcaatttgaaaagaaaaaaaggagacagagaagggccctgatttccatgattaccagtaatgaatggtgctaaaccctaaaccctaaaccctaaacactaaaccctaaaccctaaaccctaaaccataaaccctaaaccccaaaccctaaaccccaaaaccctaaaccatcaaccccaaaccccaaaccccaaaccccaaacctcaaaaccctaaaccctaaaccctaaaccctaaaccctacaccctaaaccctaaaccccaaaaccctaaacccctatacctaaaccctaaaccctaaatcctaaacactacaccctaaaccctaaagaataagccctacaccctaaatcgtcaacactaaatttgataccctaaatcgtaatttctcgtagcaatgtccgatgaagacgtattctatgtcagaacgctcgaaattgagaggagtaattagataaacaaagaatagcttgcagttcactgattgagtagataaaatatcagaaaacaaaaaaattttcgggactccaaaacttaaatcgcaattttgaggcacttagaggcctcgtttaggaaaaatttttgggcaagtcccctttgggacttgctcaggccttctcctctcgatttcgagcgcgtggccaccggtttcgcgtcaatcggacgtcccagtcaaaagttatgaccttccgtaacttacaaaaaaaatcgcgaaaaccctgcacccccatttttccctgccacgtgtcaccatttgggccaaacacgccccaattgggcgtgtttaaacacgccccaattgggcgtgaatggcagccccattttgctaaatattttccatcttgcaccattttgctaattattgatttaatttgtattattttaaataattagcccaattatagggggcacgtagtcaacctaactgattagaaaagctactgtgggatgaatgggtcattgacatggaaatgcaacacatctttttatattattttttcttttgccccagaaaatatggcccgcttttaggtgtcaaaatccagtgccattgtccgtgatttccctttcgatgcctgatagaggttcattatataaccacatataattcgtgcagatgaacccctatttaatggctattttggtggtggcaatggcaatcgttgtcaaaatttaatcataggtcatattcattcaactaagttaagaaaaaagataagaaagattgagtcaacaaaaattttaaaatctaggagatcgacagttagggataattatgttagtaaatatactagatatatatgatgtatgaattatttatagaagtttttacatatacttgattttttaatcgtttatctctttcaatttaatctttttattttattattattattattattattattattattattattacacttgtatgttagtcacgtttttatttgatttgacatatgattagctaacatgggttgatatgagtagttatgatgaatttcgtgtgaactttcacattcccgtctagaggtattaggaaggagtgtctccaatatttttaacttcagttgaaccatagagtagagtctgcttccattataatttaggatttcatcgatatatagcattggtaagcaaagttttttacacagactagtacaagaattgtttttatttatttatttaagatgtaaaatatgtgaagccctgtgtgacaattttaaaaagaaatgtaaggacatacttctagagtatatataatgctgtacgatccactttcttgaaataaactatgacaaattgtgagtatgcatgaaaaaatggacaatatgatttgattacatcaattttttggggagtgaaaattgtgaaaaaaactattcatttttgtgactcttgatatattccctctaaattcgtatataaataaaaataattttatatcaataaaaaaattagttaatattatttaattttttaattttaaataaaaataaattatttctaaaatatttttattaaaatttattatcatgaataaaaatgagtcatttttaaaatataattaaaactaaataaagtgtgttttaagaataataatattaaatatgaaaaattaattaaatttatttataaatccaatatttatgatcacttttttatttttttatatatgagtgcagggagtaatatatatcacattttagacctttgactatgtataagagaagtgatctaaaccaaaacacaatttctattcattaatgattttttttttaaataaaatggtacagttaaaaacttttggatctggtaccaacacgtatacatggtttagacattaatattgcattatgaaatacaatgaacaacgcatatttgatatttgcatcatctttattaaatgaatgctaataccatctacacaagcatctagaaatcataagtataccaactctccctattaattgcgatacatgaagcaagagacagaataattggtctcaagcaagaaggcaaaattatcaaccattgacgaaacaaaactctgctttcccccaagtgtaatttcctagagcaggtagatttcaaaaattgaatttattgggtaaagaagaattgaaaatttcaaaaaattattttattttgaaatagagaaaaaagtattattttttaaataatatgctgatcttcatcattcttttataattcattttatatgtttgagatcttttcacaaaaatcagacattaaactaaaaatcattgctaaagatgtatactaaaaatgttttttaagaaattaaagaaaattaatgtacgacaggtatacacaaaaacacacaagaagcaataaatagtgtgtagtagtattgtttgatacgtttttccttcatttggtttcaagaaaaaatgaaggggggaagggtgagggggagcaagcagagggtgggcgttgcgacacttagcatgtactcagtcgtcttcaaaaatcgtcttgcgtggcatgtgagactagtgacagcaccgtaaggatgtgcctgaaaatgcatccgcgtgccatatttcgacaagagccgtgcatcaatgagagggaacaacttacctgtccagaaacctcccaccaaaaaaaggggccccacttaacatctctccctttacaacttcagagattctgtccaaaattaggagaaagtaagaaagttgtgcaattttgcaataacattccccctactcttggacattacttagataagattgcagccttaacctacctttttaatagcttcactcctaataaacaagccatcacttaggcaggcctgtgtttaggaactttaggaccttagccaatttttttaagaaacttaatattacatattatataaattatttttcaaactaatttttttattttttttaccaattaaactcattttaaatgtttttttatgaatagtaagacatttgtcaaaagtattatatgttgagattgaatttattttttaacttattttttattttttgagttttgaaaaccaagttcccgctttttatttgatttttttctattactataaagtataagaataaaagaaagaagtatcacataatataaataaaaatatttttttaaatctgatatggtattaaaaaaatatgaaaaagaaatagagaaacaatgaaaatgttgaataaatgttatttttaattaaatgaattgataagtcatgcatcaatatctctggttcttaatgttgtcaaaaaaaatttatctctaacattaacaattatgttcctaattaatagtataatttcttataataagctacaaattcaattttcaattatatatatgattttggtatttagttttttcactcctaattgttaattaagacaaataactaactattggataatttttcaatcatagaacatctttgtccgttgcaatttgaacaataggaacagattcatataaaaacttacataataacaattaaaataaaattaagaagcctaaggcaatagtcttaattgcctttcactatccacggccttgcgcttagataatttatcagtcaacatattgatttctgttacaaaattctatttgtgacaaaagttattttgttaatacatcaagatcgttatttttgtatttttttttatcttgataaatttgtattgaaatgtgtattatattatttttaangtaataatgtatttggttaaacggtaattagttctaaatcacaaaacgattaaaatctatacacttttttttttcttgaatcaatcaatttacatggtattaaaccgagtatggggtatttgtggaatgagttagaagggttttatgacttttatctttttctttacctagtttgaaaatgtgatagggtcaattttttaaacttgaatttcatcgtatgttttaattaaaatttataaacttaattgagtttataaaaatatctcaaatcttctttcttctaattatattaaatttgtaaattaagatttaatcttaaatatatttttatagaataatcaaacatctctttaaactaattttactgtcaaaatacttttagaatcctcccactgaaaatccannnnnnnnnnnnnnnnnnnnnnnnnnnnnnnnnnnnnnnnnnnnnnnnnatatatatatatatatatatatatatatatatatatatatatatatatatggaataggactaagtaaattcaagttaatgacataatatagtaatgttaatattatatgtagttaaatcctagaattaaagaagtatataattaaaataaaggtatattttataatttattaaaagttgtattattaatgtataactatttttataggaatttttttttgtctcaaatcattaatgtgctgaattatggatgaactaatgaaccgatgaacctatcatgggatgtcgtggagtcttcgattttgcctctagcattttttatattaacttgtgacacaatccaataatggatgacttcatgggctgcagtactgtgatcaattatttcttctagcaaagctttttgccaattcctgaaagtgaaagctggatagatttatcaggaaactgtgtactgttaaatccacatatgatgtagtacaaaccattagtgaagtggtcgacaaatctctgttcaaaagattttgaaaaaaaaaatatatccgttaaaagtttcagcttgtgctcggagaatatttattgataaaagaaaagaggaatatttgatataaactatgatatgattgcaaatgtgctttctgcaacagtaatgaggagaccagtggccaacttttttttggcttgcagtattttgtatgcagtatggtgcttctgtttctcgtggttgaggagaaattcttagttacatttagagtaagaaatttttttttatctatttattgttcgtcatgtcagtattatgaattattattgttttttacattaatgataatttttaatttttttagataaattaataataatttttattttttctaagtagattactgacataataaacaataaatagatcagagtaaaaaaatatcttacttaatgtgcacttaagaatttttcgtgacggattacatagaaattgttcagaggtgatgatgtcctagcctggacgtgtaaaaaatttgttgaaacttatcaaaattaggtcttaaactgttgaacacgaatttagagtaagattcacagtttttcttatttatttattttagattgaaagtgaggggacattccatcagtatgaaatcattttaattaggtattaatattatatggttataaggattaatcgatattttttctttaaaaaaaaaaacttgtgacaatccatttattcgcaatcttttacttacacggttccctgttaagtagcttttttctttattcctcagttcaattgttgtttccagcagcagtgatgttaacagaagaaagcatggggacaattgacatatgtacacgtcacataaaagaaagaaaataggaaatagaggtaacctttcttcgtggcaggaaaaaacagaagagaataacgaggatgaaaaataataaaaagacaagatgcggataagatgcatatcttgtttatcacaaagagtagcagccagcatgtcagacctgaacacgcctctccactccacctttgctttcaaatgcatatttgtttttctagtactctattatttttttaaaagttttaatgtcagatttttatttatttattaaacgtcagatataatatctacactgcactgcatttttattttccccgttattatttttgttcacgtatgtgttagagattctaaagtcagaagcactaaaatccaaattttagaatacatttgaacttagggtgataaaaggagaccatttattacaatgatttcaataaattgaatatatattttattatgtacttacttttaaaatgtgggtaagcatgaatatcataagcacgaataccatactaatttgtgaaatataattagacttaaggtttaaaatctaatattagagactcaattatcttactatgatcgatacactattcttgatcgtcttaattagttaaacagtctacgattactcaaaacttagtctcaaagacctgaatatgtgttatgctcaatctgcctgcctaacttgttaaagcttaaatttctaactctaactaggcatgacaacgagacccaagctcgtgagtacccgtcaaaacccacgacaaaaattcggggacgggggcgggtttggtattgataatacccaccccgcccccgccataattaaattacaaatttacctttatatatataagaataaaatcctgaaaccctaaccctccccctcatttatcattctcgacgacgatgaaccttggccagcaactttctgaattaattccattttggaagctttgttgctgcaatggacctctactctttgttgtgttttattttaattttggaataatatatatttaaatgatattatattttgggagaaattaaatatgtaggtccataatggttttaattaaattgattgattttgtttaataatttttaaattatgatttcatattttgaatgtgggtttgttattaatttttttgttagctagtcaatttttttccgttttttttcaaaagaaaagtcacattattttttttttaattaatagtaggggtggggcgggggcggggaagggaaaacccgaccccaacgggaacgaggatgagtttggattttaaaacccaacgggaatgggggcgggtgcggtgtctaactctagcgtaggtattaatattatcaacataaaaaatttaagcaagtattattataagtgcttaaacatgtatgtgtggatcgatatacatgtaggacagcacgccatgtgttccaaattggaaagatctcatctaatgggattcggggggtacgagcaatattgcaaatagtacgatatgggattgggttggcgtagatagatcgtagtaggctgataggttgtgcgataaatatttatagatagatagatagagtagtaggagttgctataatctcatacccacacgtccggtcccattcgctcactagccgatgagattggtgatctctgttatggactcaaagattgtcctcatctcctaatacatcatttctaactttttaagaaaattatatgagatatcaagtattttatttgattgacatgttgttgtgaaaattttaaattagaaaattatgaaaatatcataagcgattctcaattttattctgatgtatgtcatccttggacctaaagtcatgagaattcctacattaggagttgtgtgttttaatgtcatcaaatgttgtccatgataaggtgattatatagttggttattggatataaaacaaatagtgaattgggatgtgagtggtctatatgagatttgtccatccttcatacacgactaatatttgtgcgttctctttatactgtaagagaattatgcatgacatgccaaatgtgtagtcaatgagatattgatctcgtttatttgatgtttgcttttagtattaagaaatagataaactggactatacaatattacatgatctatgcctcgtattgaattatgatatttaaaataaaaaaaaaagactaatttgaggtgcttaaatgggtcttgtacacatttgactcatttatactctttccaaatcaagtacttgataaacacctattctctccggtccaatacctttggttgggttcttatcctgacatttaattaataatttatttgtttagttataacaatcttatttataaaataatttaaaaatataattggaaatatgaaaaaaaatatcgcagcatagaatatttttattgataatacaaaatagacattaaattttataaaaatatttttagataatacaaaaatcaaattaattttttttaaattataaaaaaaattgcgtccaaaaaattgaaactaagaaaataataattaactttttgcttgaaatttaaccaataattgagtttgaattgatttggatgtattagatgaaaataaataagggagtaagttgatgatttgagatatgtgagtaggggtgaaaataggttaggccaggtcagactttgataggtctgagtctgactcgcatcattatcattaagcttaagcctgacttgttacatgttaaaaataagttattaaagtctgtatacaaagtctgattaaataaaaataaataattaaaaataaaaaataacataatatatatgtttttcttataagttatcaaatatgatcctataagttatagatatgtttttcttaatcatttatgagattttcaaggtgattttttaaagtgattggtcatctaccttcataataagaaaaaatattttttaaaaaataaatatattatttttaagtttatatatatatattaaataggccagtctgatagacctaacagactttttttaaagtttgagcttgacctttttatttaaacagacttctccaaaagtcttagtctgacctttataataaacaagttagatcaagtcaagctttaactagaccagaccaaaagtccctgagagacaacctgatccattttcacccttatacatgagtaaaaaaaatggatgagattgaactttgaatagaagagtaacttttagaagaatgaatgtgtaaaaaaaatatgtcacttatatttattacttatatttatatacatggtattggtgatatttaatatattagcggtaaaaaaataaatgaaaaataacgttcaaattcaaacggtaaaatacgtgctcctaaattgcaaaaatccaatttgccaacggttacacaggcagacaatttacttttcattttttaattaaaaacgtcacacatgccccactatgacataagtaggaatcggttctggtttgaaaaacacatataggatatgattctcatgcaatagaaatccaatttaagtaccgattattttctatcatatattgtgttggatatactttgcattgcagacggtcttacatacttacacaacaacatatgtcattaaaatgttaaatcacaaacgtttcataattgacataagttataataacttgtctatattaatcaaatggtatatgtctatttttattaaatgatatatgattcaaatctcaattttgcatacaaaataaattatattaaaaaattatcttgtgacaatgaatattatatattaatatcatgatgataaaaaaatatcacaaacatgttttttatttggataacagtgatatattacttgatattgctcattatttagtctttttactaaaaatatttttaaaaaatatatctattaacaaattatatagataatttttgtaataatatgtattaatcaaacaaaaaattaactcgaatgatttaattatgttaaaatttcaattactgattaaaataaaacctttcaaaattaatatagttgaatatatttcactatttattttgcacaaattttttgttaataattttaattttcatgaatattgaatgcaaaaagttaaatcaaccaaatcatcaattaaatcaaataattttattgattgactaaaattaattaattaattatcacaaaatatgttaaaattatcacatatgttgaaattttattaaacataagatttaatttgtattaacaatttagattttatataaattttaagcttttattcagtgttaacgtataattatataatttatgtattatgttaataattcgagttaagattgacgtattatgttttgagttgactctagtcttatttggaatattataaggttttannnnnnnnnnttaatctatttgttatttcattttaattagtaataaaagttagtctatttaatacttatttaggcattattcatctggactagtattttaaagagaagtggtaacaacactttttttttaaactctttttgttattgacttttttttgtataatcactgtgaatcccacatttaaaatacgaaaaagaaaattaataaatgacaactgaatctattaaaattagtgacttttaacaaatttcaatcaattatgataaggattagaaagaatgccgttactatttccctttattaaataaattcagttttaagaaaacatatcatcagtgctaaactaaaccaaaggaattattgataatatttcataagcaacttatgtgtaataggtaattaacattgatggcaattaatgttttgctacttttagttctaacgtttaccatattaactaatagaagatatgtatttttattgtgataaattaaataataaaagttaactattnnnnnnnnnnttatacttacatttagaatacttattatttattataaatcaaatatataactcatgagtaggaatcaaattatacgatataatttaacaattattataacatttgtataacttaatataaaatataaaatgtgaattgtatataaatcattgaattatatttatatatattattaatttcatttgtgtcaaattttttaaaaattgaacaataaaacaaaaataattaaatgatcaatattttattatattttaaaatattaatattacgttgattttaatttatataaatggagtaataaataattttgtattaatatgaaaatttttatataatttatataaacagaatttttaatccaactatgatttttaagataaagttaattttgttataaattttaattatataagataaggtcaattatttatcttatgccaacgtacatattagtataaaaaagttaaatacgggtattaaaaaaaaacaggtaaaagcaaaactgctttttcggacaatatttcgtaaaatagtagttattgccatttactttgctaccacccatctcttacacgcaagtacaaaatttgagcaataaagattttaaaaaaattgggatgggaatgggaccataaaaacaaaaaataaaggggtaaacaagtagaagagaggagtgagtgtaactgaaccagttgctaaatcgtagttttgacctcgaaaggagtttggtcttaaacgagtgcccaggattcggtacctgaaattgcccactccaatgccactgactgctgaaacacgttccgaagggacacgcaccaaacgacacatgtgtctctcacgcgcacgcgagaatcgcgtatgttgtttcaaacctgtggtgaagttgaattttcaaataactcaagttagtcgtttcactcccaacaaatttaaccgcttttaaaacaaactcgacaatttttactgtctctctcataaaaataagtaaaaacacaaaccgaggaagagtataaaaagagaaagagagaggaaggaggaagaactgttcaaaatcaaaatgcagactaaggagaagcatttggcagtacaaaataagagccaattttcaattttaacattcacagcatcgatcaagtaagacgcgacgaggatgcggatctgggtcaacaacgtttgaccagcataaacgatgacattagggtttaattaagtacttgtgggtcccaccttaatatttctcgtgtcccgttattattattatttttttttttacaaattctcaaagaagtatttaaaagccttcggccttgtcgttgatgatgttgtggtccgggtttggagattcattacattacattacccctcttatatataacttgttacctaggttttccttcattctttatctttcaaaagagagacacaacaaaaggaagaaagagtgattaagtagggacatgagaacaaggagaggagcgtgttaccctggagtagtctcaaggatttgttccgatgtgagggtttcgaagaaaataaacaaggatctgcacatccatatgcatatgcatgtccccgccggagactccattatttgtagccggaaaaggcagaagaaaacgccggaaaaaaccgccggcggtgattacgattttttcgagtctttgccggacgacctcgtaatctccatcttctgcaaacttagttccaccgccactaaaccttccgatttcgtcaatgttttaatcacgtgcgtctttactcaaccctcgttctcctccttcccacatttctttgaacgggtttttgattctgttttttttttttttttgaaaaacaacaggtgcaaaagattaaacagattagcacttcattcgcttgtgttatccaaagcctcgcccagaactttcactattaaagcaaacgtttggtgcgaatcggcacacaaattcctcaaacactgtgccgatgccggaaacgttgaagcttgctatactttaggcatggttagtacaaataataatactaattaattaaaaaaaaactgcgaagtgtgaagaaattgttgtttgttattgttattgatgaatgatgaatctaaatttgttgatttggtttctgtttgtgcagattcggttctactgtttgcaaaaccgagggagcggcgcgtcgtttatggcgaaggcggcgattaactctcacgcgcgggctctgtactcgctgggcgtgattcagttcaacggaagcggcggcacgaagagcgacaaggacctacgtgccggcgtggcgctgtgcgccagagcggcgtttctcggccacgtcgacgcgctgcgcgagctcggccactgcctgcaggacggttacggcgtgcggcagaacatcgccgagggacggcggttccttgtgcaggccaacgcgcgcgagctcgccgccgtgctgtccaccggcgccgccgcgcgcacctggctgagttggaatcttcagccgcagcagctccggcaggggtccgggtgtccgcttctcagcgatttcggatgcaacgtgccggcgccggaggtgcatcccgcgagccttttcatggcggagtggttcgccgctcggggcggttcgccggggccggggctgagactctgttctcaagcggggtgcgggaggcccgagacgaggaagcacgagtttcgaaggtgttctgtgtgtggcgacgtgaattattgctcacgcgcgtgccaagcacttgattggaagttccggcacaaggcggagtgcgcccccgtggagcggtggctcgacgaggacggggaagatgtcggtaacgacgagggtgacggagaggtggaggttatggtagatagttagacaatttttaccacggtaacggtaacggaagtcgctttggacggaaaaatgaatctatttttggcgaagtgaaagaaaaagaagaattacctgtgatgatttattcgccgtctcaaaaaggtagaagagagtatatggcttcttttcttttttccttgtatagttcgaaaattctcccgaaaaatacgagaggagattctttttctttttcttttttttttgcaatttcggagtttaaagttaatttagaaattcaatgctaagaggttactagttactactataatttttgttattaatttaatcgatttgaatttaattaatagttttaagttttattgctatattaaaacttattttgcacatttatctacagtcacttgtttgtatttgagatattagtggatacgtcaaaattaaatgtgatttggttgaagattgagatttggtgagctgtgatttgtctctattgatttaatgcggcgccatcgcataaggttgaaaaaggaatagtgaaaataaatctaatcagttcacagacatcaaatttagcattcatacaattttacctcccctcacatgcatgagatgattgcagagggttgattctaggtgatccaacaacttgttagtagcgtaaagaaaattataaaaaaaaaaaggtgttaatgacaaaagattcaaacgaacctatcattgcttgatggcactaattatttgaaagatactgttaaatttgtttctattttattctctgagctagacaaaccaaattgctcagaaaaggtttaagtgaggttaataataataattagttctgtggtctttgagtacaagactaataatcttcactccgacatttgcctgacttgtttacaacatgtttctaataatcgtgatccatttacagtatacttttttaataaggttttttcaaatcccttttacttcaaagttcaattgctttagtggctaaaattcagaaaactctctcgaactgtatagctcatgtataacgaatatagtccatagtttaacttagcaatataactttggaaacacttctaaattatgtttaatgaagtatattcacgtttcaatgtgaaaattctaaagcaactctggtgttgcttttacaaacacggcgggatcgtaccatttgagtctttttttcatgctttttccggacattttcttttccaagtgaagtcccctagtatatgaaagagtgaagaagtgttttcattattgtggaataagaagccttcgtaccttgagatctcaattccagggtttaatagtacatcctaataggggatgaccatacttgttcaatttatctctcatatttgttcacctcggtgaacatttcatgatattgcccaagctgccttcgatatgagtatgaggaattcctaaaaaacaattgtttgaagcctattgatattttggcctcttctaagttgtgtttgatttaggaaaggaggagataaataagagaaattttatactttttatgtgaaattcattcttttatatttattttaattcatttttttttctattttcattatctataccaaatacatccttaacgctagcttaatttatgtctagtcttacaataattttaagatatgttttttttacattaattgaaatgatttattagaaatattataattttcttagatgtttataaaattagttactttttttttactgaagtgtaaaattagttacttgactattataaatttaatctatttgttatttcattttaattagtaataaaagttagtctatttaatacttatttaggcattattcatctggactagtattttaaagagaagtggtaacaacactttttttttaaactctttttgttattgacttttttttgtataatcactgtgaatcccacatttaaaatacgaaaaagaaaattaataaatgacaactgaatctattaaaattagtgacttttaacaaatttcaatcaattatgataaggattagaaagaatgccgttactatttccctttattaaataaattcagttttaagaaaacatatcatcagtgctaaactaaaccaaaggaattattgataatatttcataagcaacttatgtgtaataggtaattaacattgatggcaattaatgttttgctacttttagttctaacgtttaccatattaactaatagaagatatgtatttttattgtgataaattaaataataaaagttaactattaaaataaataaagtagttactttttaaaaaatatataataaatatcataataagatattgaacttactttaggcggaatttttttttctaactatagaaacatcaaattcataaacgatactatgaagttgtaggagagagttattgaatatcgcctaaggagggagatcaatttttccaaaaatcaatttggatttatgccagaaagatgtaccataaaaactattttcttgatacgacaattaaaggaaagatataaggaagaaaaaaaagacttacatatagtatcaatagattttgaaaaaacatatgatagggtctcaagagaagtcttatggtggattcttgagaagaaaaatgtagcattaaagtattttaatacaatcaagaatatatatgatgagactaccatatgtgtaaaaatttgtaatggaatatcaaggtattttcctatgacagtaggtgtttaccaatgttcagctcttagtccttatctctttgccttagtgattgatgaactaacgaaatatattcaagatgaagtgttgtggtgtatgctttttgcagatgatatcatgcttattgataaaaccaaagatgatgttaatagaaaattaaaattgtggagaaacactttggagcctaaatgattcatgataagcaagagtaagagagaatatatgaagtgtgagttttcgcaggtaagagatagtgatcaagacacaatgtatttacttggtcaagaggtacccaagaaatatgtttttagatacttgggatcaattttacaaaaaggtgatgagattgatgacgatgtaaatcatataattagagtagggtggataaaatggtgaagtgcatcgggatatttgcgtgaccgcgacatttcccttaagttaaaaggaaaattctatagaacagctataataccgatagttatatggagtggaatgttgaccaacacataagcaacatgaacataaaataggggtagtagaaatgaagatgttaaggtggatgtgtggttatatgaagataaataagataaaaaattgagatattcgacgaaaggtatcaatgatactgatatgtgaaaagatgagagagcatagattgaggtagtttgagaatgttatgagacgaccactagatgctcccgtaagaataaaagtgtgttaccaagagctcgatacaaagagagatacaggtcgatcgaaatttacctaggaaaaggtagttaaataagacataatggagtgagatatagattgacgaacgatatgtcttaggatggagtggagaaaagttataagcttgatagaggattaactcattagtagttttatgttctagttgttcccttgtttttgttttcttcttcttcatttctttcttattttattttaacttatttttcatttcttttgtcttatttttacttttttctttccctctccttttctctttctttgtcttattttcgatatatcattaaattcatttaccacccgtctcaattaacttgggttaaaggtgcagttgatattgatattaattagttatattttttaatttttctaaataaaagtattagtaattaataataattttggagagtttttttcttctataaattgagtctcaagtaaaggttttactttccttatgtttaggcacaccatggctccacatatgtcgataaaatctgtagagaatcattggtacgatttgatgaatttatgaagttttataagtaggtttatacgcattaagttttatgtacacaattggaaaggtcctttatttctatttctttctatttgacccaatttattatttattacaactcacaaagcaggatattcaattttaaaagattcaatacctaacaaagttattcattaaaaatacgtaaatgacatnnnnnnnnnnnnnnnnnnnnnnnnnnnnnnnnnnnnnnnnnnnnnnnnnnnnnnnnnnncatcttctttttttttttttcatctgcaattataaatgtattaattaacataagaagtgcttaaaaataattacatctccaagattctcacaacactacataatctgacagtgcaaaatcaaaatcagtcaaacaacagaaattattacatcaaagaggagttgaatcttaatatatactcaccaaaacttatataaagaaagatacatcacttcaactctagaatcaaaccagaattcatactcaatcaccctacaaacttaaaatttgatagagaagcaattggatcagcttgccaaagttaacaagtgatacaaaaatctctttgaaaagctttcaaccatgaccatacaaaaaacatgattttgtgtcaaactttctcattgtcaaattcttttccttcaaacaccatttcatttgattgactccatagaattcagaggataacacaccatcccatcacccaccactcatttgcttttctcccaaccaaacaatgcgcatgttgcaaaaaaatgatccaataggcagtgcaaaatttaaacccataatactagactaacgtttccaaatattgtgtgaaataggacatgtaaaaaacaaatagaataaatcctttacctcctctttatagaatgcgtacaataatttttcatctaactttaattatcgctgtcttttttttttttggtgttttggtcaagaggggatcagaaaagatgaaaaagaaaagtaggagacacatttgagaattccaagttgcagtgaattggtgtgggatatgcgcatatttgcatatcatagagtagaatgattttgaaataagtaagctggctggaattttagtcctatataagaacctcaaaatatatttaaaaagggggaaaaatattcgattttgcacagattattagttttaaatggggaaacaaattaatttattgggtttgggaagatggtgagggattgataagagtgcacttattctttctgcaatgttcgttatttattaatttttggtccaggttctttatttatttcagttgcactgaaccccatacaagtgaacgggtggtccaggcccaatacagtaactagtcccatttccaaatatctattcaaattacggagaagaatatcacaaaagggatcatagagaagacgaaaaaagggtaatagtttggcatctttttcaaacaagaaatcttgagttttttcattaattttttcaataaataatctatcactatacttagagaatatggaaataaaaatacaaagaactttgagagacatgcttcttttatttccaggaaacatatttggcatttccttatggggaacattagtactaaaataagaattagggtcacattctaaagagatgggaggcttggcaaaacaaaaggaaaaaaataataatagttagaatggatgatcatatatgttgggtacaatagaattcgtgcattagaaaacaaatttgcttaatgggccagctacggagacaagcttacttgttacatgctaactaccactattttgtcgaaaatattaagaaccttccacgacaggtgggattcttatgcctttgaattgagaatgaattcccctgtttgagcatctaactgttaattttttttcctttcttgctttaataatctctgtttgcttcttgctttggtatctttgcatagcatatgcagttattgccaggtcggttgtcaccatcttatgctttctgtctaatcatttttcatgtcagaattagagggagacaattttaaatcatcttaattaaaggcaatttaactacatagcatcgatttattttttaaactcctgaatgcatattttagattaatgtttagtaaggtattatggactaactaatgttttattgatttaagtagtaagaaatttatttatttataggtaaggagaataatctaatttatttaatcagggaaatattgtagttttttatttaacacctaattagtttccctctattcgagttaaatggagttagttcattttaaaaaaatgatacttttaattatgattttatgccaaagttgatcaaatcttaaattttgattaaaaaaattaattgtcgaataacttgtttcaataacctttgatatttttttttttgttgaaattaatacaaaaactgaataattgaagacttataatatttatcaataatttgacaacttaacttccaagcttaagttatcaagtaataaaattcattaattacttttaatgaaaaattacatatgttaggacgatttctttaatttactttcattttattggtagggtatactttgcaaaatgggaataaatgaaaggagaaaaaacataaactaaaaggtctcctctttgtgattggggtcaaagaaaatgagataagaaagaggggaaatgaatgatgggatcatgcctcaccagacacgaaaaaaaataagaagacaaaaccacgtaaagagagaattatttattttatcctgagaagtaatgaattataaatatttgtatatctaatgcatggataaaaatgtctcggtgataaaatatttttttcgttcacacttttacctaattatatagagacaattcaactttttccctctttattttcttttgatttaaataattttaaattttacttttatttatttatttatttatattctcttttattgaatttcttttatgtttcttctcacgtccaaaatccaaataaagcattcaagaagaaatagctctcctcaccacattacccttatgtagtactacctacattaaaaaaattacaataacattatttatgcctgtattaaccttaaggtagtagtatttctttacctgtaaagaccttataaaacaaacgcaactatttaataaatatttattactattattaaagtgagtggacccatcctaaacnaaacgcaactatttaataagtatttattactattattaaagtgagttgatccatcctaaactattccaattccaattcccacctagcctagccactacacctaccaaaaaagaagacttgttggctattttaaaaatgaattaataaaataaaattttctgtttttataatgagttggtaggccaatcaatttaatattataaataaaaaagaaattaaatgattttaaaaataaataaaataaaataaaaatgaaaagataaataaataagaattgagaaatatgatgaaaattgtgttagaatacgagcttctagttaacgaatgaaaattaaagaaacagaaaaaattgacaggacaactgttccacctttgttctcaacttatcattactcatgaattatatgagtctataaattaatacgaggaacccaacaaataaataaaaatgagtaaatgggttagtatggcacatcaaacccactttattaagattagttttattaacattctttttgtacgagtgtgatgtaaaagataataaaaaataaaaatatatagataatataaaattgaataaatatagatagatgccaagtgttaaaaagtttgtgttagaatacttgcattcctcttatacttcaattttacccattgtttatagttgtatgaatttattgcacttttatgtgttatatatatatatatatatatatatatagatattaaattgcaaagttatattgaaaaaattctgttggagtgagtaatatttatcagggggtgaaaaataaggtgagatttaacttaaggataatagagaccgaatcttattcaccaaaaaaataatagaaaccgaatcctattattttgagtaaatgtccgttaactataatggcttgattattaaattaagcccagaccaatataagtattaaatggctgagctgcatgatgggaactaatgggcttaagaaaattgagcccagacgttattgtaatattggcaaaaaaaaataaaaacttgatccagaagtaggagtgggtttagccacgttgaaaacgcaggcatggaaagcacagtctattttcattgggtgctgatcggaacaaacaggtaatgcagcaaagcactttctcacactgaattttcgcgtttcaacaatttcaattgcactttcatcatagacttcttcgtaatattttctcggaatgttccagattcgtggcttttaccgttgttttgttgtcatgattatgtttttctttctcaatttcgtagtttaggatttcgacatgattaagtgctttattttttttttttaatgattggaagggaatagaagagcggagaagatgggtttcataatggaattcgctgagaacttggtattgaagttgatggaagatccgaaggaaagggatcggaggttcagggagcacgtttatagagtgaaggacaggtgcgagaagacgaaggagatgtggagctaccctatgcgaccctatgggttttggacattcgaacgccacaattctcagcttgcttgggatgcacagattagccaagtggccgggaggagggacccttatgatgatctcctccaacatttctttaccccacctaagtgaggtattgttgttgaaaactgtaatttccaagtatgcagctctcaaatgtcaatgcaaaactggattgtttttggttgattatatttggttttgtctctttgatgaatgacggtcaattactgtgtagaggttattttagtactttgaggctgatgttttgatttgtctgcatgctcttatgattatattgtgtttatggagtgcaactagagatactgtgttttttaaatcctttgggttgggattctggagttgtttaggatgagagttgatggtgaaactctgcagagtctgcacctgtcaggctgtcactgctatggtgtaagctgttatttactatattagaagcgtggtttttagtagctaaaacaaaataagtctgagctttattggggtgagaagggaaaaatggtgaaagttgggaaggcagggaatgaagtgagaaatagtggagtggatgggttttaccaattcttaggctgtgaacatggaaaaagaagtatctacaggcttgctaaaggtagagaaagaaagagtgaaacgcatcaagagttagaagggtaaactaaagtcttgctaactaaacaagttatcaaggaaagatggaagagtcactttcgagtttcaacaagacatcttcaagtgttcctattacatatgctttctcaggtacccttacaatcacctcagtcaagaataatttggcttggtcagccttagttgaactctggtttataggtctggatctctttgacctcatttaaaagtcagcatctgatatttgctcaaaaagtcaaagtcagtgggacatttttgatcaccagctttgtgctctgttatggtgatctatggagcctactattttgggcaatttcagaatcttaaacatgtttttaaccttcagaaacaagtcaaagagctggtgccatgatgcatgcttttgctgatgatatagtactagttggagagttgagagaagaaacaaacgggaaagttgagatgtggagcatttttgagaacacagactttgtataagtagaagttaacatagtatctgaaatgtatgatcagcaaaaagtgcaccagtttgagcttagagctaaaatgggaggccataccacacaagtcgcatgattttaagtgtctaggatccatggtacaacgtgacgggaaaatagagggagatataaaccatagaattcaaaccatttgaatttaaaggagtgcttcaagcaaaacacagtaatgtaaatagaacagtaaatgagagatgagtattatttgtagataacagaaaatacagtagatgataatcctactgcccagagccaagctctttcagagaggttacaattctctctccataacagaattctaaaattcccgatacccctctctctctgacaccttccctaaataccctcagattccatgtcacacttttggcaattctgttactctcttgccagatctttccttttctcacctttgtttttcctagcatataccctggatatcttgggcctctcccttacttctaagcccacactcccattcctatcattattagtgatagaaaagtactactgaagcttcaagggaaaattttactccacaacattaattatagtagttgttatgttgtttaggattgaatgttggagagcagacacacaagatatgcaaggaaataaacttgatgttgcagagcagacatgcaagattataattaggaatgtttgcatttgagtgggggttgaagtagcatgagcatcgattgtggaaaagatggtaattcctgccttaggtagttggggcatgtgtagagaagacttgtaaatacccaatacggagagttgattagatgaagggtagtgcaataattgaggcagagggagataaaaaaccagaaaataaattagatataaatggtttgtcattaggtatgatttacaatagagcattattgttgttcctttaattgctttctttatatgtatatttttctattatagtcttttggaagtttgacgaggtaggtttctagttataattgcagtacctgccgctgtcttctgtactcatatgtggtattctcttttctatgcagtgttgctgaacttgccacaagcattataggtgaaaaggatgaatttgtcgtaatttccccttctaatatcctgtcttgtcgcatgttgcagagattacaactggattgtactgttatttcaaaaataaaggttccatataactatgctgttacagaagaatttttcctctccagaatttacattcttgcacaactgcacttcttggcaattatctgctttatcaatgtttcatgtcattatttagtatttacattgtttgtggatgattcatttctgtcgtcttgtagcctgtagaatgccatatttagaaccttttatgtgttgaatagttcattgttagtttttcatagaatgaggataggttggcagccttaaggtttgctacggaagtaaatagtctatcattgtggtggcaatgttacactgtgtatgtttaaggggaatcccactttccaaagcaggttgaacagggaatccttctcactgtggattcacgttcaatgtgctccaacgtgaaaacaaacgcagctttagtgttggatctttccattaatgtagtgcattgaattttgacacccatcctgtaaatttttattttaaccacaagtctatatgttgaacttctatttcctccaacttccgatcctttcgttgtttcaccaagttgaccttgaaagagatccctgtccaccaaaagaggccggttcactgtggcataattgttatacatgcagaaaacaataaagaaacaacttcaaaacctgcaccattcgaaagccttgtgtctttagatttttaacaaaacaagtgcgaaaatccaataagtacgacaagagttatccataaaataatacgttctgcaaaaaaggaaattatgcagttaatattgtattttcaaacgtataattgttttaattgaaaaataaatctacctcaactatatatcatttcaataaaattagtgatgctcaaatccatcgcataaaacaatggttgttaccaggacaaaatcaacaattaaatttagtttaacagtaggaaaattcaacaaatttcaaaatcacgccaaaagctggacgatatgagcatggcaaaagtcatcatgcagatttagaatgagattttagagaattccttctcaatcattcaaaactattctttgaccaaaaatcaaatcaatacttatttgtttcgatgaccttccctcttccttttcttttttgtagaaagagccaagtctaaagtcaaggaactcttcggtttagctagcagtgctcattacgtcttgaagggcaatcatcgattccaacgagagcataggatgctcctcatgcatttgtgaatgcaaccctgtttcaactctttgaactttgtaatcaacttgtgatgaggaattggcagcctgacctaccctttagtagtaaattagttctgaagcttcaatgtttattccttatattagttataatccctatatttattctgtttaagattttatctctccaccgtacgggacatcaatccataacatgtaagaataatttgaaattttaaagattacgaacgaatttttgatataactacaatcaaaattaaattaaactataagaataaaagtatattctaaccaaataacaataattcttttatgagcctagtattatatttttagtaatactgttcttagttataaaataaatcatttaaaaaccaaaaatatattaaaaatcataataattcgtttttaaaattactattatgctagatataatttttaaaataattattataaatcaacaaaacctgaaaggattagtcaagtgaaataatacaaaatctcgtatttagcacgtagaggcttgtgtccttgggttggagaggcatccctcctaaatttttcaagtgctataaaaaaaatttttttttttggtagatggagaaaaaacaaacaacaaaaacaaaagattacactccagaaacaggctgattcacataatcagctaataacagtccctgagttacacacacaaaaaaaatcttctgctttatcaattagtatttaaatcatattcttattttcttatttattattaagtgtaagtgatttgattgtggcgtccaaggaagaaatgctcttgaaatgtcgtggaatgttaggtgggcaatcccagttccaatagtgagttagtgaccaccctcaatccgcccaagacgacaataaagataatttttatgcaagaaaaggacgaaacaacttcaacttggtgacgtccatttaacgcaaccattgacacaatcccataatgttctacgaacttggttaacttataccatccacacactccgaacccatttcttacacttccatgaacacccacattgcccacaaacttaaacaaatactagccagaagcagattttatgaagaaaatagctaccctattagtagtgctctaagaactctctgccacggaacctgcttcatcttcattcacattgccttctccctgtttaaacgcctttgctatctcatcaattggaatcagaggcaaatagccaaacacggcaaaacccttttcactcgttcccttgaccacattgttgtatttttctgaccagtgtgcagctgtgggaactgccatctctgctactgcatggaatggtggatattggttgagaccagtccacaatttcaccgaaccaaagagcacaatttgcttggactcagtggctacataatttgctgctgctcgtgcccctccagattgagcctcactcactactttctcagctttgtgtgtcacttcctgaaccaaacaagtgacttgggttgcaacctgcttaaccaaagaaggtgcatgctcatcgaatttgtgagcagcttcatccacctgccacaatcatatacccaaaaattaattgcttagcaaatagtagcaatttcccaatccgttcaaacatcaacaagggaatttcatttcaggcatgtcgatgcaagggcatacaaaatttacataaattcattctttttaattttattttgttttaagtactcatggaagacgataggaatcaaacaagacaatttaagggagagaactatacataaaaaaaagtcaaactgtgtgatagtatcaagttctggggtaaacaaaaaaaatcaactgtggatgcatgtacagataacaggttcctcagaaagggtgttattgttatttgccacggttttcaccaattcaactacgtgggggaacgaaacaaatagatcttgatctgaataaaaagataaaaaatcgtcagaaagaaaattcatccttaataattagaaacagaggacaaacaaattgcaagctttaactgatttggttgaaggggtacagcaacaaaagaagaaaaaaacaacaaatcacacaaacaaaactaataaatatagattttcatgaaagaaagagagagaaaccttgttgtcgacaaaaaggaggaggtggttggggacagccttgaatttgtggtagacgggacccagaacggtggttacagtgtcttccacggttccaacagcagatctcaaaggtcccgagttttgctttgcgaagtcgtagatattcgacacacacacaaaggctttaattgccgcaatctttacaaacccaagatgcttcagttcttcttgatcactcttgttctccatatccctctgcacacacaacattattcaaagattaattctatgagatctctgcaaacaaaacatagaaatcgagaaagaaaagagaagaattgcaaacctccaaggtggtggccattattgttttctccgccttggaacttgcacgttagctgttgttgctgcaaatataagctcagtctctcatttggagtgttcatttatagatacaaatgggaatcacatgcaactatattaacataagtaaatgccaacgagtacggactccattcttttttaatccatgtttaaggttgtttttgtaaaaaccaataaatataataattttttattttaataaaatagtcgtagagttttttatttcatttctttctctttcaactccacaataaataatgtatgtgtgaattaattaaagataaaaaaagtaagattataattgataaaggaataattcaggtgatcttgaactttacaaatgacaaataaatagaaacaactttttttttaaaaatccgacaattaaaaatgatcagaaggagtaacttaaaaaatattgattaaagaatttaaaatataattttttttactgaaagatagaaaattgtaatttttatgattttttacgcttttataaaatttatataataaatatttttttaatttcttaaccaattaatctacaataattttttattacctagaccattaacctaatcaagttacttagtactatatagcaattgttaggggtgttcacaggtacgggtcactcatgaatctgaaccaatctgaacagtttgagttgggtcatttatatatttgggtcaaaaccaaaccgaaccggtcntatagcaattgtagtgtagtattaacctcgaaatattaaaagtgaatatatatttactatcatgtctaaacaattccaaaaaaatatgatacgatagccaggtggaatcaggtctggttacttttgttctttaaatacaatcacaaaacaatgccaaaaaaatatttaatttaggatttattatcttttaaaaatacaacaaaaaacaaaaataaagaattgttttaatttacacttaatttcggtagaataagttcaaattttttttattatcataatattagtgtaaagtatcactaattttattaataattaatatatgctagagaatttaactaattcttctcaatcatattctttttatctataaaatttaaatttaatatctttcttaagaaatttaatttcagtgtaactaatactgtaacaatattagtacgttgaaatttaatcacttaagcattattgctttattgcgggatacaatatccccttttttaagtaaaaatgtaggaaaatgagattgtgcctaagtctaaaacaagaatttaaagttttcactccttttttttctgtctgnnnnnnnnnnaaaatttaaatttaatatctttcttaagatatttaatttcagtgtaactaataccgacgatatacgttcaaatttaattacttaagcattattgccttattgcggggatacaatatcccttttttttaagtaaaggaagatgagattgtgcctaagtctaaaacaagaatttaaagttttcactccttttttttctgtctgaggttgtattacttaacctatctcagctttgatatatcctaagtgtattatgattggacttgaggtgcaccaaaacaaataatgagatgccttaaataattatccaagttaaatatcccttcaccgttggattatgtagtctttaatatttttttgtatgctagcccacatgagatattgtcgaataaggccgatcagaaatgccatgaaaaaaattattagcccataccttaacccaggcgtgttatggttttgtatgattctgatttctgaatatcgccatcgtgattttggataaaattaaatgcgacacttttatttattgatatagttttagtttaataaaaactaaagttttaacgtaaatattataaatttattttaataatacgaaacattaataatatatattattatgttaaccattaattggtagatgacgtttttctatagcgattccattcgttattttagaaatattccctccttgttctcttgtactgtattctatcaacgacgacttccaaacaaaagctctacataatatttgaattctatgatttattcccttctttttttcttctttttatttttcttgtcctatgaatggccttatccttccggtgccgatcatattttgtctgtaccaatatctttcccatataatgaatgctacaaattaataaaatcttgatcctaaattgtcacatgaaaatgtaaatacgtcactggaggcttatttttatcctttttttaaataaaaaaggtatctctttttcttttcgatctatttggaaaaaacaacgtgaatgggccatgtaatttctgttctttcttatactttgaaaatatctttaacatggatctcatactgcatacattactgcacgatcaacttaacattcatttacttgtaattatctagttcttgtaactgtattatatcattctcttagcttccatgcatatgcttgtcctctctacttaggcctttacttaaattgagattttctctttaagcctgagttatagagttaggggagttatataatcttgtttttaattgagtctattactatgtatactcttgtggagagtatggagccaaggacttttctggtttattctattgtaaatccctcttatagtttttcactcactccactacaaatggacactgctcacactcttaacttttgtaataattaagcaagacaggcttagaaattatttacaataatttctgtattgtgaggctcaggtcatcattctatagagtaaccttcttgggatattttatgattggagaaacatttttctggtttggtataaaggtaattttggcaaatacaacaaaatttgaatgctagttgaaatacatacacttttggttactttggttaaacctttctcaatacacattaggtatactgaaaggtctcccacctaatgggaagctaaggctgctccaaaacttgaaatggcagaattaaaactaatataattggagagccatgttacaatagagaaccatatccaaccacttaatgcatgaatttgaaaaacttatatcttcagaaaagcaataggaaactggatttcatcttttctatctttgtccagtgtctttgcctaattcagaaagtgtatttcagcattgtctccaaattgtccattggctgggggttggagggtgaggagagtatggattttgatttggaatagagtggtttagtcaatttgggattgcgggaattcaattattttttccaatgggattggtgatccttttcatattgtggaattaaatttaatccttggcattggtttttggctaaatccaataataggagcatttctcatattgagggtattttgaatagtttctagttctattgcggtagtaatggggtactataggatccttggtgttgagaattgattttcaaccccctttttttttgataatttggaatatccttgatactccttttataaagttactagtactcctctgcttaaaacacccactgatggtttgttgaaccagtagaatagacttatacaatgtttgaaaaagaataatatttgtaatggcaggaagacttagactactaaaggtattttagtaaccttgttagctcaagaacatcaaagaatgcaatagcaatgcagactaattatttaagatagtaaacgaattaatgaattatatagtactgataaataagcggtgtactccttgcaagtaatcaaaattaaagaataaataaacatccatttcacagtttccctgacaggtcaaattaatagcaaatatgcaatttcaggtatagaaatccgaaactacctttaaaagatgaatccgtcaatcaatgtaaacaaaaaatattcatcaaattaaaagtaaatcataactaacatcttatgaaaaaagaaagacagagtttaaccttgattggacagacgacattatgttccttcaaagtatcataaacactttccaagctcaaatgctccatgaaaatgtgtacttcaagatttccaacttaatataataatatagtcaagcaagttgataccttaaataccacaagatattgaaattgcactgaccaatgtcttaatacaaatcaggaaattgcagaacaactcatcctgaggataattgaaatgaaaccccaaactctggaagtaactctgtgattggctctgcagcttggaccaaagttggttggtataattgaaggcaaactgtttctaataccatgttcatgaaaaacaactctttggcaagttggaggcgccatctaaacctcatagattctactaccattggatcaaaaacttggttggtgtgttagtataattagcagttgttaaactaataagtttgttgaattttgatgtttgtcttaattatttgactttatgaacgttagatattaatagcattattgagcaagtaaagcaattgacaattgataaagaacagaagttattgagaaattaggtaatatcttgataattgtataggtgaagtcagacagccaaaattcatctcattgaattcttgcttattgcagtatattgaattttttagctttctagctagttgcattcttcatctttttagattctcttgtttaaatcacatcccctttttcgtttatcatctaaaaactaagaattaggttaaactgatacttaaacaataatccttgtaagatcatatcttagaatcctttataattctaaattacttgttgatgtgtttagttgcccaacaagaaaacttaatagcaagtaaaattagatccgatcaaatccttagtttgttctctacaagatgccaaagtaaattttccaatcatgatgaacaagctcgatatgaccacccgtttgaataggtaaaaagcaaaaaacatacatttaaacataggtttaaatgttgagtaaagctcaacaacaacaattactcacaaatcgacttaatcttattttcaataaattataacattcaattgttttaagttttaacaaatactagtatgtgagaatgtatgatgcaacatgcaataatcaaacaggtactacttgcacaaggacttgaaaattgaaatcactgtacatacgttgatcgtggacatttcaaaggcaacaaaacaaacttaatcacaaattgcattaatgacttcccttgtgaaaagataacgtagaatctttggcaatttcgcatataaaatgatcaattaatggttcatgggcacgcctaagagaatatgttaactttaaggttatgctacgtggggacccaattcaataagacaatagatttgtggagcattaacatgattattggaagtgtgagtatgtaattacttcaacaggaataaaagggctttgccttttatactgttggagactacgcgaaacgaatattgatttggattagaaaagcctaaaactttggggacgtgacttaaatatctttaatcactttaatagtttaaagaacctggcttttatccaagacatcatattctaataatcattttgtcaatagaaaatgaattgcacaccacttaaagaacctcagacttagaaaatgcataccatatgagattcccaatattccactaacttgatattggggagacgacgaatagagaagtagaatagtacgtacttcgaaatctgttaccgtcctttcttcctaattaagttagctttgcacgtaaaaatgatcttattggattttatcatttagaacagtgttacagaaaaatatttaacacatttctttttaaagaaattttactaaaatatttgaatctttcttttataatgaactcatataaaattcacctacccataaagagtatattaaaataatattatgtgaaaatgtatgctgctagtatatatatatatatatatataggtaaatctcacttgaaaaaaattattctgccaccataaatgagacctagctaccaatttacataaggatgtatcagcaacatgtacttaactaaagtaaattaatattcattcaattcaatttattttttaaaatggttaattttcaaaattgtaaatatagcataatctgaaaagattaaatgatttattttttaaaaaacgaaagtgttttccatatctttagggattaatttaagtcatccttttttatgctttaaaaagaagtattatgcttaatatacaatgtgtttaaaaagttccgcgtgaaagataaaatcaaaacttaaagacaatacggatagatagataggagaggttaagaatgagcatgggaaaaaaataaaactttgtttttattatcaatccaattactgataaaattcaacacaagttaataaatagataactttataaatatattgacttttgaccatgccaatatataaaaaaaattattgagagaaaaaaaaatctattttgataatctctacaaagaaattttgattatctattgggagacatctttagtgcacacgtaacaaattgacccaatttaattactgagaaatgatagggagactttctctatactctcttttcaatattcttcatgtgattgagtgaaatttgttaaaaatcattaatattgatgagtctcacttatcatttaatgattctctctttatggattgtttaaaattatactattataataaacatatataagttatttgactgtaatgtgacattttggaattaattaatcggagataagaaattcaaaatgagttatttaaattgaacttgtcttaacctttaggctatatcatcctaaagtactattacatgaaagaatcttatcaacatataaatccgtagttcataatacgtaataaaaaaaaaattaagtgatagaggcctcgaaccatctattctaccatagagaaacggtagacaataactcccccgaacacaaatgatcacaaccggaaatgctctgatatgtgcatcgttttggcctggatttacgcctagagcggtttaatgaccattaattacatcagcctcaatcactgagagaatcaaataactttctgactaattaatccacaacagctcaaaaacaaaataagccaaagtggccagtgcacacttgctcctgtgacgcacaatagacaaattgcctaaaaaacaagcaaccacccgttggaattgcacgaacaaaatgaccatttattaccacaaaaatatgacaccacgcaccatgcaacggagaaatgcaatacataagtaattagaaggtgcacaccattgaggaaaacactcttttctaggatttttttttgtcatttcttgattcttaccgatttagtgttagattctttgtgggtaagtcattagtcatcaccgatattcgctagaaaatgcaggaagaactacatatatagtagacttgctacaaagatttcaacttactgggacaaggaagaacatatatagtagacttgctacaaaaattttaaaatacaattaaagaatttaatacaatgacaataaaaataatattattgttgtctttaattaaatagaacaactttttttaacttaaagtttttttagttaaataatctaaactcacttttttaattaacaatttttttaaaagggaaatttaacgtgggtaaggaaacagaggacaatttattttttaaaataattatataaaaaataaaataaaatattaagacactaaatttatgttaactttttattttaaaaattagcaaattaaatattatatattaaaaatgataatttgccctcccttattctacaaattaacctcagttcataaacatcttaacagacggtgtgatttatccgttccatacatccagtttggaagttacaatcatacagaatataaaataaataaaaggaaaggaaggggagggtaaaaatttaaaagaaaaaatgtagcagaaaaaagaaagaaaagtgcattatgttcgtcaaagtttggttattactataggcatccaaagttcaaaaacatatatatacagggtttcagaaaaatgtataacatatggggttactcaaactccaaaaaaaaaatagataaaagaaaactataaaataggttgttgtaactgatcagtagtagacagaaaaagtaacactatttacatgctaaaggtcgaaatagaaaaaaggtggattaatttttcttatttttttcgaagatacgggaggtttaaagtgtaatgcttttagaagttacgtataaatgtatcataaaaaaaatagacagctaaagatagtgataaccagtaggagttgctttaagttgagaaatgattatgataaaggcttaagctttggttagtgacttagtggtgggacatctccagcaaaaacttgaaactagatctttacggtaaaatgatttcgatggcatcccctatatatgatttgttttatatcaattcatatcatataggtgacaatagctagtgagccataatttttaacattatttaaaattaattagatttgttttataaaattgtgcatgcaggtgggttaacccattggatttgctattcagccagctgcgcgcgtctcatggtatttaacccaaagcgatattgaaatgagacgcaaacatacaagaagaaaaatgcatacattacattacaatagtttacattttacaatttaaagatacataaagccttcttaagccactctcttcttagacccacctcctgtcaactggcactggatatttattttaataatttgataccctttaaaaataaagtgaaataaaacttagagataagctccctaattgtacgataaactcatctctaaatatttcactagatatttgagtaacaaatttaacatcaagcatcagatactcgatcatcctaattgcacactaaacatggttcggttcaagggcttacgattatttttatttatttatctacgaaccactagggatcgcagaggtgtcttcatttccatggaaagcctaaggcattcggaaagatccacggtttgcgcgggaagccatatgaagtggcgaagaaggtgcgcgagccagagatgggccgtggccaagcccaaggcccggccaggacacaccctacgtccagccccgaagggtgcaagcctcaagtccgatcccatgatggagacatcttctttgaggaacctctcgggcttgaaagcccacgggtcttcccagatggacgagtcatgcgaaatggcccacatgttaaccattgctgttgtgccagctggcacgaggactttgtccacatggacatcatggaccgcaaggcgagcccatgatagtagcgggcctggtgggtgcagccggagaacttctttcactatggcctggaggtaagggagattcgcaatatccgagtctagcacgtgactgttttggccgacgcacgtgtcgatttcttcgcgggctttcttttgtaagtcttggtgtaaaaccatccttgccataacccattcaaggagtattgcaactgtgtctgttcctcgaaataccatttcctgctcaaaacaacaagatcatatatatccacatatataagcacatccacccattaggcctacatgaacaataagctaatgaatttatgtcactcccaatctgaatcttataaagaaagaatgagatatgcaaccactgggttacttgttaaaatatgttgacatcatacccctacatcaaaggtttttatttctctaaaatacgtccaatattaaaataagggcttgtagatgtcaaaactaattaaagtctcactgagaaaatatttatagtggcatggcgcgcactagattattattctttatcatgatgattgatgaggtactgatagtgaataatatatataagttaatgttttagaaatttcttgaatatatggtcatttcatcaacaatttaacctaggggactttctctactgtgtagctatgtgtcgtacaattaatgaatttatgcatgttaattaacaagttttaagatgataagtaaaataatatactaatccttatttgcgttttttgagggaaatataacgtatggaaaaagatgcatggttatattttatttatattattatccatgggatgagagagaggtccaccactgagtgtggggttttgagagaagaaaaatgattctaggtagatagagtacttacccacagaatagccaccagatctgaatcagccaatctttcttctttgggcaaggatagcaaagtgctaagaaaatcattcttcccaacaaaaccaccctctctttttcgctcttccacaatttgccccaccacactaccaaccttagccgccaacttgtggcaccttctcttcaccccatgaaaatccaaaaacttgaaaggaaaataatcccccaagttaaacatcgcaatcaactcgtacccttccctaaccatatcccccaactcctcactcttatcgttactgccaaaaacactctccaaaatattacaaagtgacccttcctgaaataccctccgaacctccaccacccccttctcctccatctccctccacgcgctcttcaccatgtcgtcacccacgcgctgtcggagaccctccaagccatgaatcctcctcggagagaacatgtgaaacgccgcgatcctacgtaggtgtcgccagtaggttccggaaggagcgaaaccaatggcacgctcgaacatgagagcgcgtgccgattcttttatcggacgatccgaaaacgatgaacccaacaagatttctctagcggtctcggggtggctgcttataacaacgggagtaggccccagactcagcgccattaacctctttgcgttcagggaagtggctaaagccgcaagtttttggtgagctaaagagcccatgaggggcagagtcccaagtatgggccagcccataggcccagtaagttttttattggtttgataatagtgatagtttctccatgcaaagcctccggggacaagccagtagttaagggaaattgcgaagagggttataaagaggatggttgttccaattccaaggcaaagacaaacagcgagtgttgttgaaggtaggagaaagaagaatgttgccgtgggtttcatgtttggtcaaaagaggaggaagaaaaaaaacggtgttattgttatccagagatggacgtgtgtcatgggatatagagcatgtggggatcaattggaatatataggggtggaaagtggataagttaaaagagcccatggttaaggtgaccatggttaagaaccccaggtgctatcttgttatgacgtgaagctgcactataacatttaactttatgagaatcagacccacatcttccgttcctttttttctctttttaaacatcttgattttaggaaagaaaaaataatattttaatagggaaaaattttcaccaataaatcataaataatcatataaatgaatatgacatcacactttaatctaaaatcttaaggtttaggtttatggattttttcttcacttatatgatgttcaacattcttattcctatacgatgtgagacttcatctcatatttgtactccaacaatctatccctcaagtataagtttcatctacataatagtctctccctcaattggaagtcattttcatccacgagtatttttagggtggccttagagctctcatgctatagatacttgcattgtcgcgccactcacgagatacaccgcatggacctaccgtcgggaagacttttgatgcaagaaatccccatgccaatgattcaccatcgtcatcttactcgttcgagctagtcaccaagtcgaacctgatatcggttgttagcaatatcaccttgaattctaaaggaaatgagagaaatcacacacacaaatacaaacacaagagatttaacaaggtttggcaagtgcgcctatgtcctcgggagcaaagtgatttttttaaaccattaaattcagaatatggtaaagtaactccagggtgggagagctactcctttgatgggtgttgcaatgattctatttgcgatatttctatctattattttggagatttataattcgtccattttactctacggaatttctatgaattagattcacaagaatcgagtaattaatttttctatccattattgtttggtagttcattccattttgatcatggaatttcgtggtttttgtatttttggaatatgagtgtgtgagttgttttaattgatcctattgaaagtacaaaacataaaatggatttgtcatcttgatagagatgacacttcgaggtgaaatcctacatcgtgtaggaatgagagggttaaacaccatataagtgaaggaaaacataagcgttaagattttgggggtaaagtgtagtctcgagttcacttatgtggttgctcataacttattggtgtaaatgtccttggtgtttaccccctctatttcccaacaattggtatgagagtcgatggttcgacttggtgaccggtttgaacgagtaagatggcgacgatgaatccctggcatgaggatcccttgtatcaaaagtcttcctagaggtgagtccaaaaagcgtgtctcgtgggtggagcgaaggtgcaaatatttagagcatgtctcgaggggaaggctaccttgtggatgagactcacacttgagggaagattattagagtataagtgtgaggtgaagtctcacatcgtgtaggaatgagaaggttaaataccatataagtgaaggaaagatccatagatttgaaccttaagattttgagttaagacgtgatgtcatattcaatagataattttactaaatacttatgattcaataaaataactttcaacatctaaccaactttttaactatttttatcaaacataaccataatttcatttaattaagttatattattattatgcacacttacgtaaatatattttactttatcatttaataacatattatcatatatattaagttaattattttgtattagttaacattgtgaaaattattatactgatgatgtacaaaaatcaaaatcttattattatgtgtacgaaggtctcagtaccctagtggttcttactatatgtgtgtgatttagtaagtttgaccagtaactcactaattaaatcaacgtcttagtaacctctaataatatattgacactaaatcagcaagtcgagtttaataatattaatttaataatttataccagtaaaaaaatattaatttatatttgattaatataacaaaaggattttctttccaaactcacgtattgttgaatcattataataatggtttaacaatcacaccacttatagaataaaataaagaatgagaatattcagatgcattatccttatatattaggtacattgctttaatttacacttatttcaaatgctttatagatcatctttatattgaatttttgtacctaaattattttattttcatgtacgttaataaagcattgcggcctgactcaaaccaattcgtgtttatccatctagggccttttaatggctataatgtcacacccagccccaaaatatttggccaatttcttggaggcttttatgagtggagaaattatacttcctagttaagtagtgatgaccaattctcatgggatgtacttggtaagttggtgttcgatcagttcatcattgacttttgccatattgtccattggcatgtatctagttggcaattaccatatttgagcttgatttttgtttattttctatttgttaaaactaattggtaagagtaattttcaaaaactgtttttaaattaatatttctatcttaatttaaaataaaggaaaataagttttttttttaatattgcctcattttcttcttctttttctagtctttaaaactagttttgaaaatcattttataaatgatttttggagacaaaaatcaaacacatctcatatcactttggatttcttaaacaaatatttattgaaaaattaagaaagcaattcttttatgaaaaaaaacctttaaaaattgagatgaataattattattttttggagggcgtcaccttgatgaaataaattaattttaacttaaacaataaattgaattaattattcatttttaaaagcgaattacttgctttttataaatacttatagcaaagtttatttaaagtggtatttgataaagagtttgagtttttaatattttattttccttgcatttcttctacatcttctcctattttatattttttgtgatactatttattattcattacttattttatttattataattaagattaagatgaattgatcaagcatgtacataatcagataaggtcattatagttaagaaaaaatactgacattttttaacactttttattattattacagttataataaaaggataattaactagttcgcttcggtgatatgaatactaaattctttcatgcgcagactcttgtgaggagaaagaggaataagattcatgatttattctttgatgatggaacttggcatattgatccgaatgatcttcgtcaggagactaccaggtattttcattctattttctcagaagatagttctccttctcattcttcctttgaggttcagaatatcccccaattgaatgaggatgggaatcttgatctttctgctcctgttacggttgatgaagtcagaatagctgtgatgggcataaaatcattcaaggctcctggccctgatggtttcaaccattcttttacaagcaatattggcctatcgtaattgatctctggaaacttgttagagatgccttcctttatggcactgctgacccgggcctccttgaaaccttgcttgttcttattcctaaagtggaaaatccaaaccatttgaaagaatttcgcccattagcctttgtaatgtggcctataaggtgattgtagttagactccgtcctttcttaactgagcttattgacccctttcaaggaagttttatccttcgatgaggtactatggataaccttgttctagcctaagaagtggtccatcacattcatcaatgcaagtctagttctggagtgcttgctttgaaaattgaccttgaaaaagcttatgaccgcttaagatgggatttccctccgagtatcattcgccttgtcatgtgggtgtaagtggttcaaatttagctgtattgtggaatggttcgaagcttgataacttttctccagctcgaggtctcaggcaaggggatcatctttccccttaattatttgtttgttctctgtatggagaggctagcattgaggattgatgagcttagggagaataatacctggctccctatctccctttccagagggggtcctcctttgactcacttgttctttgcaaatgatgttcacctcttctgtaaagctacggaagatgatttggggtgtgggattgagggattctggtttggctaacatatctctccttggtaattaagatgatttggcagttgattcattctcaagataaaccttcgtgcaaggttcaccgtcaagattggtgaaggatcttcttccttcttttttgatgattggctcggtataggccgaatctccaacatggtgtcgtttgtccatatatatctcagatacctagcttcgtttatgtgaggtctggtcaaatgttggattgaatctgaatgatgtttatacagtacttcctgatcaagtaaggaatcaagttctgagactgcgtattccttctattagaactggcaaggacttctttagttggattagtgactgttcttcgtgaactcttaagaaggggctagaattgctctcctatctttgtacctcgtcatgcaaatggagtagtggatacactgactcgttggggagctcaaaggattggttgggatcacagttggaagcatcccccgaatggagcccttcttgcactaaggaaggacaatagttaatttctttttccttgctttctgtcttttattccattgtacccaaaaaaaaaaaaaaattaagtcggttacatgaatgaatgacaagatttttcctaacaatttcaatcattgtccctcttagtctctctttcaaaagatcaataatttataagtaagataaattgcctatttcttgttctaaggtgttagacgatgccactataattcttgaaaataaagaaatataaaaagaatctaaaaatgcaacacattcgcccatttgctgcatgtaatgtgttacttaagtgataataattatgtctagaaattaaaattatattaaataattaagtttacatatttagacaaaacatttaacaatttgaagaatttatttaaatttttcttaattcagaaccataaaacaaagcttaacattttcaacaccatgatttatcacttattatattataagtatatctatagaccgatttataaaataaaaaaaaaaaggtgttaataggatttcgtatcaggttagtgtatgtttgatttgcaattataaatattacaacatacattctaatacaaatccaacatataaaaataaaataaaagtaaaaagaaaggttttgatccgttaataaaattactttttcctcaaacataattttataacggattctcaaacaatgctcatgctcttctgctctccatcctttacagccaaaagaaaatcaaccagaagcagcacaaagtgaatggagagaaaaggaaaaatgaagaagaaattagaaagatgtaaagaagttggaaagagctggagacagtcttggctgcacatgaacctagtcatgcatgttcgtcctggaacatgtgagtggaaagtgaaaacaaagacctgctatttatttattattattgtttaaaattcgaaccgaccaactcaaagtcacagtaaccccttcataagcaacgaatgttgatgacatgaattaatcatttgatattttacaaattactataatgcaaaagttgtgtagcatgtacatagcataggttatagcctctgccatgtttgtcgctttagaggcagaatgtgcatatacaatctattgactctgagactaagatttgctgagccccccccgacaagcttgtataaagtttccacttctccatgttaccgggcaaccatatttaatttagtcaccggtcaacaacattatgcaattctaagttatttttggaaagaaaaaaaataataatttgttttttaaaaaaattaatatttttccaaaaataaattcaattaaacacaaattaaatataaattctcatacacgagtgagaaataacattcatgttcttgttccccattttatttatattgcgtaactgtgacttagccgcacatgccacagataaggaagagcaacgtcatgccttcacttttcacaatgcttggattcagtaggaaaaaaaaaaaaagtgggaaatattcctgttttggaggggtggaggtttcacctgattagcagtttagcagtctgtttggcgaaacagcgagaaaaggaacacagtgaaaggaaataggaaagtgaaaaataaataagaaatatgatgatttttttattaaagagaaatattaaaaaaataatgtaaaattatttggtttgtataaaaagataaaatatttttttattaaatatataaaaaaataatattttactttcacgtaatgtgtagcacacaggtcattatgagtatatgatagattatacagcacacataataaattatcaacacaaacataacaatttttcatggcattggcttaatttggttgattttagtgtgcatatatataatcgattatatgcacctacaaggacgatagtcaattaaaatatgcatataatcgacttatcaaatccatcaagagctgcgcaagggtttagcaagatgagcaagtgtgagaacaaacaaggattagtttaggaaattaaacactgtatgtccatttccaacctgtttctcttctcttaagcgagggaataagaccatagtaaaaaccataactttaaacttatcacctttctatttcatttatattaaacaacaccatttttttttatcatcattacgttttctactccctccactcattttttatgtatttctatgctaatacactgtaaataaagttatgtttgaatatataatgatgaaggacaaaaaataaaatagaattaaatgaaaataaaacaatgctattattttactgcttagatgttttaaaatgaaagaaacgagtatatcccatattctaaattttacaaataatgatattggaattttatcagtttcatttcattattttatcagcaatacaaacaataaaacttgaaatcattatatttcatttttgttttttccatccaatatatatagcctaataatgaactcacttctagacttagataacctggtgcggcccattggtctgattcaaattcggtgacttgccttttgggttagtttggtgaactatagaactgctttttgtgtaatatggttgacttgtttctaattttaattttcggcctttagtcaaaataatttttttgaagttaatttattttgcctgggaaagttttgactccaatgttaaattacatgttttaaatattataattaaattatattctatttaaaatatataacattttaatattatattctgtttttttattactttttaaaggtttttttaaattccttgacttattaaattaattgataatgttatcctttttgtgaatcgacctccgatccgaatcacacacctatgctcaactatgtccacatatataatattcatgaaaatgcaatgacaagtttatctttaacaattatagattcttcttttagtgtaagctttttggattactttgctttccattttcttctctttttagtatgtgaaaggacaatcccaataatatgccttaagccacatttctcattgccatgtgttactgcaaatcttacggaatgatttttcccagcatccaataatgcaatgtgcaaacacatccactcatttcacagttggaatgagcaaaaactggacatgtgtttcaccgtggcatgtgctgtttacctcgcagctgaaccggtcacaatcatgtttgtggttttggccaactgtgtttgtttcaatttattataaatttaattttgtatcattaacataaaaaatgaattataaaaatattttatatttaaaataatgttttaaaatatatttaaataattatttttactttaatataaatactttttaaattatgaatcttatatgcatgattgattgcacttttgatcctcaagtattataagataaggatgtcaatcgaatttttaagaattgtaattttctaattaaaactttttttataataaaaaccgcacatttctcgcataattgtgatgtatacatgggaatcaattaataaaattaaaatataaggaattaaaatttcatatttaaaatacagaagagcctaattgacataattcaaatttaggtattaaaacaaacatactttcatttatattatatcactttttatttaaaatatttatatcatttaatatacatatttaatatacatttttttttcattcgtacttttattttcactcatcaaacaatttaaaaaatcaattcactttctattttttcttcttctttctttttactttcttctccaaaccaaacatactattagttggtgttatttagtaatgaaagacaaaattcttttacacatcaagattagaaattaaagtatgttttatcacatttaattaataattttcatatataaaaggattaaatatgtttttggtatcgaataatatttaaattttacatttaatctataatattttttttcttgacttctgatccctgaaaaaattatattttatctctttcatcacattgactttgttaacttaatacatcaccatttgattaaaaaaacaccagtggttgtgataaaaaaattaaaagatcaaagaaaaattcaaaaatatttcagaaatcatgtatattctctctagtacgcatgaaaactttttagatggttcaagtattctctttacctcgtgtgtcgcagatattaaaaaaaaaaaaaaaattcttttagtcgttgtattctaattttgagatggtattaaacctccttttaaggagtactattgtgcaactcaatgaatcgccttgaattagtggctaaattaaacctgaatccaattacagatcatttaagcaaaccattgatatgtgctataataagaaacatggttatctcacaacccatcaggaaaagttgttcaatggataattgtacaacccttagagaatacatctcagatggtgactagagtcaaagagggtatggagagcacaagtttcttcttgattccagagtggcataaggctttgttggtattgctactagactctcgtcacacagtacaaatccaataacttactcagacgtcaagtattgtgtgtaacttgtttgggtcttctgagccaatttaatgggtactcaacactgggattatttagtatttaccatcatatatatgtgcatgtcattccctacataagtttcaatgtcatagaaaaataaagcctgtctaagttaagttgtaagatggtgtgaaaccaacaaattttaattcttactaacatgtcaatagcatgttaaattttttaataaattcttttcaattaattttagaattttgtgattggatcgccagagactaacaccgtaatcttcttccattaaataatattggcgtgggaacctctatccatgaattctctttcactcccatgccacacactctctctttgaattttgtttttcccaaatcattatctctaaaatgactaaatcccctatgtaatggtttgcatccatatggctaattttcctagtcttgtcttgcatcaaaatggtagtatacttgctttgtcctcagacagtggaaatgaagcacttgaataaatcaagtaatcgtacgtttttattccaattctgtctcatttctttgcttgatcactttttcatgtgcatcctttatttgtatgtctaccgcattggtgaaatggtagtgggggtactactgattaactatttataagttataaccatgggcatggcatagagtacttttggtctctcctttttttgcttcttacctgtgtttaggagcatgccatgattgtctttcaattattatgtgttaaataatattgctcttatcctttttgaacaattatactttttatgtaacgagtattttagaaggaatttcatcttcgttcttgaaatcatatgtatgtcagtggaatgcaatttaaactcggcattgtgctgcttcttttttttcatttaatagagatcttgtgcgcacgtttagaagaccttttctttttggtagttctaggagacctttatttcagagtgaataatcacttattttgaaaaagttatctcacaaaattgaaataaaacaagagattatttttctcaaaataagttgaactaatagatacataagtattcacctaattgaattataaattaataatgggatagagatatcaagtttatgcttgtccatgcgataccacaagtttgtgacagatgttaacgaagtgagttccattacattgattaagatagatatgctaataaaggtttttataatgcagcagatatattaatgtgctgttgtgagagaaaagaagaaaatgagcgcagtactgtgtgaatgtgtgcgactgtgcgagatgtggaatgcaatctaatagtctattagaatcaaaaaagcaattaaagaaacagaaaccagttgaagtggttgggtagttattgcttcttttttttttaacaaagatttaacagtattagttttaaggatttaataacaaaattttagaattataaattatagagatttaaataaaattataatttaacccaagaaaattttcttaacaattaagaaaaaaatacatataaagataacaaaaaattgatttaatttaaaataatcaagaaatatttttttttagttacgtcatcttcatgttgatgcttacaaatgttgcttgattaagttaagcaacgttacttgctagacaaaatttattattgtaatatttcttatacaagtactgttccttatataagtaagtttttttctcaccaaaaaaatataagcaagttttttttctttcaaggaaagatatgtccttaaaatttgttaatgttttttttgttttaaaagagagaaattaatacatgttaagatagataaaattaagttaagtatttactttaaaaattttagtattatagtaaatttttgtgtaaattacttaaatttatatgatgtcataggattcataaaagataagtaaactcatttaagtaattatgtactgtggatgttactagtagttaaaccaattttaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaataaatttacctatgtaactaataaaaattattaccaatacttgaaaataacatttgcataactataggcaacagagtatcaaaaatcgtagatgacatattacaaaattttataaaaaaaaacattacaaaccatttatagtcaattaattatgcattatcaatgtaataaattcataatttaattaactaaaaaatgtttgatatatatgatattgcatattatcattatttaaaagatataaaagattggatttcatataaggatataaaacaaaaataaatataaatacaatatacaatattttacaattggatttggtttaatttccacaatagaaactggaaaacaaactataccaaacaaatgttttgtcatttaaaattttgagaataaactttttaacatctttaataatcataataatacatatttttaatttctatatgttgttaaatttgcttttagttttctaaaaaaaagttattggttttagtctataaatttaaaattttgaaaaatattatttattgtcatatattaataatataatactaccactatgtcacatcaaaattatcactaatatatgacacattaccactatgtgataacaatcaccatttaaaaaatatatatgaaggaagaaataaggaaaataggattgagtaaaggatatgtctgaaaactgaaaagtggagaaataaaaaagaaaatgaaagtgatattaactaaaactgtacacaacatgtctcatagtacaagacttggctctgcctttttgagtgttaggccctcataaacgtacttgtagtatgcttgctagcgagttggcttctttttcaagttcagtggctaacccaatatggttggcatcaacccttctttaggtcatgcatgcttttttaattatatatatattttttttttgccgacagtttgaatttcttttgtcatcctcgacaaaataatagcattctgttaagtcttcaacaaatgagtattgttactagtttattctattcatcttatccttacgtatccatctaatttttagctatatattctctataagcattacctatatattttgattaatacacacacatatatatatatatatacacacacatacagcattatagctgggggtggggggtttcctaggcggttttcttggtcatatattcgtcgcgagtacgtggttacaaatttgaagcaccgttatgcattatccatataatacaaatttctattgtgtcactacaagttaattattggggttctgttgtatagtttccagcaatttctaatgtatcactacaagttaattattggggttctattgtatagtttccagcaaatcatacaatttaaaatcatactaggaccacaaaggaattttagttacatttaactattcaaaatactatgggatcacagataaatcaaatctgtaaagtgttgaatactataaatagtaaattataaccgggattcttcctagatccaacttccagaatgcagtgtgatcttttgaaaaagcaaggaagattttggctgacgaaagcgtccaaaatatattcagcatatatccaatattttctatgcaattcttgttaatgttgtgattgttgttcctttgtcatagtaaaatatcttcagcaatgtttatatcaattatttgtatactaatgttgaagaagacgcgtggctatcttcgcacccattcaatctaattgctcttgtcgttttagcataggggagggctccatttttctgcaagcatgaaatccaggatctaaaatactagaattatagtatttagaatccccgttaaccaatatgcatatcattgcgtagtgaagtgatgattggatgaaattaaagcaccaaatgaatggccaattaagagttatagcaaattctcatattatttgaatatttaaatcagatactaatgaattatattgttaaaagaataattaatatttctatttttatgaaaaaataaatattaaaaaaaacatgtaaaatgagaccaaccaatgctattacacaatgtctcaaaagaaagatcatcaacacatgcaacaccaaaagaatttctacagaagacggtttattaaatataaatatgtaaaaggtgggttgtctttgaaggagagaaaatgagagctataccctgtagcagatacttccggagacccttggaagaaaacttaagtggaagaaaacttttagatactttaacatatataatcctaggtgcatatcatagattaattatagactcatacgcccatgatcgacccaatatatatttgtgaacgttaatgggaattaataattaattaaattgtatttgtttgaaatcaccttcccctctaaatggaaagtgacccataggccgcctcaagcacctcttgaagtcttgatcataccattaaaagaaagtggtgggccttgttgaccatgaccagcaatgcaaccctgagaatagttattatcatcgttcaatttcctatacatacgtgtaatctagcaaatcaaagataaattaaaggtgcattaattctactcatgattacactttccttgatatttttgtggtgtttgttttcatgttgtttgattgagaattatgtcaagaatgcgtgtaattaaaatgacatctttagtaatatttcaggaaacacttgtcctctctacagatgcaaattctattttctttatgttgctaaaatcctgtttagtgagttccttttttagggatgtaccttaagtttcaaggattagttgagagctaagattggattaaattacttatcatttaagctgagtacaataattttttttaagtaagtctctattgatactcctaatatgttattaacaatattttcggtaatattagaggtatcttctcaatttacaatttttaggtaatatttttaagttaacttttttaggtcgatcctgagtcgaatttaattctagctttttaagcgtataatattatatatatatatatatatatatataataaagaacagtgttatatgatacaataaaattatttagaaattttatgggtggaataaaatccatattttagtacttttcaatccatgaaatattcacttagaaaatagtctctagaatgtacttgatagattttggaaataaatttttgaaccatttacccatttccaaaatcaatttgagaacgtagtttttaaaaaaataattttagaaaaatattacaaaaattacaaaaaaggaggtgtctaagtaaaaagatgaaacaaatagcaattgctctatttttttgtctttgttgtttctcctaaatggtttgaactcgatccatctcattcattttttatattcaatttttggcatttgtatcctgctccttccaatatgaatcctacacctcccagaaagtgactcattataaattgacttattatactcactatgaaactaaagatactgatatcttggaagcattccaataaactactcaatatgataagtaaatcccatttaatggtaaaaaaataatgaaacaacggtatcttaaaataacttattaaataactagtgccggaaatacttttaatttcatgcatacgtgaagcaataggcttaatttaattaccttgaggagtgctggacttctgaggatgcccttttgcttatgagttctccatgttggaaaataagtctccatgattaaggggttaaagtacagagaaaattagagtgtggatagatgaaaaaagaaaaaaaaatattatttgatatctactcatatagagagtagaaaagttaaaatataaattactcttgattaatgttattgcgtttgttcgaattttctttgctttgtcatagtctagaaggattgttatacaaatgaaaaacgaaaccggttcaaacttcaaacgttcgcgtcacggcctcttctgtattcttaactcatagtcaatgatcaatttctcttaaattaaaaaaaaaaaaatcaacaagtgaaaacttgtttattaaagttccaaacaattgaaagtcatgtgacttgtttcgctgaagaacctcaagagcttctgtaactttaagttcccattattgaaaaaattagtagtgacggcatgttattggtttgagtacaccaattttacaaagcatatacatcatactcctaacatgttgttagtttgagtaatacaagacttagattttgttaaataaaatcttgagtttaaaatttatgaaagaaaaaacaattaaaagaaaaaatttcattataagtgatcaattaaattttttagcaaaaactaattattaataaaattaataaatatttcacaccaacattaatattatatatatacacgttgtacgtgacgaaaagagaagagaggatgatgctggaaaggttatttaaatgctaaaaggatgcaatacaaaaatattcaaggaagagttatataatatgtatgattgttttgactgaatttttattttccttgttctttttctcctcttttaaaagttaatttaaaataattaaattaattttcttaaataaaaaatgattgaaatgttgatgaataaaaaaaagagcaataaaattgaaaaaaaaataataaggcatgccattttgttgccgtaacataaagaaacgtgcctgtgattttacacgggtttagtcaccaacttgtactactaccattcccaagctaagcttgagaattttttccgttaaacttgagagtttctctgaaaggaagaggtgctgatagaaactaaaccataaaaagtttgctcatactacttatatatagggatcgaaatgttaaaatggtgtaattataagaactaaaacatcgagcgttagatatgttattgccacatcaccgctacgtcaatgtcatactaccacaatgttaaaagctttagagcagatttgacgacaaaaattaaaatgtaattaaaaaatgtatatgcaaagacttaaacgtgtaatttctaaatatataaatcaaaacttaaaaataatacaaatgcaggaatcaaatgaattttcgaaattcagtccatttctcctttggaaatttaccaaggtttgaaccggaccgaccgggtgggaccttggatttgaaacggatgacatcttgtgtctggatattaatggaaaaaaaaaaaaacgacaatgcatggttgctgcattatcttctttaatcccttgattcatttcctgcataaggttggtcctttgaacattgctctcattattgtttttttgggttttcttgcagcaattgctacttactggttcactttttggccttgctaccttctcccacttgactattgaagctcttggagacacagcagtggtaacaaaataacataaaaaaaggtggataatttggagatttttaaaattataggtttaaatatcattttaatccttgtaatttagtgatttttttttattttagttgttacaaaaatctgttttttacttttagtccttacaaattatatttattttatttttcatcattatgacactttagataactttttttcattattcaaagcatagttatcaatcgtggatagcaaagcagagcaaccactctcaaaattggaatagcggatagcgggatgattgttattttaatatttttatatatattaaaaagtttataatataaatatataagctgaagaaaggaaaaaagatgaaaggagtaagttgagaatttatagaaaatgggaggtgaaaaaatcaagtcccattgtggagatatgctagagcccaatgtttcaatataagtccaaaatttctcacagaccacacttgctccacattataaaaaattgtcatatttgctcccaaaatttctcacagaccaaccacttacttcaaccttttcgccccttttcacacttctctctctcacttgcatcagtgcatcagcatcacacacaaacaaacactcccaatctctctctctatccgactctaatctcgtgatgctccgttgcgcaaccaccgcctctccatcgacgtgtcggtgactcccatggcggattcagccttcgcaaaggtgtggaagaaagtgagcccagacatcgacccgccgaagacgccactagcgtacatgaagcccagaccacccactccctcagctctcccatccaagttcacagtcaacttcgtcttacctgtgactggtgagcgcgaacaacgggccgacgatgatgagaacggcggtcaaagcgaacagtgaatcgtggacgcatcactgcgatcgcgcgcgcgacgccaccatcctatcacgggcacaacagccgcagccgttaaacgcaccgctactctactccttatagtggcacatgtccgctccgctgcaatcgcgaccacgaggcccgctattaataactatggttcaaagctctaaagtattttaaggactaaaaacaaaataaacataatttgtaaaaaataaaaaaattacaaggaagaaaaataaaaataaaaacattaaattgcaaggacaaaaatgtattcaaaccaaaattataaaattaaaaggaggtacaggaagaaatatgtgggctgcaagaagtaacggcccggcaaagtttatcacaatgattttgtttggacttagacctattggacctcctcccattatcgggtcattaagtagagggatagctaatttataagtaatcttggggttaaatccaattctaagagaagcgaacaagccaataacaaaagctattatcaaaatctcttataagctattatcgaaatctcttataagtagaggtataaaacctgcaaagcattacaaactaatttatttgcctttgttctccacaatcctgccttctttctatagtttcttggctataaagtctaaacatatactgaacacaagttgtgtccacccaaaaacaccacccaaagatttgtgcacacacacacacacacaacttgtccccccaaaaacaccagtaactagttggtcaccacccacacactcactgaaccatctttcattattgttgttatgtatcccttccctttaattaaagagattaaagacatcggcaaagagttacaccatccccgatcgaaagaattgttgattcaatgcgagtatcattcgctatataggtgttgaattcgagtgtaggcttcctattttgccaaaatctatcttccattttatcgttgttctcagacatagccaccgtaccaagccataaggtgttgtcgtatgcaattattccacctttcttcaccaattttaacagcagctcgtgatactttataaaatttttcttgtcagcgtccacaaacacgtaatcaaatgtatcttcatgtttgccctgcaatttatcgcagtttatttttatttttcattctttaaatatcaattcaaagacaatagataaaggatgttgaataaaatacaaaactcactttgtttagaactactttatatatagagagagacacacgcgcatacacaaactcatttttataaatgtaggggacaaaatcaagataataaataaaacataagcttaataaaaatgtaaagaataaatgatgtaattgatatatatatatatatatatatatataaattgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgtatttgtaatatagaaatgtctttttctaaaattagctgtatgaaatatgggcaccggatataccgctgaaacttactgtactgtataatggctgatgtttataatatgaaatagaaaaatgctaggtgaagacatttgggacgggatacactgatgtaatttcgaactaaatttgctacagcaacatctattttattctcgttaatgatgtgattgtttgtgtgtgatcatggagcggaatgctggccagcacataggcaacatgagcataaaatagaggtagcagaaatnnnnnnnnnnaaaggatgttgaataaaatacaaaactcactttgtttagaactactttatatatagagagagagacacacgcgcatacacacactcatttttataaatgtaggggacaaattcaagataataaataaaacttaagcttaataaaaatgtaaagaataaatgatgtaattgatatatataaattgtcaaagaaaaataaataaaatatgtatcataagttatttttaatttttatttaaatattttttacaaatttcctattaattactagtttacataaattaatatcatatcaaactttcattatctttcgattaatcattaaatgaaatttaaaatgagacacttaatttaaacaattaaacaaatgtaaagattggatataattttttaaaataaaagagactaaattacaaataagtcaaaatatgaaatctaaaaatgttatcaagccaaaaaaaaaaaaaacacttacatttataagatcatggagggcagatagtgcatccgcttggataaagtcaattttgtgctccactcctgccttctgaatgaagggcaatccaatcccgtaagcttctctatcgacatcaatcgctattatctgcaacattcgcaaaatccttttcacactttattcattattttatatttcatatgtacatatttgtgtaagtttagaaaacatccataagaataaatgaaagcatgataacaaatacagtatatgaaaaaattgttgattcgtgtgctagccgtggctgagattacataggaaaaaaaaaggaaaatgtttgatcgacactcaaatgttgaaaaagttaagagaaagaagtgaagatgtaatagataagatgatgtgataagagagaaagtaagagaaaataaaggttgtcaatgaagtagttacactgttgtgatatccaaaaacaaaaattactataaaaaaatgttaatgtgataccttgccatcagaaggaagagcgagagctgtagaaagaagagaataacccgtgaaaactccaatttctaatgttttctttgcgttcatgatttttagaagaatagataggaattgggcctcatccacgggtacattcatcatgctcctgccagtgccaccatacatacatacatatcactatttttttggtattaagggggccaatggcccaaaaacaagaaagacttagggtctgtttagataagattctttagaaatacttttaaaagaagaaaataagaaggaaaaaataagatgagttttttcaaaagcaaaaataaacttttcattatctaatttttagaagctcaccgatataacttcctaaaagatgagatgacatctacaaaatgagttaatggaaaactcattttaacttatggagaagttcatttcattattttcttcttactttcttcctctaaaagtgcttctagagaaacttacatccaaacaggcccttaataagacattgcacaaggtgctgaactagttgttttacacatgttaggtgtgtgtctaatagaagacttgctcccatctgtgttgcatttcactcacccaattggagggggtaccatctaaattcaatgaggctgggtggtatatgcagcatttgatttagcgatcctttcagcattcaattgcatttgaatttgattatacacaatagaattccttatgtgccaaatctcatatatatacagcagctacaaacagacttggccaagaaaaaatggtgtcatgcaagggaggatttaaagggcctttactgttttaaatcaggaggagggacatcgagggatttccaaagttgaacaagagcaacacaatttcaaaagatgtgggagagagattcacaaagtctattacatataataggacagatagtgtgatagaggtagatggggtcagatgtattctaggaggtgtaaatagtaatgaagctgtttagttaatagaataaggagttagttacagttaactaactcaggaaatgtataaatagaagtgaggataaggaagagggatcacaagagagtgctaggaggttgtgatatcccttgaaagaatcacattgtaagctgcaggagtttactccaattctaatagaaagttcattctaattcctattcgatttcctctgatccagttcctattaactggtatcagagctccaatcttggggctttgtgccgtagatgagaacgaagaagatggaggctagaattgaggcattggagcgcgctatggaggagtcacacgagaatagccatctgaaccaagtcgcgatcgagagttgattgggtttgatggagaatctgcttcagcgattggcggcgacgctggacaattcagatagggaggatacaattcgcgtgaaggagagaaaaggaagaagcaaggaaagaaacgaagaagtagcacgaaattggaggcaaatggagttgcccttgtttgcgggtgatgacccagtgggggtgggtcgcgaggatcaaaaggtatttctggttacaggaggtgagagaggaagagaaattagaagcggttttggtggctctggaaggagaagctctgtcgtggtttcaatggtgggaagaatggagcaagaaccggtcttgggagggattcaaggtggaggtggtgcagaggttccaaggagcaggaatcacaatcattttcaggctttgctagctctgaaacagggggatagtgtacaggagtacattgggtagttccaaaaacaggttggagctggaagagggttggatgagaaatttctaaaggaaattttcttgaaaggtttaaaggaggaaatagggagagaggtgatgatacatgagcccaaatccttgttggacaccatgattaaagcccgatagattgaggagaagaacagggtcttgggcaatttaccaagaagtgggaaattgaacaattattttcaaagacccaatttctttggtccaagaactaggagagtggcagccaggaggagttaaaggaggggaacaaacaggggtggtgaaagctggaggagaagggtggaataggaggaagcctatgcaaaggctgtctcctatggaggtgagtgaaaaaatgagaaaaggggaatgcttcacttgcaatgaaaaataccatccaaatcatgtatgtaaaaataagcagttaaggatcatgattatggaggaggatgaggaaggcaatgatgaggaggaatttgaaaaagaagaaactgataagaaggaagagttgtaccagctttcactatacagtattcagggatttatcaataaaaaatctcttaagttgtggggagaagtaaagggaaggaaggtggtggtgttgattgattgtggtgccactcacaattttatatcattggcattggttaaagaattgcagctagaagtgactcctacacagccctattttatggaagttggtgatggacataaggtgaggtgtaaggggatgtgtaaggatttatccatagaattacaagggttaaaattggttcaaaattgctatctttttgaactagggggagctgagttggtgttaggggtggaatggttggctggattgggggaagttaaggccaatttcgaaaagatgacaataattgtgaaggttcaggacaaagagatggagctaaaagctgaaccagagttgattaagtctgctgttagtttgaagttgattaatgggagcttggaggaagaggatcagaggtttttggtggatgttaaagaagcagaaaaagtagaaaaaagagcagcagtacctgaagaaattcagcagatattgcagcagtttgaaggggtttttactgagccaacagaattgcctcctcatagggacagagatcatgctatcacactgcagcctggtaacaaaatccctaattgtaggccttataaatatccaaactatcaaaaagatgaaattgaaagattagtggagaaatgttgaaagctggaattattagggctagcactagtccttttgccagccctgtaattttggtaaagaaaaaagataatagttggagattttgtgtggattataggctattaaacaaaattattgttcctgataggtttcctattcctattattgaagaattattagatgaaattggaggtgcacaatggttttctaagctagacctaagagctggataccatcaaattagaataaaggatgaggatgttcataagacagcttttagaacacatgaagggcattatgaatttttagttatgccttttgggttgactaatgctccctcaacatttcaagtattaatgaatgaagtgctcaggccatttttgaggcagtttgtactagttttctttgatgatattctagtttacagcaaggacacggatgaacacaaactgcaccttcaggcagtgttacagatactgcaacaacaagagttgcatgtgaatgagaagaaatgcaattgggcccaagaatcattggaatatttgggtcatttgatttcagggaagggagtgcaggcagatcctaataaattagcagctatgagcaaatggcctatacctaaggacattaagagtttgagaggattcttaggtttaacaggatattatagaagatttgtgaaggattatgggaaatgggcacaaccattgaatgctttgttgaaaaaagatgcatttaaatggactaaggaggctgagaaatcatttgagaagttgaaagaagtgatgagtgaattacctatgctaatggtccctgatttctctaaaccttttgtgctggaaactgatgcatcaggagtgggcttaggggctgtgttgttacaggagggcaggcctttggctttttggagtatggctttatcaggaaggggacagcttaaatcagtttatgaaagggaactgatggcagtggtattagctgtgaaaagatggagacattacttgttgggagggaagtttatcataaagattgatcaacaaagcttaaagtttctaaatgaccaaaaattgttgactgaggaacaatttaaatgggctgcaaagctgattggatacaatttcgagattcaatataggcctggaaaagaaaacattgtggctgatgctttgtcaagacaatttcatttttctgctatctctttggtacaagaggaggagtgggcagattgggaagaagaattaaaggcaaattagcagttgtatgagtggagaaacctgggtatgaagtgaaaggagggagattgtattacaagggcagattggtgttaccaaagaattctgctagaattcctctaattttgaaagaattgcataattctcatataggagggcattcaggattttttagaacacataaaagggtgactgatgtggttttttggcaaggaatgaagaaagctattaaggagtatgtagctgaatgtgatgtatgccaaaagaataagagtagtaccttgtctccagctggtttacttcaaccattacctattccaaccaaggtatggtctgatatatccatggattttattggtggattaccaaaggcacaaggaaaagatactattctagtaatagtagataggctgactaaatatgcacactttctggctttgtgtcatccatacacagctaaagaagtagctgagatgtttgttcaaggagttgttaggctgcatggctttcctacctctatagtttctgatagagataggctgttcatgagtttattttggaaggaactatttaagaaggctggaactgagctgaaaatgagttctgcttaccatccacaaacagatgggcagacagaggtagtaaataggtgcttggaggtctacttgagatgcatgacaggcagtaaaccaaagtagtggccagctcatttagtttgggcagagttttggttcaacactaactataatatttctgccaagatgtctccttttgaagcactttatggacagaaacctcctttattgataaaaggagctaatattccttccaagttggaggaagtcaatcaactgtgcaaggacagagatgagcttttgcaggaattgagagaaaatctgttgagatcacaagatcaaatgaggaagcatgctaacaagcatagaagggagttaagttttgagattggagattggatttttctaagaatacaaccctatagaatgaagtcattggccagaaagccaaatgaaaaattgagtcctagattctatggaccttataaagtcatccagaagataggtgcagtggcttacaaattggaacttcctgctgagagtaaaattcaccctgtttttcatgtatcattgcttaagaaatcagttaaagcaaactgttcaccacaaccattgccagcagtaatgaatgcgcagtgggaacttcaaatgaaaccagaaagggttatgcagcaaaggcaaaatgaaaaggagcagcaagaagtattgatcaaatggcaaggtctacctcaccatgagaacagctgggagttggctgaagaaatgaaggtgtttccagaattggaccttgaggacaaggtccagcttcaaggggagggtattgatagaggtagatggggtcagatgtattctaggaggtgtaaatagtaatgaagatgtttagttaatagaataaggagttagttacagtcaactaactcaggaaatgtataaatagaagtgaggataaggaagagggatcacgagagagtgctaggaggttgtgatatccctcgaaagaatcacattgtaagctgcaggagtttactccaattctaatagaaagttcattctaattcctattcgatttcctctgatccagttcctatgatagtgattgttataatgtcccttttaacaagggccaatttagcaacacaatctgtataactggtttggggatagagaaagcggtcaaatgataggctgtgttgttggttgaaaacaccatcaggggtaaggttccagatgaatttgtcatccccaagattaggtcttggaggtacagaagctataatatccaaacaatctaaaatgggaagcaagtgagaaaatttagataaattccataggccaccctcatcaacatactataataatcttggatgacacctatccacctaaattgacactcatttaatttgcaattgcccatctaccacctttcataatccactcccaagtactttgaatcgccctccaaacctttgagcaattttgtttctttttcattagtggtctgaaacctgatgtttggcgaagttccaattccaaggccttagcatgactgacattcttagaaacaaataatctggtttttgttatagaggccttctggccagaggcttaagacatcaaggcacttcatgatagtatccatatgatatattaatagaggcttcccccaaaagaaggaggccatccgcaaagctaaatcactatgtatgatgtaccgttccttgaccaaatgtgttacttagagcatctttagtggtaaatcttaaattgggatcttagactacttgttagtggatcctatagtatcacataggattaaagatctctcaagatctctctaattttttcctttaacggtagatctcattttgagatcttagggagagagaaagaaagagaaaatttattcttttttgaacaatgtgcagatctttaggaatcttgtacaagaactcattctccatgttagagatctctccacttcctttattgggagatctagtgaatatcagatcttgagttcaagatttttacttaagatctaacactaaagatgctcttacatgcttaattaaaaaaaatcaaaaagaagaaaaggaaaaaactgtaagattgatccagttaactaattagtaattataagttcataacagctttgaattaattttacacatgcaactagataaattgtacgtaactgtaacttacttaaccccgtatttctgctgtgttgtctctcggagttgcttcaattgctcgtgctctttgggatagccactcgtttcaaagatgtactaggtaaaaaacatgcagaaaaatacagttaatgtgtactttgtatattgtaaggaagcacaaagtatgttgattgaattaggaagatcacacgagccgtatacatcagaataaatggtttgcgagaagttagattttctgaatggagatgaagatatgcaaattcttttcatattgattttgggcaaacgatgaagctagactgataattgattaataaaaaaatattttacacaaaattgataaatggggcttgtggggttgctgatagtgccgatcacagaacaaacatgatggtcgaggtgtttcattttgcttgcagagaaagaattgatgattatagcaaattaagggttataatattatattacatgtatgagattgatttcaagtgtatatgcatacatgaagcaataggcttaatttaattaccttaaggagtgctggacttttgaggatgcccttctgtgctgatgagccctccatggttgaaatacagagcaaattgcagggtgtctttagatgaataatgaacttctcaatttagtggctgtagagtgtagagaagaatataaggaacttcttttttataaataagaatataaggaacttgagcgttgacctttgagatcagaagcaccattccctacgtggcagtcggccacacttcccgtcattctaaaatgaaaacaacaattacttgacacacttagttttagagatttttagcagtagatcataaattgatatcttacattattttttttttttggtagatttcgtagcaatattaagtagaattgaagatttttttctttttttttcagtgtaaatctcattttaagatttaatgagaaaaagaaagaaaaaatattttttttaaataatatgtatatttttagaaaaaaattacaaaatttatttttttttcttctttattagaaaatttagtgaagatcaaaactgaaattcaagatctctattcaagatctagtattaaagatgtttttaagtctaaagaggaagaaaaaacagaaataataaaattataaataagacagataatttgataatttaagaaaaaagatatcaaacaagtatttgtatttgtaatatagaaatgtctttttctaaaattagctgtatgaaatatgggcaccggatataccgctgaaacttactgtactgtataatggctgatgtttataatatgaaatagaaaaatgctaggtgaagacatttgggacgggatacactgatgtaatttcgaactaaatttgctacagcaacatctattttattctcgttaatgatgtgattgtttgtgtgtgatcatggagcggaatgctggccagcacataggcaacatgagcataaaatagaggtagcagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattgaaaattttagtgttatattagcaacattaattattttttaatgtaattgagctattactttttgctttattttcgatttatcattgggttcatctaccaccgaccccaattaatttgggttaaaggtgctgttgatgttgttgatgttgatgtttgtgtgtgatcatctcataaattttttgatggaatgacaagtcaatggattatcataaatatttgttacttgattgaagaatctaaaatcattttttatttattttacatagactaaaaaaatctttaaaagacaaacaaaaaataagatatttataaggaccagattgttatataagttaaaatcaaattacaaacaaccaacatcaaatggaaaatgtacaaaaaatgtaagcaaaaagtaaatgaattttaggattaaacttagttctttagcatgaatggagatgtacaaattataaagtgaactgtcgaacgacaaagtggaaattgaaatccctttctcacgtatctcaccccttcctcctgagagcaaaccttcgtttgcacaactagaaaaaaaccacctcatgagagcaaatcttcagttgcacaactagaaaaaaatcacttaatcccagtgtccggaggctccacgctatgcacaggtaaaggggaggctgttttcggattcgaacccatgatcaacagatcaccaagacacaactttaccgctgtgtcagggctcgccccttcctcctgagagcaaatcttcggttgcacaactagaaagtccatatttaatcgaaatgacccagaagaggaaatacaacaattgtctaggaagtggcaatgttcatgaacatcaagcccccaagtgagatgtcactaaatgcccaccaaattagaagccaatgccaaaacaaataacagattaaaacttattcaaaaatctgaatttcaaaatgttgagataagaagatggattaatgatattcctccctttcagggattgtcactgtaactgaagaatgtacaagatcaacacgaaagctccaaaaatcatctcctctgccaccaatctgggatttttaacctccggtttctatgaacagaaagtttgacccctggaagcttgtgcttgacctgtctccacagcatatcaacagcatcttctctttttggaggatattggaattcataatgatgggagatgttttttagttgcctccacatttcagtccatttctcctttggaaatttacgaagttgatcgatcatgtagccaggctgtaatgcctctttgaaagagaagaaaaccgagaactgggagtagtcgatctcatcctcaaatgggagttcaatttgatcactcacaatgacaggaatgcaatgactcacaatggcatcaaaaagccgacaagatgatggtgtgtctcctgctggatgcaaacagaactttgatgaacgcatccctttagatgactgttgtatcaagagcagtggataaaggaacactatagttaatgattttagcatgatacgaaaagattaaaaaaaattgactataattcctctcccctagcaaagatagtaactcatcttggttatattgcaaaaaaagtttcaaagtctttccaccctcaaaatgaagcatgtttttgattcaggatatcatatgaatgtttttgagacagagaaagtgagaaatctaaaactagtaatatttcaccaatgcaagatttatcagatttggtgggggggagctcgcaaacaattcattttgtctacagaaagcaaattgtatctcaacattcaagttctcagagtcagaatgcatggggaatacaatatgtagagaagtgcagcacatgggtagttcttattgtgtaagttatctgaaatatctttcgcttttttaaaggaatcctggcctttaatttacaatgaagaagaaaatagttgtaaaatcaatcttttaaatggttaaccacaaatattccagctacaggtaaagtaagcaaagatcaattacataactatactgcataccgcttttatgttctcttctgtagcaacacttcgctcatagtgaacatcatcataaccagccaatatctttgctagtttaacacggacaatccctttctgcaaacatcacagacgccacagaatcaattatcatggaatttaaagaaggaaaaagctcctctaaacttagattggctttaaagtgagcaagtatgggtatatccacctttggattttaccgagttaagatcacaatgcactttacttgctcactttaaagacaaaattactttagaagaaccttgtccaattaagaaacacattattcgtacaactaactctcagttagacatacatctttcctgtaagtcctccctcggaagaaaagcaatgtggagcgagactcgtatggatcttgaggctcatcatctgtaaaagagtccacaacatgcacatatggggacaccacatctttgttcaaattagacatgcccctaggatagcgaccaaaatccacaacaacctgaatcgattcattcaactgatctcgtaggaacctaaaggcattggggtgcgtcatgggaaatacatggtctctacctccagacctctgccagtacttggatttctttaataattccattaaatcaacctgacaccagaaacaagccctgtttaacattgacaacagagatttgtaaaacaatagctatgatgcacagatacaggtacaagtacaaacttacaacaccctgcatttctgaaaaaaaaaaaaaaatacaatgtaagcatggcaagaaactgtataacatacataaaatcccttacatatcaactcaagaaacaattcaaaacaaaaaagctaacaattgtcataacacatcataaataagtggagaaaacagcttttatgttccgcagcacaaatttcaaacatgacggaacactagctgttcgagatccctctcgggaggattcagacctacaattaagaataaagccaatgtgctagcccaacggaatcaagcacaatagctgacatataaggcctaacatcaagaatcttctggcactacaccaatcccagtatagtcgcaatgtaccaaatctgatgccaaagttcgtttcgcagactcaacggatttcacagggttgacccttggaggtatttctcacgcctcatcaagtaagaagcaccacaatagcctataggagaataatataaataaatcatataaataggcccattttccaactttacaatctctcattctcctcctgcagctacaattctcaaacactgacttagcgatggaatctatgcaggtacataagcagagttcaactcgtgcgatcctgagaagacttcattatgatatcccaaccttctagactggtgtgaagcgaacattagcattcatcaaattcttatgatttttcagcatctaatgccgtttaacaaacatcctgtatcgtaaatcttcacgtgatcttactaatcgcaatctaaggctaaacatgcaaagcctagctgtgaaaaataactctcatagcatagcatctgaatgattcacaaatcaattcggaaaaattgagaaacctagctaggagaaacgtagcgaagcacctgcaattggcgatctatctgcgtggcgggatccttcatggtgtgaccatgcgtgttgaagctgagcgacgagaagaacggcacgaagaacgcttgggcgagttccggatccgaaatcctaaccgcttctctgcccccgccgacgttgaggagcgaccccatcatccagtactccacgctgtgctgcttcttcagtccccagttcaccggccacgccggccattcctcgacggtgacgggcgtctccgccgagctccggcggtcaatcatgccgacgttgaatcggcgagggagatcgtacatgaaaacccgaagaggcgggtcgggtgcacagggagcaggtgcacccgcgggtaactttaggcgagggaagaaataagatcgaatgtcgagggtacctatgaaaattgagtaagaaaggacgagcaagagcacgaaaatgaacgagagaaccacttttccatacattgcaggttcttcttcttcttcttcttcttctaaatattttggggaataatagtgagcctgattgatgcttgtacgttatcttcttcttctgctgctgctgctgcagcttctgttacgagttgctttcttagctctgcgatcagttgcggtgtccatgaatcatctatatcagccaaatgtgaaggccaagaagatgcattgcttccagagtgagcttatgtcgttttcttttctaatttctaattttaatcatctaatgggatggaaaaaaaaaatactattattttttataaaaaaataaatagtttatatattaatggtgagaatagtttttatactattatataatcacaaattttattattaaaattaataatattgaaagtataaaatattttatgctagcaacacataattctttttttaactcagaaaaaaaaacaattttttatataatcactaattaataaataaatataagtctattttattcattaaaatataacctctttattttggaggtaataaatctgcaaacattgacaaaaatttacgattgaaagaagaactttgattttcttctcattcacttgtagttgatttttgtccgcatcccttataacaattaaaaaattgcatgtgcactttggtcggtttgatttgtgaatgcagtattctttttttaaaataatatatttttgaatgtagtattcacggatcaggatctggcagatttgaccttttaaaagaaatttgcatgtgcactttcgtggttttgaatgcagtgttcacgatctgatagacttgagttgacctttaaaaattagatctagtatgttttgatacactaacattttgagttaatgctgtaaaaaaaatcttaatttgaatgagtgttctattcgggtattcggtcatccgaataaccaaatacacaccctcaattacctgaaaaagacatacttaagtaagtcgtatatccctacacaaacaaggaattcgattattcggatacttgtatatctgcaacacaaaactgatgagaaacaagctcgtatgatactcggatgcctgtaaccaggtggcgatggttggaaaaacatacccgttgacgggagcatattgtcccaacctttttggtcttaaacagataagcgaacacccttttcgataatattttttttttgttttatctcatcacaactttatttattttctaatattttttttgcatatgtgagcatgaaatatcatgctagtaagatgtctaaagagatgaacataacaattgatgggaaggaggggctagcgaaagaaaagaagaagggaccataatacaagtcgggcctcatcgacccaccttatattatactattgaatgttataagagtaatgtttaaacctattatataacctcttgtattttgcttgtaatctctttatttgcttatttgaattcaattgacattagatctcttatctatgttcataacattatcaaattgaaaagtcaaattttatcacgtgacaaccgttagttgttacatcatcatcaaaagtatcatgtaaacacaactatttgacttaatggggaaagctaacaatgagactaatttattgcattttttgcaatctcaataataattttttttcatctttcaaagacctaattgttagaacttaacaaattaaagaatgaatatgaatatttaccttcaaataatgaaattattgaatgtcgaaagaatacctatggcatggaattggaattaaccgtggttaagataacaaaattgtgagacgtggttggaattggaataatgatagtgaattagggagtttaagaaagaggaaaaaggatgtttcagttacaatatttaaatagtgacgaggaaaaagaatctaataaaatttggaaatatgcatatgataagaagagagaaagagatgtgatcatgcaaaaaagagaagaggagattttgattatctatagttttttttttaaattacatagttatcctttactctacatgaagtttaatataaagaaaattggttattttgtcaaacataaaaggtgcatggtgctaatatatacttactaatttttaagtgagtttatgttttttttttgtttttgttttttgtgaacgagaagggcaaaacgcgttccaaacgatcaattaaaacccacacgggaaaacaaccgacattacatgggccaaaacatatgtagacataaaaggtaaaacaaaatcatgaactctcatatgagtgggtctatattagcaaatcccatatataatattatatagatatattaagattttttttatatatatttgatttgattcggtctttgtttgagcccaaaatgatatggaagcaactattaacactaccatattttctattgatagtttgacactaccaacttttgtgaatctcttttttacccattcaccaaattcctacacccttctcatcccctcataatttttatcgagccaccccacccctgtcctctagcactaccacacacctccatcttcgttcagatctagcattgtcgtgcacccctacctcgcccaaacccatgttcgccaccttcactgtgccactagtccaccaccaaacctatagctactacaccatctttgctctagctttgaaccacaacaccaccacaatccaacaacgtcacgcgatcgccttacctaggacctatgatccctgcacatgcaacctcaacatccaaggcttcacatgtgtgactcccctgcaccaccgctcacatccatagttgccactaaatagccttattgttcttgtctaagaggtagtaatatttgaccatacaaaattgtgttttcgttggtggagaaaaaaatataataaaaacatgatttcattatacactatacaaaaacatgattacatcatatattttttttcaccatcacttaattcaatggaaacaagattccgttgtacaagtgaacaatgaaatcatgtttccataaaaatgacattttttcaagatttatttttaatgcacacctaggtagtgccaatagcaaatccagtattgttaactgttgctctcaaatgacattttaaaggggtattttcaggtttgaatgaaattgaccgtgggctggaatagatgttgggccttattctccaccatagttccataacgctgaattacgaactagggttttaaactcattatattatataaactccgtcaatcttactctggagttgctgacaagccaattctttgtgttggtgctaaatccctagtaagccgccatggtatgcactccacctctagtcctttcacttgcttactccaatccgtgttttcatatcatgcttaatattattgtttgcacatctgtttctgcaggtcaagtactcaagggagcctgacaatccaaccaagtgtaggcttcattaataatcacttttttgcgtttgtagaatcgacacttattattctctaaacgacggcgtttatagtctctcccaatctcagcatttttttttttatcgtttttcatatgcagcttgcaaggctagaggcgccgaccttagggttcattttaaggtactgagtcccgttacattggttttctgtttaataattttctgaaagtcgaaaagtaaatttcatttgaatagcaatgccatcaatgtataatcaattgtcgacaactcacatcaatgatatatatatatatatataaatatatatatatatatatatacatttttttttttgcatacactttgtttcttgactgagtatggtttgtctgatcaatggaaacatggatttggatttatacttaacagatcctgatgataaaagcggggcctttttatcctgtttgagcatggccctagatagcttgttttgataaatcacaaagcctggtttatagagcttttcaaataatctaaccagagtggtggcttgggaaaaaagatctagaaactgaaggttttttttcctgaagctaatccaaatgaaccttgtcacccccttccccttaactgcattaactttacttgaggctgtccattttgctctagtttaacttgatttggattgtgtgggaaaaccttttctaaataaaaaatgaagtggaataaacctgatgaaaaaagcaggggcatgttgcctgtgtgagcaggcctctcataaccttcagggatataataaccattgttattgggtgaacctctgttctctgtttgtgactgaaaggttcagtaaatgatggaacccatggtttaaaaaactgatgaaaacttattttaacaaatgaatgaagttgaataaacctgatgaaaaaagcaggggcgtgttgcctttgtgagcttgcctctcgtaaccttcagggatataataaccattgttattgggtgaacctctgttcactatttatgactgaaaggttcagtaaatgatggaacacatagtgaaatctgatgaaaaccttttttaataaaagaatgaagttgaataatcctgatgaaaaaagcaggggcatgttgcctgtgtgagcaggcctctcgtaatcttcagggatatgataaccattgttattgggtgaactgctgttccctatttatgactgaaaggttcagtaaatgatggaacacatagtgaaatctgatgaaacttttttaataaaagaatgaagttgaataatcctgatgaaaaaagcaggggcatgttgcctgtgtgagcatgcctctcgtaaccttcagggatataataatcattgttattgggtgaacctctgttctctgtttgtgacagaaaggttcagtaaatgatggaacacaatgcttttgttgcatcatgaatttgattcattctgagcttgatttttttatttcttttgatgttttgtttttaaaaacagcagaaaattgatgctttacccaatggagggaggcagtagttaatatatctttcttttttgtgaatgatgtttcattgatgctagaacaatactattgagtttattttattctgagttatatcattttcctagacacgagacattaccttttacattgtacttacagaacactagggaaactgcctttgcaatcaggaagttgcccttggttaaagctaaaaggtacttggaagacgttcttgcgcacaagcaggccattccattcagacgtttctgtcgtggtgttggaaggacagcccaagcaaagaacagacactcaaatggccaaggacggtggcctgtcaagtcagcaaaattcatccttgatttgctaaaaaatgctgagagcaatgctgaagtatgtctatatatactcttttttttccttttccatatggctattttatgatttccaaactaactgaaaattgtttcttttcaggtgaaaggtttggatgttgatgcgctttacatttctcatatccaagtcaatcaagcacagaagcaaagacgccgaacataccgagcccatggaagaatcaatcgtatgtctaaaatgtcgagatttttgttttaatggcttgttatcattttcacggttttatttatggagactgtctttgcagcttatatgtcatctccgtgccacatagagttgatattatctgaaaaagaagaacctgtgaagaaggaggtatttgattcatctagttttgttgattctcccccatttttttcaatgattcattatctaattcctattctttttttggtttgtagcccgagactaagttagcaacaagcaagaaatcccaagctcttcgaagtggcgcttcgtcttagattactaataaattgtttgaggcccaattttctagattatgtcaagtggagagttttggttgttttatttttgttatggtttgatatgattttcatactatcttcaaattaatttgagttaattgaaaaacttagtacttggtatgttttccttcggatggattacttaacattagttttaaaagaaatactaaatattagaacataaatcgatggttaagtggtactgaattattttttttctgttttctttccataattctttcgaataccttctattcaaaaaaggtaaccgaggcgcgtcttgctggttgaaaactatttttaaaccccctcttaggcctgggttgggcccaggcttttgagaatttctgtaagggtttcctttggggttaaagccctacaattcttagtttaagctttttttttaacgtcatgtaattagcttgggttgttgaagcatttctaaaaaattctaagggtattccagtaaaagtgtaaagctaataaatgatatataatggttttgtaaacgtgatattgtttagtgtttttggtgggtggtgaggaggtggcatcgtaaacagccagcacttattagctagttatcatgtttggcgtttttggtcagttttaatgtttttctttggttgatgaacaagtgctgttgttgaaaataaagatttttctttggagtaattattaaatttttagttgttatttacataaaagagagaagtataagaagtatgaaatgaaataataatagtcagagatacaaaatgttataacacgagttggtttttttctttctattattcaattgtaattgattttaattgaaatggattatgtgtaagtttttttcgaaaacaaggaattataaaaatgtaatataacattaataggattttattcatcgtaattaatttttggatgatgcaagaaaatataccatgacataagtttgttaatgtgaatttttttaaagtcagcgttaatataaaatcacccacattgggattccttcatctgatcattgtggcttgtggataaaggtgaatgatgggacttttagacaaactcctttgctattttaagttcattggtgcttggattgatcatccagagttccaaccagtcgttcgtaatgcgtgacatattggagacacttagaatgaaaatattgaaagacttactgggtcccttaggacttggaaccatgggcggacttacatgtaatgggggtggttaaattctgaaagtaaattacgaatatattcctgattttaaattttttaatatagatattcttttattttttttctgcagcaaaatatattctttttttttgcagtaaaatgttataaatagatatattttagattttatctttaattgttatctttaattgatagttattatttttagctattatctttagttatctttatctttagttgatctctttaaatagagacctcttgtattactttaattgatagttattatctataactattatctttagttattatctttggttatctttatctttagttgatctctttaaatagagacctcttgtattaatgtgacacacaattcatattctacatattcctattttcaagtcaaaacgtgttctttctccctattttcaattcatattctatatattctacatattcctttaggataaaaagatatttaggttctttttttacaaagtcaagtggtagtagtactaaacgttctcgatgtgaatcttcttcatctattgatttagttcaagataaatcaaatgagtgttcaagaaaggaaaataatttgtatgttcctgatctgggtaaaaaacttcctattacgaaggaattccaaaaaataaggcctagaaggatgacattatagttatttttatggatatgtatttgaacttttgaacattgtaattatttttctagatatgtatttgaacttttgagtgccccccttgatttattttctggatccgtccctgcttggaactgtaactgttttggtggcaatttcaagaaaatgttgttggccagacttcagggtattcagaacaacttattctctaatagtagtccaggtttgattgctttgagacaaaaactctggaatgtttatatccaaatctctaaccaggaggaactgtattggtaccaactatcttgttcgaattggctgaagttgggtgatagaaatacccggtttttttcaccaatctttctttaacaagaggagcaaaactagaactgatgcccttaaatgacgatgatattgggtctatgatgataacgatatccagaatatggttattaaccattacatcgagctttttgcctctgaaagccatgatgttatgatgctataatcagtggcagatctagaaaagtaattaagggggatactagtagtgtccacacacatttagtagcttaaagtttatggttgcataatagtttgttttccttaatatttacacaaagaagcatcaatgcaacatattgattataaactttttcaaattcaaaacattctaatccaaatacacgttattatttgtgcttagcccacgtgccatatgatttgcatttatcnnnnnnnnnnnggggggggggggggggtgctttaaacgtaggtgtgcctctacaatcattccattccttccctccgattaaggaagaggatcttttgttgataaacagtgacttctttgtttaagaaactaagcatggtttatcatcctctatattttaagtctcaatgggagtatattgggcaatctatttttgagtatattctgaaagtcaaagaagaccctaaacttatagctttagtcaacaaaaccctccccaccttggtctctaaaggagctgatccttcatatatatcgcaatttagacccattgctctttgcaatgtgatatataaaattgccaaccgtgttaacattattctcccatacgtggtagggccccttcaaaccagcttcattaagggtagaaattcggttgataacttcattattctccaagagcttgttcattcttctcaagctgaatttgcagaatgttcacttcgaaatggattccttgactgcggttaaaaagatggctagatagcttggcctaaccatttaggaaatttcatctaggatatcttgaaccaaatacaagtgctaacttcttggctggtttggcccaagggaactactatcctacacttctggattccattcctattatgttgagggttatcatcgaggagaacactaggggcctgaccctccctagaatggttgcggtgtagtcattccttttctttcccttttatccaaaaaattaaaacaacaaattcatattatgataatttcattgtttttcatcaatcgagtacatctattttctaattacatttgaagttatttatactgcaaacttgaatctagattattgggtttgatggtggagtgttaagtggaaagaatgatttaatattttagtaaaagcaataactgaattaaatatttttaatctttatctgattaataatttgtttacaatttttttgttccttttcatgttatcattaatatttttaagtattgataagaaaggtatacttaagatttaagagtttactcacgcatcttattcatttaagttaactaaatcatcttctgataagacttaaaatctaaacctttagtcaaaataaagaaaaagtaaaagaatactgaacttttttttttaaccttaaatttattatttaaaaagcaaaataaaggggttgaaatagttttgtggtataaactcgaggaggttgaattgagtacctcactttgctacactctccggcgttcaatagacttcaccatcttcctcttctgtctaccccaaaggtatcgtttcaccaccctcactttctctttcttttgattctcctcccttagcattcacacacacacacacacacacacacacgtgccaaacccattcgctcgactacgctttctgggggttttatttcactgaacatcccgatgcttatacgactcgtcgtgtttctacaattgaactttatattcactttttatcgcaattttaccttttccccaaattttaaagcataacctagaccggggctttcacacaacacaggttacggctgccccagatctgatctagaaatttatgttattacagagataatttctcaagttcttgatgttgtgggaaattttagacaaatgcggctaatgtggccgaaattgtggtcacgtcgattcctaaaaccttgatgtcgcggttcttgattttgatttttagcattgtattatatgatctcaattaacgtgtagggttgctgatgctgtgtattttccccttaattgttgttgattagattaggatggattggctagggcaaaagctggcggagcaactgatgcagataatgctgcttgcatttgctgtgattgcatttgtaggtggatatgtcatggcttctttccaaatgatgattctcatatatgctgggggtgtggttttcaccaccttgctcactgtccccaattggccccttttcaatcgccaccctcttacgtggttggatccaagtgaggtggaaaagcatcccaagccactaccatctgccaatgtaactcaaaagaagaaacctgttaagaagtaggtttttttatttttatttttttacatttttggggataatatatctttgaagtacatgatactttgacagtaatttgaagttcttaacctctttccccttcagtcgatattacagtgtacaaccatatatttactctcttttannnnnnnnnnnnttttttttttttttttttttttttttttttttttttttttttacctattttcttgattttaggcttttgattatatgataggggaagagagttctgacccttgatggtttgtggttttagttttagtgtgcaattttgatgatcaggtgattacccaaaggacaaaacttaaatgcagttctgtagtgtttttggtgttgttttctaattagaatcagagttttacctcgataatctgtttaatgaaggtttccatcaaaggtcaacatagttctgaagctccaattatgattggagaacaacaccaaaagcacttatgaaattgcatttaagttttgtcctaagccaaaccaagtgatatcataagccattcaagatataacctatctatagattcatgaatcaattttttggtcgttaggcttttgatggttgatagaccttgttgatttgtttattcagctgatgctcttcaattttaaaggaatttacacagtttgttttatgctaacttgcacttttggtcttcctactttctcaatttcatgaatttcaatcttcattttttttttccatgaatttgatcctagctattgtgcaattatgatccttatgtaaacttaacatccaatatttaaaggaaataaattgttgaaattgagataattggtgcccaaaatgcaattaagtctgttttatattgttttctaaatccattacgaggattcttctctctaactgtgtctgacttttcttttctttgattgagctacaatattggtctgtcatggtttatggatttcaaagaaattggtttcatatctcaggccaaagggtttttgtagcttaggtaatatgtaagttgcaaatttggaagcttttatttttgttgtagtcttggatgttaatgtgctcttctcttgttttgctgtcacttctgagtttttttctttctttcctcttaagtcagggacaatgttgttaaaatcgtgagaaaaatcgtataatcgcgcaccatcttgcgattttgcaggtgattctcgtgctgaatcgtgttaaagatcggagggtgttccagatcacgatctttcgcgtgagaaaaaacccattttgatctgtctcaatctttaggggttggcttgtgggccgtatttattatgggttgggtttcacttcgaaacccatattttctgactcggcccagttcacaaagcagagaaaaagaaacaccttatttcagtcattctttgcaactctcttcatcccctagggttcacctttcaagcttttcgtcctctgttcttcgttggttgttttgcccaggatcttcccttgttcttcatctgaaactgatacctccagcgccctattcttcatctcaaacttgaggatttcagttttttctctaatcttcatctgaaactgagagcttgctgggttcttcatctccctcgtttctgccttttgttccccgattcttcttgcatttcgtttttcattctccagaagttttaattctaatagtacgtgttctcgtttgtcatttttacggtttgtgttttgctgccacaaatgcacatgttaatattttttttgtctacctaaaatcacaacatcttttatcaattgtgttctgattttgacttttgtggttttgtctatcattaaaaatttaaatgtattttttttatcaagtgctcattttagtgcgaaaaataaatatacctcttgaacattttgggcctttggctgaataattaaaattttagcttgatgctaattgagaaagtgcttctctttggttctttcttggaatcttgattctcataaaaaaaaatccattttttgtaatggatctaccttaactgcttaactcgtcaattcatttgaattgtcacattattcttccacctctagtcttgatctatctttttctatttcctttttattttaatgaaaatcccctatatgatgatgatgctgaaattggattattattagggtttttatcataacatatcttcgtgatttgcatcgtgtttataaattcgatgagtatttcaaatatttcacatagaagttctcacacttgccaaaataagcaaattcaaacatgttattcagttttgtctccaaaattgaattcatgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttactgctatttcacaatcttataaacttcaattttttttaagctagcttatagctagtaattttttttattacatttctctttaatatctttaatataacttcattttttatattagtggttaaaatctctagtacctaaaatatatttttacctaaagtatataatttatgtgaaaaactttagaaacatgtttcttttgttatttcatactttcagctatttaatagttaactttgtcgaacatttctaattaaataatttaacttatcaagtttttaattagtttatgtcaactagttttgttgaatgtaataacaatatttttcatttttaatcctacaaatataagaaattttgttttaaactcttgcaattacattcacgtaaattatagcagtttttttttttttaatccgtgtcatctctatgaggaccaaataagtgatgacaaatattataggataaaaactaaaataaaatttacaaagatgcaaaaagtcatcatttttgcagcaacgtaaaatatattgatgaagtcatttcttgaattaagtatatgtttagtaaaacaattataatcatttagcaatattaataaatatcttggcaatagctaacctaaatgtttaatacttgacacttggtgacaaaaataatttttttggatgatttaagtcatgggttctcttaaatactgtcacggtgggtttgcatggagcatcatgcactcacgcaattgacaacgttctaagaacaaacataaggcaaattaggatgatataaaggtacacgttcattttaattttcctctctcaatatatttcgttcattcattagaatgtcaagaatccttgaaagtgaccacatcaaaccttaattcaaaggatttggctgaagattagctactccggtgtgtgtgtgtatatatatattactcccttcaacagatggagaacatgtactaaatttagtgtgaagcgcaacatttgattgaaagtagtcgttttcattgtaaggatgtctttacataaaaatatatatttcattttttcttacatctttttaaattaactaaacaaagattttttttttcttcatttttttagtcaaaacaactgaaaagtattttttttctctttccttcaactttttcccatactgttcctttcctcatttttttagttatatctagattgatgagagaaaattaaataaagagacgaatattatgttctactatttaaattataaaacgaggatggaatataatatatagaatgagaactttatcaccttggaatattacggtttggttggagtcccttcttcagtccaattggaggttggcatcctcctcaatatcgttgtaaggatgagttattttgtattgaaaactatgtgatcagttttattaggagacaaaccaattgggtggctcgtcaccttgctaaagcaactcaattccatgttagccaccaaatttatgaatagattcccacttgtattgtatcatacattatcaatgaaatgacttaaatttcttttaaaaaatgagaactttattctattttagtttttccacaatatatctaaataatgaaatataatgaatttgattctattatactacaaacatagcctcatttcaaaacatggcacaaaactctccgttccagacatatctgaagcagatatgccccaagaattctagagattgagacaacaccaagaattctgcatcaacaaacgtagttgtaaatagtctgattcacgagagaatagttgatgtttattggacaccagagtgttcaacgtccggttcaccacacacatgtacatgcaacaatattatcatagtaacttcaaagttgaaccacacttttgaattatagcaaataatgatgtagcaatcaacgcatgctgcaatccaaattcaacacatcattaattggaatctcaaaatctgtggtgatctatgcatactccatcaatagaatcaactattggcctaagtttcacaaagatttcacacttcgctgactaaaagtgggaatataattctgattctttgagcgactggttttatttaatcggcgagtcgtaatagaaaaagaaccaaaatcatagattctagtgggacaacgaaacatacccagaacaggttcatttctagggaaaaaaattgtcataatctactctggttttatttaaggaaagagtaatccttgtccacttgtaattattagtatatgttcgcttacaggaaagagtcaatttttttaatttataaaaaatatcatttcaatctttaaaattatgtacacacaaaaattctttaaattattaaataaaggttattttagtctttgcatataaaatatttgcttctctaaacacatgcaccaaatgaatgtctcaatccttttctcaccaagactgaataatgaattgcactgacgacaataggcattttaacattttaaaaaatgaaaaaaaaatatttttatgacataagaaggaattgattagattaagaaaatccggtacaataaattaataactatgcccccgaagcatgcacatcacttgatttctaatcatatatatgtagaatataagtagaaaattttgactagagagataaaacttatctcaataatttttactcctcgaaattattaattaactttcagttgacagatatatcttagttaaaaaatcagggcagggatcggttatcatttgtcatcatgcaattgtgttgctttcttaattagcagtcaagatatttcattccaaggagttaattagctaaaaattccaaaaccgatccataaaaataaataactagaaaactaatgtcaactatcctgaatttttataggttctttcaatttttactttatatatgatatgatatgatattcctttcggaccaaatcgcgagaagaattggttattgcgtcacttggactttagcatttattaagccaactgtcgctcttttacagcataaatcaaggacgtttataggtttgaattaattccatgaatttagcaaatcaaccaaaacatttcagactttcagttgtgtcggtttgacttatgtgtacactttgcactaaattaaactaatgaaacttaatatcaagtatatacatagcagtgatcaagttaatgtaacattaacttttttttagttacttttattttcactattgttttttaaagatctggtacttctaatgaataacttatcctaactatttcctaaaaaaataaaactaatcctaactattggaagaaaaaaaataattctannnnnnnnnnnnnnnnnnnnnnnnnnnnnnnnnnnnnnnnnnnnnnnnnnnnnnnnnnnnnnnnnnnnnnnnnnnnnnnnctatgcttaatgtactctttttagcttaaaagttaatctaaagttaaagttaaaaataaaaaactttaaaatactgttagactcaaatacaactaaattttaattacttgatattatttaatgttataatctaaaaaatatattttaattaattaaagttctagtccaataattattttttatttttaatattaagtttcaatggagaacaccttagaaaaaacatatatatattttttaaatatgaccacaagaattaaatgacattaactagctttcttaattaatgtagttttagataaaatttaagatctggcgtctgagactaattttaagaattcagaaattataagaatttagtaaggattaaaattatgcaatatggcattatatataaattaaaatatatgataacacaaataacaatcaagctaattttttttttggtacaggtcaattttcaattattgagtgttatttggtatggaacaaatttgcacaacttttctttccactaataaaataaaaagatcacggaaattagaggaggtaaagacagaaggaaacaaaactccaatcaaaagcgttattatgtgaaaacaacgaattgatcattttcctatcaatggcattattctcattaaatttatgcaagaaaaatcgttctgtgaaaattacgaattgatcattttcctaccattagcattattcttattaattttaataaagtaaaaaaatctggctcgtacaagaccacaaatgtcaacaataagaggaaaaagtcgagaaagaagatagggcacattgcatatccaccaatggctcattacaacatgactagatcaataagtggttcttgattatcattgatggagatggaataaaaagtaatggtgcttgcttgaaaaggaaaatatttgtgctgtagatagatacaatattctattaaccaaaaataaaaaaatacaatattctgcaagataatcagtaagttattattgagacaataggctaaacaaaaaaaatttccgacttacgctagtgcatgtaaaaaaaataaaaatatttatcacttaaactaatcaatgatcatgcaccatgattttgacaagagttgttattgtatgatattattaacaaaaatcgtacacgaattattaatgtcatgacttaattataaaataatctattagtatgaaaataaaatataataaatatattttaagataaccacaaaccataattgatgtggctcaagtgactttgaatacagcaaaaattatatatgcacatttgataatatatccattaaattaaaaaaaaatgtagtttggaaatatgaaatttatttatatgcactataatatcaaacttatttacacaaacatttaataggatttatcttatcgttactttatgttaatgaataagatgtcgtgataaaataatcaaatcctattgcatgtatgtaaaagaaggttttacattaacactgcaaataaattaaattattagaatatcccttttaacattcataaaaagtttaataatctttagattattaagtgcatntatatatatatatatatatatatatatatatataaacctttttattgttatcttgttaacttttttcatcaatagaaaattcacaatagactttatgaaaagaaatataatatattgtatacttcaattttcaacaggttaaactgagttgatgagacatttttttttcaatctttaaatagatctaacatactattcaaacaaatcataattcataacctataatgagaaaaattatcttaacagaggtgcatactgtcatcatgttaagaaattccaattgcaaactcttgctgtttactttatcaacaaaacaagtcctgccgtggtgagattgtgtcagtgttatccgaatatcttgtctccaaccgttttggtacctaaataaatcctataaattccactttgcttcttacagcgccaccaacaactccaataactctatattgactacacaaactacccttctctcatttcttttttcctttcaacctcattattattcttgtaagttcctctttctttttataattcacaattcatgtttagttctcttattattccaattcctgtttttttacttgctacagatctaccaagtgctattttgaatccgatttgtttacacactcttattgtttgtctcttgctttattatatctacacatttgattcttgtttcctgtactgtatgtactctttgtcaagttaattggttgtcttaaaattgtttgtcctctcttcagaaccaaaggacaatgctaaaaacgtgtgttcgtgttttctgaaacctcagcttcgatttggattccttttttttttatttttttatttctcattgatctcagtgttctcaacagctgaggtttatttacacttgcaaatttattaagatcctgtgataaagtctcatttataaatacataagaaaataaaagctctttttattaactagtgatctcgaatttgtagtcttttaattgcagctaagagtgtcctgggtttattcaataagtggtctcaaatttgtattgaggataaacaactatgttaaggagagttttgttattcataatagtcttattatgtttggcttaaatagtattatctcctcgtgcttcgaggaggatactgttaggcataccaataaaatcaatatgaatctcttgtaatgaaaggttctttcttttggattggtggattttgatgtgttttttccttcttttttttaaaaaaaaaaaaaactcttgttagcttcatttctttataaacgcatctagtggctacttttgctccgggtttttgtgcaagaggacaattgataccttgtaggtttcaattgagtggttttaatatgacttcatctatgtctggatttaattcaataggggcaaaggtttatttatttatttaaaacatttctcacttagttcttttctgtagtttcttacttgctttgttttagatcacaatcttttgtggaatttctggaaaaactggaaggtggagttttgttagatggtagttccttgctatatttttagattatagtgcttacaaacatttagtatgctttcatgtccaagtgatatctgtaaaaggaatagtgatttgtttttgttaacccagcagattgaacatttttcaattgaagtctcgttccccaattgaataatcaatttttctaaatactgtgctacttttttccctctccagtttgattcattcagctgatatggagttaaagaaaatgaaagttacaggtggctaaggcttggcaagttctatggcctactctggtatgactttacattttttgctaatgaatattttggtaaatttttatttttaattttaataacttttttccttaatttatagatacttgggcaatgtgcgagggaaaatacaactctggaagcttaagatataatttgcggaaaggcagtaggagggattattgtaggagcataacttctgttatggaatttgaatcagattggataaagcacagaaagtcatcttcttataccgctcatgttattcgttctgcgacatctgttataccttggtcttgtagaaacccaattggtgaagggtatcatgaatttctttaattagttgtactcactactctgtaagacattttcacattgtttggttgattggtcgtgacttgccaacgaaatttctgtacatcttcgttgcacatcatatatgtgattgcgaatttgaaaaatacctggttttgtggctgaaaagaagagattcacagagccaaatatgtgttttaccaatttggccaaccatgataaaccaactcttacaaaaaacactcattgcttgaggtccgagtttctggatgatgatgatggtagtagccccatcctacctgggctgcctgatgatgtttcaaagcaatgccttgcactcgtgcctcgttcgaacttcccggccatgggtggtgtctgtaagagatggaggtgctttattcgaagcaaagaatttataaccgtgcggaagttggctgggatgcatgaggaatggctctatatcttgacagcaggtagtgaaggaaaagggagccattgggaggtcatggattgcctcggtcataatcgtcgatctcttccaccaatgcctggtccggcaaaggctggctttgggctagtggttcttaatggaaagctccttgttatggctggttattcatcaattgatggaactgcatctgtctcagcagaggtttaccaatatgattcttgccttaacaggtatgcttttcggctgtaaatttacctggatgccttaggaacttattacacttgatatgataattcctgctatataatggagttaatggaggatcatttttttcctgtatatttttgtatgggaaaaaatgatcctgctgccggttctcttgtttattatactttatccatttctgggatgtgttgattttagaaattaggactgaggtgcctgtatgtctatgcttagaagtctttctggtaaaaggttttaacttttctgacatgtgtttttttctccatctgtttcactcaaaacagtagaaagtgggaaataaagactataaagcttggatggaatggcttgacacaaattgactcttttattgtatgattttaatttcccagttatgtaaatgttaaaatggttttcaagaataaaaaaatcattgtcaacgttgttacatgaattctaaaacatgaagtatgcttgatcatacatcagcctcacttttatggtgtgctttacacctgtatttatttgcttacgctccttcttgtataaatcactgtgtaattgataaagttgcatcactttctctatgatgaccttttattattgatctagctatatattctgagttaccatgacatgtcacctttattgcaaggaaccatcttagcacagtgctattattaaactttgtaattgcaattgcagctggagcagattgtcaagcatgaatgtggctcggtatgactttgcttgtgctgaagttaatggcttggtttatgcagttggaggctgcagcacaactggtgacagcctctccagtgcagagatgtatgatccggataccgacaagtggacgccgatagagagccttcgcccgagatggggttgctttgcctgtggatttgaggggaagctctatgtcatgggtggaaggtcaagcttcacaattggaaactccaagtttgttgatgtctacaaccctgagaagcacgggtggtgtgagatgaaaaatgggtgtgtgatggtcactgctcatgcagtgctagaaaagaagttgttctgtatggagtggaagaaccagcggaagttagcaatattcaatccagaggacaattcatggaaaatggtaccggtccctttgacagggagttcaagcataggttttcggttcgggctattagatggtaagttgttgctgttctcactggaggaagagcattcttataagactttgttgtatgatccaaatgcagcaccaggatctgagtggcagacttctgatataaggccatctggtttgtgcttatgcagtgtaactattaaggcctgaaaagttggctgcttccgaatttagaaaccttgagagagctaaggattttgttgttttactaggattttgaatagtagttagtaattttgaacgtgactcgatgttaatttagtgtttttgcttgttcttgttagttttatcatgtcatgtcatgtctctgatttatggttggattatttctacaattattcatgtaaccatcgattttgaccaagcactacaaattatggtgggcgagtttctttttctttttcatcttccttattttgtgttctcttggtaatattagaaagtgctaattggtaaggttggtaggataactttgacaaataaatgtgtccattttaagtaggtggtcagagttcaattttctgactcgtatttatggaaaaagtatttgatggaaaaagttattattttttatttaacttccattcctttgcaaggaaaaaaaacaatcatgtaatatattttttttaatcaaaacgcactcacaaagtttgaaaattgtatattattcaagacttaaatgtgtatctaatctatgttagtttattttaaaaaataattatttattaattttatgaaagatttttgaaaaaaataatgggtagatgatttataatccctttgtaaatccttgttcttgaataaggagagcttaccctcattcaaaacttttatgttccaaaaaacacttatataattgatatttgtagaaaatggatgttcatctggcccgtatctatagttttttttcttctaataaataatattgacaaatctgtgtacatcatgagtattgatactgagcacttgatttaatagatgaaagttgcttgcttgatataccttggtaagaattgcacatgatttatattaagggaaatgacagagttttgaaatgtagaagaaaaatggtaatgaacagtatgaatctttcacaaaagaaaatgatcatgggaaagttataacttataatggaggactgagcagatctgtcgatatgcttttgtgatatttaagataatataaggcgggctaggtgctgttacgaaaattacttttcctaatgaagtaactttggatgatagtcacttacactgatatttaatattttgttgatctgctgtatccagtagtaaaaaatatttgattagaagaaaaaaaaaatgatatagaaaattcttgaaatgcgataaacaatgaaatccttgaggaggtgcaaattttgaattcagcaactcttaattcttgacataatgtaatccatgaggaggtgaacattatgattgcagaacactttctcctagtactaccggtaccagaaatacgagaacattctcttacactcttacttacaatgaggtcatttagtgagcaacaagaaatagcttagcagcccgagaagtattgaagtgttacactaccttgattcttgctgctctcttgagcatgtattagaatttgttgctgaaagagtagaagacttcttgggatgtattaaaaaaaatggacgtaatgaatatgaatatattttatttatattctctttcaacgatgtagtattatttaattttttgttaaaacataattatataactcaaaacaaaaaaagagagaagaaagtaataaaaaatatcaacacatgttatactaatctaacaaataaaaggtatttcaatttaatataagagacaataaaaatatacattattaaaaaggattatgacttaagttttgaatccacaattgtcgatcaaaatacatagttaacattataaaaaaattaataattaatatttgtcgataaaaaaattgacaacccacattttgtagaataatacttaaaacaagtattaacataaatgcataaaacttaacaaaatacaattattattattacatttaaatatatatatatatatatattatataaagtttaattacttatttgattcttatagttatataaattttaacttagtttttatacttaaaaaccatctcttttaatccttatgttagttttcattatgagtttaaacggtagggattaaaaggaatataaaatgatcagattaaaaaggattaaaaataatatgtgtaaggattaaaatacatgatttaaagtgtaagaattaaggtaaaattttgtataattataaaaatcaaatgagtaattaaactttaatataatactattatatgaaaaattttgtttttaagaaaaattttgagggccaattatctatgcctatataatggatatatgtctattaaaaaaaattagagggactctcttcgtcctcaaataacttaagtaaaaattatgtcagttgtatatgcataatcaactattacgtaagtaggagataataggttgatttggtggtgaaggagaaaagaaaaggagatagattgtaggtttgaatttctcactaacaaaaattaataaattatcgactaatatttgttgataaataaaaaactcttaataagtaagcaacaaatcacgtagatatacagttcttgtttgagttgggactattacatttatattctcaattcctcgcgcgaattgtttgggttagggctactaaatttatattcttaatttcctgcgtgaatattggcaagaattgattaaaattttagcatggactcatcaacacacacctttgtctaatttgattcaatggaaagataaatcagtgactctttccgtaatgcaaccaagattgattggactagtcaactttttcataagttatattttacttatggagtgttcttaattttctcggcaaatttagttaaataactttaacgaaagtcttttaattcaagacttttttggaaatttaatactttcaaatacatccagtaatcgcgaattaagctttcaagtaacaaaatagttatttagcctttatctgttcttcctatccctgttatttttggagtgaacgagtatctaaaagaaaaaaaagtaaatagtatttaagatttgaagttacgtgaaggtgacctcctgcccaaaggtgactaaacatggcaataggtactcagtaggcccataacccataaatgcaatcattttcaagcccaaataaaaccaacaatccaaatcaaattatcataatgcttgcacgccaaaatcaggaaatttcagtgcgtcaattcactcaccaaaaactctgaccagcagcagtcgttaaaacaaaataatatttttgttcgttcctcttagccgctattgccttcaattcaaccatttgcatcataggcacacactggaccgaacaaaaaccatttgatcaatttatataaattataagttaaactaaacttaacacttaccaacagaaacaacaaacacaattcagcttctcctcctaggaaacgctgctgacatggctttcgggtcttccgaggatgtctcaggagtcaaattgcttttccttctggcggtcatgtacggactcttgtcggcgctgacatactccgtcatccacatgaagttcgtgaaccctctcgggaacgacgcgccgctcgatcgattctccgaagccagaaccgtacaacacgttcgaatgttgtcgcaagagatcgacggtcgtcaagtgagccatttttttgttttttaatttcgaaatgtgaaacttgatcatggtatttgcgtttttaattgtatattgtttacagttagggatcttaactgtgtgacatgatgatgtcaatcgctttcgaacaggtggaatctgatagcgcttttttcatcgccatcggtgttatgaactgagaaatgttattcgtacaataacttttaaatattttatatagcaattttaagtagaagaaaaaatagaacatacatgacactgtaaatccaattacaaactagtatcaaatatggtaagtttactgataactaatttaaaatagttgtcagtgtaaaaacttttagtctaacagtatatactcgttaaactcttatttttatctcttttgtcacattatttgttacatctcatatttctctcttaatcacagataatatttctcttatgaatctggcatgcttttgtgaattgacttatggtgcatttattattaggaagggcgtcctggattgaaacaggcagcaaaatatattaagggtcagttggaagtaataaaggagcgagctagctccactgtcaggttgcaatactttattattattattattattatttgtcacacacttctttttctcatttgcctttttggcccacttatttatttaacacactttttagtgtatgtttattatttttttttctttctcggagtctgattttattttatttccaatattttacttgcagaattgagattgaggagacaactgtgagtggctccttcaatatgttgtttttgggccataacatagctctgggatacagaaatcacactaatattcttatgaggtaccttggctgttcaatataatcatttgtattagattcagttatgttattaggatttataaataatattcttcagcaatagattacaccctatacttaagcaattttcacatttcatacatgaacttccttgttttaagcctgtagtttgtccattgcttactttttaaggaaaatatcaccactaaagatgcaaacttaatatatgttagggcaatgtattccataattcaagtattatctgaattcaacccatagttgataggtcaccagtcaccactttgttatccaaactgaccaacaaagtgatacatttgctaggattcaactactgaattgagtataaaccagacataaaataaaggtatggatgccttgtcaaagaccaatgcatgcaactaaatgtccacaatataggaagggcattctggagtggccagaactcatgctagaattgcagcataatttcattggaaagggataaggaaagatgttccgcaatttgtaagcaaatgtttcacataccagcaagctaaatttagtaacatgaaagcaataatgtaatttcaaccttttccaatatccaattacatgtagaggacatagaggcatggatttttaactggcctacaactatcagtctaacactacactaggatgcactgtcctgttaatatttatcgatcatttgtctaagtaaggccactttgcagtcagaataactaactattcaagtttgccaattgcagaacagttcattcacaatgggcagtttattgaatcattttctttctggttgtggcttattaaacattaaagatattgctgtgttttttacttgtaccacactcagtgctatcttactctgttttttctcacaccagtttaaatttttctatggaatttatgcatattcctccagcaaattcaaagttgtattagtatcattctgtttcccttcttacatttactcccacccttcctcttattttcagttccctgctgtgatgttaatttctagcaaagaaagacataattaggaacaccatacttgaagtgtgtttagctcacatgcactacatgtgttataaattataactggcattaatcatgaaccaaagttaagggttaagtgacacagagaattgaaagggctatttgagaagggtgaaactacatgggagataaagtgtaattatccctttgtttgaattacatccctgaaagttggttaacattgaaactgttaacaagtgtttggttttttaggtgggatttcatgtgaccctttttttaactgttttgtcataatgttgaaaaaaatacctcataattataaattagaagtgttaagatgtctcacactgactaggaataaggctagaatacttcttataaggcttgggcaatcctcacccttgagttggtttttggtgtgagcagagttgtcaatagcagtgtagcggccaagggctgcaataagcactgccaaagcatcacacttcaaaatttttaaaatagcagtcatcccactatgcgctatactgctatcgtgttcttaagttcagccgctgcatgctgctatctttgacccgtaacaatggatttgagttaacatgtcctgctacattagctagtaatatgggcagaatactccttataatgcataagcaatcttctccccttgacttaggttttggggttgagttaggcctagttcatttctaataagaagtaataggatccaacaaggtaaaagagggtgagaaaaaaaggtattagataagcttgcttctataatctgagataatcctatcaatggggtcacttgctagtaacttacaataacactgtaagaatcatacagttatctaatagttttaaatataaacaatgttcagagggttaattgaaaagaaaacagagctttataaatgtaatgcaaaatttgaatgaagttcatggggtggtggtaatctggatttacccttcttgcaataaacaatgttattttgatgcaatctctctctgtctgtttactttttttaaaaaaaaaattgttgcaaatgatatttgtcctaacacgcgcacacgtcgcccagaaaagtgatatataccatttcttaactttagagtgggagtgaacataaggtgggaactaacatgacactcttaatataaattaagaaggctccttgaagaagggttttgcaaagactgataaaaaattgtgttctcattagtagataatgatatgcaatctaaaggtctttgaaatatggacatttggatataatgatttgttattgaacatattatgtcaaaagtcaagactatagtgaatcattattgtaccttgagtggctacacatattttctgtacatcatgtaaacaacaaagtttgacatatctgtcttagtttaaggaatgttgactgcatttcatttttattttactataggatatcatctgtggattccaaagagactgatgcatccgttttagtgaatgggcattttgatagtccccttggttcccctggtgctggtgactgtggttcatgtgttggtgagtagtggctacatttgatgtcgtctttgaatttaagagattattatatttgggaaatctaccttgtcaccttgagcattctaaatcttattgttcatctgatttccccacttttcagcatctatgctggaaattgcaagactaattgtcgactctggttgggctccctaccgcccggttattttcctttttaatggtgctgaggaactttttatgttggtaggatgttgtctgtggaagatgaatggttattcatgaatggattttaccatgatgaaactaatgaggtattgtttgcttttgatgcttaagggttcacatggattcatgaagctgcacaaatggcatgacactataggagcttttataaatgtggaggcatctgggactggagggcctggtaaatgtgaagcaaaatttctattattagtagtaggataataagctaatcttcaatatctcagtccatcaccttatgatgtgtgctatacaggacattttcactgaataatgttgctaaaattaacagatttagtttgccaatctggacccagttcttggccttctaatgtctatgcagaagcagcaatataccctatggctaatagtgcagcccaggttttgtttctcttttaacctccctatatctataatactctactgtgttgcttagccattgttttccccttttgtatttactaattcaaacatgaattttctaatttaacatacaggatgtttttcctgttattcctggagatacagattaccgaatattttcccaagactatgggaatattcctgggcttgacattatctttctacttggtggttatttttaccatacctcctctgatacagtagagagactattgtatgtatcctatgtgcttggtttggtacaagatatttgattgaaattgcaaatgtgtttgatgtattactctgtctcagacctggaagcatccaagcacgtggagagaatttgttcagcataatcaagacttttactaattctgctaagctacaaaacacctataaaacaaattctagtgaagttacagctagcacattcaacgatgagcgggctgtattttttgattatttctcatggtttatggtatgcactgaagttggtagattcctgcttttgctaatgatctgatactcctagcaatatgatcttcataattgggccatctttctctttgttgtcttatatataaattatggattttcagatattttatcctagatgggtagctaaaattcttcacagtattcctgtcttcttctttcttgttatgcccttcatgcatggtaggtcacattcttggtcagcagcattgtgtgattttataaaaggtaaattagtacatgcttactttcatttacttctttgtaagatgtttctaattgatctccttgttaatcactttaattttttcccataatctccataatctatattctaggagatttttttggcgagttatcctagaataatttaaatattatttgtagacactttgaataatattttgtaatttgttggacttgcaggatttttgttccatgctgttgggattatattggccgttgttgttcctgttgcattttctatgctgagattactgttttcttctcagacaatgaattggtatgttcatttaacgttaactttaggcttcttgtagttagtgacagatttttttcttgtttaactttggtttcttgtagttagtgccagaatttttctttcttaatcaaattatacagtgggagaacaaagtatgataagtgccttttttttgtggccattgaagtatctgaggtgtaataatttaaaaatcttaatgcattttctgtgatcatgtgttaacataattgatgaaacccaggtttgctcatccatactttgctttcgcgatgtttataccttgtgcacttgttggacttttaattccaagaattatctggagaaactttcctctttctcaagatatttccattgtcaagacatcgaaagaggtattgcagcacatattgaaatgggtttaacaagtctattgtgatccatgtttcatagttttttttttttttttgatgaaatgattcattaataaacatttactttattgtttgggtctcaagctttacttagcaaatcttaagttgcttttgaagagtacgagttttatatcttggttcttctagttatcaaatgaaatttattgtccgatagaaaggcttaaaacttccaacaagcagtgtctacaaaatcagcatacctactttggcttgtgctgccttcatgcgtgatctttataaatatgattgtgtggtcttgtgaatttgaacatattcttcatgagtgattccattttgttacgagtctgaacttactttttgatttgacacataattgccaggcgctatctgatgaagcaaggttctggggagcatttgggttctatgccgtattaactttggtgtgcagatttaataaatagtcatgcaccaacacacatgcacatacacatatatatacacacacagcatgatttaatgtattctctttaatacttttgtgtggctaaacaactttagtaaaagcaggcttatcttgtagctgggttgagtggaggctttgtgactttttttgtgtgtgcttccctgcttcctgcatggatatccttctgcttgtcagtcaaatactttggacaacagtcactcaggttggttgtgaattcttatgtaattgtaatcattgtatttactattttcgtacaaataattgtgtgtcttgcttcatcttcggtcgtactgccactaatgtcattgactcccttcacattatgatagatttgtcttgcgtgtttgctgtttttatatgcacgctattatttaatctattttcattttgcatctgctattcatctccataattttttttttactctccaggtcaacaatgttttacatactacctctagttccatgccttgcgtattctgtttattttggtggctttcttacccagtttctgatagagaagatgggaatgatgggttctcttccactaccatatggttagtttatatatacacactccagtaattaaatatatgcatagtagattggccagtaattaaattaacttataatagagtggtttttaaggcctgggatgataactggaccattgtgatggaatcactaagctttatgctactgcatttgaataagtacatttataagtttatttatttaaaatcaaatgaaatgtatgtatgggattatctcgcttgaggtttcctttattgtaactcatcactttgtatcatgctagcaatttcataatggtcaaaatgcttgtggctgaccataacttcttcttgcagggcactatgttcccgatgttattgtggctgcattaattggaattgtaactggttggtgcacaggccctctaatgcccatatgtgggcattggttagccaggtcatccatcttgcaatttctgctacatcttagtgtgtttgctttggcattatcatctcagttctttccttacactatgtctgcacccaagaggattgtttttcagcatactttcctaactgcaggtattgattatcagaaatggcagtatggtggcaattataattttcttgatactctctgaagtaatcaattaatctagtgtctataattgcttatataagatcctcttatttgttttcttttccattatcattgtagtaccccaaatatcacctttttccccctctttgatctaatttctaacatttttcctatggtttggcaggctcaagtcagattatggaatccacttatgatttttctgtaactgactccaattctttactattccttttcaaacattcacctagagtggcaaaggaattgaatattacttcagagttttcatttgaatccacatcattgtctaaacgcaatgattggatggtaagttgcatgctgatataactatatgaatctttttctcacaggcagtttttcatctcactcaaataaaatgggaaagagtgaaataatatttttgtccacgtttattggttgttctttaattaatgaagttcaaggttgagtcagactcttcagtagttgcaaaatttcaagttggtgatctagctggtctgtttatttgttcagtagttgccatatttgtttatattacatgtattaaccacttttagatatactgttgttatcatataaattcattagtacaaaaacaactgttttttttttatatatttaagcttgtgatttcatgaaattaactttctctttgcaggcaatttttccagtttcttttctcttctcaaatagtctcaagttccctgcaaaaagggatgatattttgaaacagtatgaattctttcccaaattgtctgttcaaaatccatctttaaatcccgaaaagggacccagaagagttcacttggagctttatttagggtgagtggatcatggtaccagcatagttaatttacagagttaaaaatgcatggtgtgatttcttgtttttaataccttggcctagtgtggaaatcttgattatactaattgtttagttgcataaaacctttttccatgttggtatcatactataacagtcaaggcgtgagaattagtgcaggggtcacaaattgtgatggtagttggactagtagtctaatttttttcaacttggttgatcttgtctccataaagtattttattatttcaatcattgtgaatttttgtctataaaaaaataactttcatctgacagtttttagctgcaatttgttttcgttggtctgaaatctgtttgacaccaaggtggtgatctgaaaaaagttgaaagaaaatgaaatcttaaaatacctaactttttactttgttttcatgtacaattattttcatttcagttccttggaagaggtttgggttgcggttctcaacatcactggtcctttatcaagttggtcatttgcagataatttgcttccaggtatgaaaattgtttcctccacttagttaggcgcaaactcaattctaagatagtattaaaatctatcccagtggttattggtggtcctatgagacctgttattgaatcattatcagatcacctacaaatatttaatcttacaaacttcatacttcagatgtctaattctcagcatgaggagggtatattggaaatcccatattgactagtatgtggccaaaatagtgtatataacttaccttataaattagcttttggggttttgttaagctgactcagatgtctaatcctcgacatgagtaggttaggttgaaaatcccatattaactagtgatgtagtcaaaatagtgtatcattgtatataacttatctcatgagttagcattttgggttgagttaagttaaactcaaaattctaaggggggtgattaaatgttttcattgcctaatgtagcctgcatttgcacaggaaccgaaacctatggtggtggtccacaatcatatatatgtcgtctcagtggacctagcgatgggaattggaccttctggttagaggtaaaatttgatgctgtattaaacttctctttactataacagcgtaattttattttgtttgataatgtcaggctaacagctctgaagcattaagagtggacctagcggttttagaccaaaagttggttgatccagtaaagagattgaagaatctttttccagactgggttgatgttgttgcatattctagttttatgtctagctatatcttctaattctttatgtaaacatttttagaagaaagagcaaacatggcatttatagatgcaaaaccaaaaccaaaatttgatactagatctggactgtcacaaatacgtctttcctgaatttggcttttttggggggaaaaaattaggagaagctatccctattacaggctgcagaatgcaaagtcatagggaatgcttatagtttatcaagaataaaataaaaataatttttttgctgaagcttaagagttaaaccaatgggttgcaaccgaaatgctcttttggtgctgaacaataattgaaaatcaatgtttcgaaattcatccattcccaattaacgacagtcaagcttcctggtacgtaagaaggcttaacttctaaattaatctcttttgtctgcgtttgttcatcttaagtttgattcgttgtgagttctgcagcatttgttgttcagtgtaacagaacctctttattagttataaacttcatcgttgaagattggtggtttggcctcattcaaaacttttacgtagccgaaaacaattgtattaatagatattttgcagaaaatggatgttcattaggcctatatctttttcattttgttttacttttaaataatattgaaatctcatgcaaatcatgagcatttatagtaaggcaaaggactcagtttttaaacaaataaatggaaagtattgatctttgacaaaagaaaatgataatgggaagttacaatggactattgagcagatatgtcgattttgtaatatttaggataagttaaggggagctaggtgcaattacgaaaattaaatttcagatgaagtttaatttgggtgatagtccggcttttacacttggacaccctatatactctttttttccgggaatatatttatggactagcttgtggtcatgggtccatttttgtagaaaatgtcggttataataataaatttagtttactatttaatattttgttgatctgtatccactagtcaatatttgattaaacaacaacgttacatgcactcttactgcgttggtattcatggacgaaaaatgagaaggaagcaaggaatgtttttcgcaaatagactctccaccaagctgtgtttatcctaaatatttccatatgcttctgccatgattaatactacaagcgttgtccaaccagtaaatggatgtgccccttttcccttacccttcgtctgttcgtactgttcccacaaaaatcccgtatgttgataattgcgcactatatttctgcagtaaagagaaaatatattatctaaaaaaacaaccaataactttaaacaggatttcaatcgaactgaatacagtcgacaatacctaattaaattgcttctcaattcttcgtagatggttttagctttctcttgatatggcccattctctacaagattcaacccaaagattagtttcaggaagaggaaggtataaaatatagtgggaatattagcagatattttgccttggccagtccatattacctttggagtaatggtggagcgctgaaagaattctgtaattcatgtttatccaaattggacctctccagtatggagggtcatgctctgtgttgtgtttcatgtacaaggaactgtgtaataagaaatattatttttggttcactataatcaacatatgctgaataatgtcgttcaattatatccattaaaaaatgcattagagcatagggtgcaccttgttttggcaagagaacgtaatccatagttggtccataagaggctgcgatttgaaatgagttcaagctgcttttccagaatccgtgatccctgaatgaaacagaaaataaacatctatgaactgaaatcattcaagcaacgaataaattcttagttcattgcataaaaagacatgttaatgagaattaatgcacatcacttacagatggaatgatcctccccatgaacgggaataaactaacataaccaatgtgaggaaccaatctcaatacaggcatatccataacattccggagaagttggcgagtagcataattttgtgctgcctcaggttctttccatttaagttgaacctatcatggttatgtaaagaaaatctcattcttggtcatgaatagggaacccatgtattggtaatcttgcaacagtatgcataaataatactaaatacaaataactatatactctaccttctctgtatgatttccaaaatcaaagtaagcaccatatgcatcatcaaaatgcatctgtatggacatcaagaacaaattaggcatacacactattattgtagcaaataactattaaaagtcaactgcatagtttgctttcaattttctttttattaaaaatcatttaaaaacaaaaggaaacttagattatcattattttctccatgtcaaacaccatatgttatccatgataaacacatagaatcttccatggaacaattgctgccaatagataggaaaaatagttggaaatttcaattgtcaagagaaaacttgaaaaaaagattccatgttaatgcagtgtgttcataatcaaaggtttttatatataaaagatgttcacattcttcaataattccataataataaacttggagaaggcctagatgagtatcccccacaaggatgagcctcattttctatgaaaagtcaagaaaaaagaaaaacccaggaatgtgtgaaagttttctaaatataaaaagttttctttcccataaaacagtaatttgttttccatgtttaaaattcaacttatctataactgtatgtgctaagaaagttttcttttctcttaattccccctttttatttctctcctctttatcttcactattttgctcctgttccagtgctgcatcaccaagcagggatgcaccaccaccacaattacaaggtgtgcaacagctctaaataaagggagatgaggagcaaaggtgcaatacctggttcagtaactcaaaatccaatagcaatttagcagtagaaccataatcctgcattatttcattcaatatgtcaattaaataaggggattaatctgctgccaacaattaccgtactagtaatttatttttcaaattataccatgccaggtttgatttccatatccaacaactcttgaatggaatgcatacagtctgctgcaagtaacatccaacatctaagatccaagtggcgttcatcttcacttgggtgtgaagctcgtggataatcatccaaaccagaggacagtgtctgaaaatgccagagataatgtttgttaggagcaagggtcatcatcagggataaggaaagctttgtcaaaattgaccaacataaacaccgcaactgtgttatgtgatcctaggatgtaatagatcaaagaacaactaactacaagtgagaattctggattcaaactcattcagtgctcatgtttatggctttctagtttctagtagcaacagagaaagccatccaatagactcattttattttcaggaaaaaaatgtgtcctattgtattctttgagtaccatcaaagatatggaacaccaacagcctacaaattatcaaatatgtaggaggcgggcgaatttcttcgtatattttattgtatttggcaagaaatctagagcaactgtgtttgcatctctatgcttaattaggattttggtctctgttgtagtagctatttatcaatgaatgtggttgccttaacattaacttcttataaaaccatgacaataatggtaaagtcaatctgctgaaatacctatatagtatatagttcagattaaaattgtagataagtgctgaaattaaaaagtatactggggatgcatattagaaccttaggatttatttcacgcattgtcctattgtcccgtccgtgccaatagtagctgcccatctgtttccctttattaaaaagtgatgataacaatgataataaaagggtcaaaacaaagcaacctatttctagtgatcaagcagacagcacgtgcaatagtatatacctgactgagttgtattgaaccaatggaaccatgcttccaatcgaacaaaggcacgttccaggaatagagagatctcacttctatccattgcagtaaactcattattcttcaagccattaattatatctacagaaacagatttttaacctaattcaaaatcaccaaattaatgtttcacatacgtctgatataaagtgatatttatagatataataatgtacttcataaaaattgtcactttccataaatttattactcagaatcatctaatgtatcatcaaatccagatcagttatgcataattcctaatttaaatgaagaatgtgcaaaaggagttacatggatatgctaccacagaagaggtaaaaaataaccaagcaggaagttgttaattatcatccctcaatgaaagggaaaacctgtcacatgcagcctggggtcctggactcaaggctcaagctatggcttgcttgaagtaaattattgtaacctatttataacaaggagaaatagaaaaggaacattagcatataccattcaatgctaaaaacagagttggaggatttccattagttggatgctgaggaacaaattcctctgggacccgactgcaagtacagaagaacctatatgtcaataggaaagctaaaaactttaaatttactgcaattatttgaacaaaatgtttagtaatacacctcagtgcttcagcccccaaaatttgttcacgcggtatccatccatcaacattcatcaaatccaaccaatgcccaatgatatccaatgaaatatgaatatcccaacgcctggttaatgtgcacaagtgcaaataaagcatatgtatacatcaagagttatttatttgttaattaatacaggtaagtcttgtgcattcaacgacaacaacaataataacaatactagtggtggtggtcatgaaggatattactaaaacaaaaaaactaaccagattataagttgatgaaaaccttcatcccataaaaatcctcttggaaagaaagatcgacttggtacagctgtgtaaagctcagcagaccaatacgacatataattgacatgttctctaagctgcaaaggaaaccaacccactgcatatctatccaagtctaaattgctgacagctaattaaaagtacaaaagttggcaatatcaagatgtaaaaaggaaaacaaaagtcactgacagcaattaattgaagagtaccaaattacactgttagggagagaaatatatgaggaaatgaggcaaacagaaaattaatacaaacctagctactgacacaggatttgttttcaagcctaaaaagatagacaaatgcttcacaacatcaaatctaattaaacttctatgatgaaccagagtgtgaccacctatcaagaagaaattttacaaaatggtggttctacacaaggcaatggttgtgcttaagaatattgccttcgctagcaaaatgattgtagtggtttcctttagagtcagattctcaattccctagcaaagggtaggattcaaaggaatggggaatgagaagcatacagtcaatgtaactcacaaatccttgaatacttatgttatgaagttacgcttctttcatttctttttttttcttccgatgtggagatcgttcttgctacagaatttcagaggattccagctggggatcacccatttcctatttctttgctttctactttttttataaagcaaaccattttcctatttcttatcccagtcaactactgatgcaggagctttttcagattcaaatttcttattggtttaagtcttctaattctaaatccattgatagttacaaggatttaaactttagactaaatatttccacttcactcaatctctggttgttcaaaaaaatattattttattccatttgaagtctaagatccactctaaggattaatatcacacacatgatcaaaatctctcctattgaatcacatgtccggcagttagatatttgtggtgtaagctttgataatattggtgaattgtgaatttgtacaaagagcttagaacattttctccaattagagggttctaggagaagggatatgaagggcaaggcaacttggcagtataaaatgttcactgttaataggtgattatggttagtgagagatgcgagaaatgcaaggttacatttttttttatattggttttacaataaaatagttttactctttttagcaacttcacagtgttcagataatatttatttcaaagtcaaaatctttattgatctgcagcatgatttgctagttaattagcttgtctaggttttcagtaagcattaattcatttatggatgcaactgaagaaatttttaatttagccagaatcctctttattggttagcaatcctctgttctcgtacttctttttctcatctctaaaatctcctctttaccaacagaaaatacaacacaagaaacaaagctttcacatttatgataatcacatgtcaagttatgcactattaaggggtggtatacacttcaataaggactataaaaaacaaaataaggtaacttacattaaggattcttgaaagagcaatctttgactggccatagaagtacccgatgccacctaataagtttccaacagcagccttaccaacagataaggcttcggaatccacctggaaatccactactatgataaagaatttatatccatcaaggataagcttctaaacaaatttactcaagcaaatgaaatttgagagatccaggacacatcaaaagacaaaacaagaagaataagggttgttttggtaaagaacttaatttaagggcttcttgaataagtatttatcatgtaagcacttgtatagtttttataatcaaagaggaaataggtttaaactattttcatataagttgtaaggttgctttcatgatattttggagaagttactgaaataagctaaaataacttatgaagataacacaagttgttttcgtaagctttccgaaacacttacactgctatatcataagataagtccaagtaagtagtaagttcttccaaacataccctaagtaattgaatttgagagaataaaataaaaaagaagacaaaggacaataaaattagtaccttcttggccaaattgaaaatcttctcaaacttctcatcaaattcttgttctttatatttcagtttattggacagtgaggtacctaacaatgagcaaaataacaaataaacaattacacactagcatgtagcatcctaatgccaattagaataaaataatctgtacaaattcggcagttctctttaaaatatataatatttaatattcaaacaagaaaacatcctaagagaaagagacaaaccaaaagccttttttttttggtcagcaaaaataatatatatatatatatatatatatatatatatatttaaagagaagaaagaaacagtacaagtagaaaaaagacaaaaaggatccaagcaaacaggacctatggcagcctaattcatgagaaaaggcatgaattaaactgccagaagtctggctagatcgaaagaaaaccctcaaaacaggagaagacttatacattaagtcctcccctgattaaaaaaaatgtcacccagattacaagaccaaacatgaaaaagaatattgaatcctttttctaaaattttaatccacatccagcaggtaaatatggcttcttccataagcaagtttataaaccccaacaatgtacatcaatatgagaagcaagtttccaaagcaatgaccaactcgacaactcctacaacaatgtaaaggactagattttttcctcctttttgatgagagcatgcatatatacatgtcagattttgtacaaacattataaagaagcagagaaaaacctgtaagcatactaacacgctcttcttccctagaagtttccaaatcagttccagagattagtacaatatctgttgtgaaaggaaatccaccaataatctgcagcacaaataaaaaaattgagaagcacatatgaagtgaaaccgtaaggaaagatgttttcaagagtagttggaaagtggttgtgtgtgtgagtgagtaagacaaagagactcaaagattaaaaatgttaaacgggtattacaaagtgtacatggtctatttacctgaaaaactaacacatttggagaatcatctaatgagtcagatagctgcagtcgagcatgcttttgtatctactaaaacatgtacataaagcaaagatatcaagggaaaaccccaaaaaaaaaaacaaaaatccataaccacattcttgcattacatgaaaattatatatcatcggataaattgaattgaactgaaataccctaacctacttgtgatgcaagattttcctctacgagatcagacaaattgtgaaagtgaggtgtgcgaaatccagcataatgcagctgcaaatcatcctgaaaattattaagcataagaaaatgaatagcaggttaccaccaggcataatattacagataatcaagagataaaaatttctacattaaggcaagagaggaatgatttaaatgggttatttatcgatgaaaggaaaaaggaggactgggaattttatcaaggtagttaaaatattaaataatggcatatacatgtttgctataaaatggggacacttattggtttatcatattcttaaactatttcaaagactgaaacaggaattgtgggtgcttctttaaggaagtgtaagtcaatcacaagcagtaaaccataaaatctataaaaaaaaaaatgtccaatggtagtacaagtaacagaatcttgaatgttcaatcattaccgttgatttcaaatgtagctgccaatctccaatatctgctcgagagccagatgcaagcaaagaatccacgtgaatgttcaagttttctctacttacatctagagcattaccagcttcatcagccaaatagaaaaagagctgggcacctctcccaaattcctcattcctcttggatctgaggttcgaccacaagaacaaagacactcaatagatgaaagtcactgaatagagctattctaagaaatgtagactcataaagggaaacaataagaaagatccacaggaaaattaagtattacttattatgttatgttataattaattcaggaaataagtcaatccaaaagctaacttaaaatttacaagggtgccatgagaatctctaacttcaacaaactggctagcatctacttagcaataaagaaaaactacaaaaaaaaattattctgtcgcaatacatatatgaaagtgatttgaagttgataacatcactcacttatccatttgcacattaattcgaaccgcccaatctccaccataaccactgccttcctcttttgattttaaaaacccagtagtcaaggtcaggccatggtcaaccagcacttgatgtccaaaatcacgtccattgtgccttgtccaaccataagtacctaggtcatcctcatgtctgcaaaaatgccgcaagtgatatttgccatccttcacaccaatccacattaatccagccatcaaagattttggagtcctgaaatagaaataccacccaaaaaaaaagtgagaatgcttgcatgctgagtcaaatatcgtcgacatccgtatcctaaacacaatctatgccaaaatttgggcacaccagtttctgtgtgatgcacaatttgcatgcataaataattcaaattactcacaactcgaaatatatacaaaccctgcaccatcaacaacagtataaggctataagccttaaccaccaaaatagtctcttacttcataattccatttcagcgcaaacaaaacaaagctgagtctgaatataccttgtggtttcatcaatcaataaacaaaaaaacacacctcaagcatacacacacacacacacacacacacacacgaattgtgcttcagaaacggtaacatacctggcgcgaattccgagatacacgtgaggacgataagttccccaatacaaactctccttgtgctcaccttcaaactgcaacagcaccaaccaagtcattcttctttcttcacgcacgctaaaatcgtcgaattctcaaaactgaaaagaaaaagaatggggaaagttgaaagttgacctgaggaaggtccattatctttggcgcgggaaatggcgtgacggcgcgaggaagcttcggttccgttacggaattggagaggtggtggatcataaaccagatgatgaagaatgcgacgaagcagataccgagcagcactttgagattggcattgttgtatatcggaatggaacttccgtatctgcttctctctctttggcgattgaacggaggcctcttatgtcgaagagaatcggcgtcggcgtcggatctcactctgcttcgaacggtacttcttccacttccggtcatttttggcggatcagagattcacgccaccgcatgcatagggatttggagttcgagtggagggagtgtttgcgtagcagaggtttcggtgttaataggggatttcgcagtgtagcagtggagttcggaaggaagaatcagaaggaaggagacgagtgacttgaccgataatgggcacgagcaaggaaattatcgtgggatgaattggactctgctaaatagactatataaatttctaatgggaaaaattttatacacccagaaaaagactcatgcaccattccaatttttttaaatagctaaagtactctcgcattatacaagtacggattcgtgaattcgtaatttctttttaagtcatacggattggcccaatccgtacgtaagttttttttttaagttaaaaaatattttttcaaataatgacacatgtaagtttcaaacatgtgaccttcaggttattaacacaatgtttcaaccaactgagctaataggtcaattatgctaaaaactaattaatattgatacatatagcattaaattttttaatgtatatttaatacacatataagtttatataataaattttgtaacaattaattttgatataataattaaagtattttttttatataaaaatcatagataaataaaaatcataagtttaataaaaatttgcaggtttaataaactataaatacagatataatttttaatttaacttgtaaatacaaatataatttttattagacctgcaaatttttattaaaattatgatttttatatgtaaaaaatactttaattattatattaaaattaattattacaaaatttattatgtaaacttatatctgtattaaatatacattaaaaaatttaatgttatatgtatcaacattaattaggttttaacataattgatctattaacttagttggttgaagcatcgtgttaataacctgaaggtcacatgttcaaaacctacatgcatcattatttgaaaaaatattttttaactaaagaaaaaacttactttggtgtataaagtttttcccatttctaatacactatatatttcttagaaatttatatattgtatttaacacacaaccacaacttgctgaagtttggactaacctggcccaaattcaaccttattttagtaaggctttttcttcttacactatagaattttcaacatacactatattgtaatagtgtataaccgaaaatacctatgtttaggtttttattttgaaattgttcaaaaccatcagcaggtgcacgcttcctctactttgacttccttcttcgtttgtgctttcttcttctctgtggtggtttgacggtggtggcattgctccggtttgtggtggtcaatgagttgcaggtggttggtgatcgtccttgggctgcgccgtcggttacccgtgagcgtcatttgatttgatagggtgattagggattgtggaatccgtggatatgatacgaattagtcattccataaaaggggtttgggggccttacggattggacaatccgtatgaggcatacggattacacaatctgtaagctttatacgaattgcctaatccgtaagtttcatatggattgcataatccgtaaactttatacggatttgtttgataaattgcttgaattgcctaagtttttcatatattattatgtttgatttgagaaattacaataaactaaattggtaaatgtgatgtgtaatattgatttgagggggttttaatttgaataattatcgtttgacatttgttttaagtttgatgttttgtttgtgttactttagtttttgcacttgcaatttgaatacttattgttcttgcaagatacctgggctatggaatatatcagttttctttctaaatacttattttagtttgatcattattgaaattatgttgaatttccactaatgataaacttagaaatggtagtttgttgaaaacctattggccattaggctatgtatttgttttgtgttattgattgttcttgcaagatacctggttgggctatattcattgttttgtgatattcattgttgttgaaagattaatgttaggcatagtgatacctgtgaggggtatacgtgtgatgtacttttatcagctaaccttgttgaaccaccatcaacaatgcgagtttcaattatgaatgattaatctcagcatagcgatacatgtgtggggtatatttttgttttgtgttattcattgtcgttgcaagaaacctgtgtgttggctataactgtgttattcattgttcttgcagaatttggctattgttttaagtttgatgttttgtttcatttgttcttttattttgatgagtatgtgtgaaaagtttgtgaactgaataagctcttggattattattggtagaggaaatggtgaaaacattaaacttgcataaaaatctggagagacctgctgctgcagaggaaggcgttgaacgccgtaggtctaatgcctatgctcgaagaagacgagcagttattcctgttgttgaggaaccagttcctcaggacgtgcaagttgaggctaacactacatatatggtagatgacataggtagtaaatctgaaggatttccaggtggtcgggaagacccttcgattttgaaagggtatagtaaccacgtcgcccttagagtgtgggccggagaggtaatttgacgccaaggtaatttaatgcacatgtaagttttattttacaacattaaattattctagtatttttgttgttgttaaaatttaattaaaataataataatacacatgaccaccccttaaaatatccaaattattaccaccggttattaattatatatgaaacaaataggtttttttttttctttttctttctaatgaagtataagcgtataacaaatataaccatatttttatatttatatatatatatatattaatcgttaattttttttatattcttaatttgttgcaaaataacaacacattgatttattttttatacaagtgaatttatttcttatgttaatgcatgtgattgtatgtttgtgaccattagataattattgaatatttgaaattgaatattacacaccaaaaacaaaatgaaatttaatattaccgtgaaatttaaaatattaattcttaatggcaccattcattcacaaatcatatctcagcatgtaaaaatttctcaagcttagcatttttggtgtagttcaagataatctgtaggttctcttgttaattcatttttcttactgttttgtatctttgaattcttttattttagaagaaaagcaataacattacttagatgacaggacgccagctaatgttgtttttctttctttctactcgcttagaacttagacgaagtctaatatgaagtttaacttcttccctcatccgtgtactcccaattttatcagtaatgataggtttgtaacaggaatatatatatatatatatagatatataaattaaataaaatcattttaaaattattattttttattttcttttttttaatctccttccctacaagccttcccgaatgctcttttatacgaatttatatgttacaaaataaaatttatagataaatttgcatgtttgataaattaaactataaattattagataaattaaactataaattaattattatatcaaaattaattgttacaaaatttattatataaaattatatgtgtattaaatatacattaaaaaatttagtgttatatatattaacgttaattatttttaaacataatgggcttataaaaaaaaacttacggattggtccaatctgtaagattacggattcgtcaatccataaaaaaaaaaaaactcatacggattgcctaatccgtaaggttcttacgaattcgtcaatccgtatgaattatgcggatccgtatgaaacaaaacatgtaaaatagcgaaggatattttggaaatttcactgttacgaaaatggtgtatcagaaaaacgaatggtgtaggaaacaacattctatttattttgataatgatgatcattagcggataagtaaaattacaaaattaaatatatttcttatgactattatatatcatgttaaaattacaaaacaaaacaattttttatctaaatattagattgcatatcatgaatcattttgtaaaataattgaattaaatttacttgaccgtatatcatgttatatatatatatatatatatatatatatatatatatatatatatatnnnnnntcataatgtaataaaaaaacatgaaaaaataaagaacaatgctttaaattaatttttttaagaaattgaagcgtagtaacaaaatggcaccaagataacaataataaaaaaatgtcacctatataagatagagcaagttacctttcttaattcatgaatcatatccataatgaattctaattaacaacatattaacactaaaaatactaatatagtattttgataatttacaactttaacatcaactagcgtcattagaaacgtaaatgtgatattttgataatttacaactttatcactagctcttgtaaatagaaaagtctttcccatttaaacttttttaacactaaaacagtaatatagtaatttgaagatttaattggcatttagttttgtaaatattgaaagacataaaataatcaaatcacacaaattgatagtgttggtttggttgagaggtttggggaggaggaggtaaaggaggcaatatggcaatgcaagtgacaagttggaatccatatgatggagagatctaaaaaaattgtgtgggagttgagtggtttaagatggtttgatgaaggactagattggaaaatggaaaaaagggataaaataatttttgttgtgatgcataagagggagagcaaaactttgccaatttatatctcatactattcctcattttattgcaaaaatttgacaaaattgacaatatgggaaggtgggaaggagagacgtggagatggaaatttagttggtgtaggaattatatttcttaggaagaggacttgcaaagaaagtttcaacaacttgtatcaagtatgggcattgataggaaacggttggatggttggaggtggaaacgaaatgtggatgagtcttattcagtaaagacaacatataatgtcattattgggaatgacaggaaccaacagacaaacaaaattgttgttctatatggaaggtaaatattcctccaaaagtgatcttttttttttttgtggagattgtttttgaacaggttgaccactttggacaacttaaaaaatgtgagggtagccgcgaaaggctctatattgtcttaccattatcacctgaggagaacttttggcaaaaacttgggtctgcaacttctgaacggaacacaatctagtgtgtgatggtctgacacatttggaatttgtgtaatgctattatttttggatgtgtagtttatgttttgtaaaaattgttggaccaaattcttttcacgagctggtcatggttgaaaaatagttcgaaaacatttcaattttcatttgcagagtggtctctgaatacggttgtctgcttatacagatcttaaacatggtgtggaggcttggaataatggaaattcaaagggtgataggaggagtggtggccaacaacttgggagaggaggaggattcaaacttgataggaggagtggtggccagcaagaagaagcgagacatcagcgaacagaagtgagccaaacaaatttagtaaaacgcaattttggacagcaaatcaaccaaaattaactcctagcagcacagagatgtgtgaaatgagaaattgaagcccaatctagaccgaacgcaaacagaagcatgaacaggaacaatcacgagccaaataatgtcgtgcacggacaagaattgatgttgaacagtaacgaacatataaaggagtccaaactagcttcaatcagcacagacaacaccaaaagaaagatccctagctcaaaagaaaccaatcgaactcgtacgaatgaacaggagcaagcgcaatgaagtttgcaatcgtaaatcagatacgcatgaacaataaagaaaattcaatcaagaacaagactgaaacaaacaggaaatctaaacagaacttgtgagattgaacatgatcagtgcaaaatttttgctgttgataccatgttaggtaaaatgaacgaaagagagagagagagagagagagagatggacagctgaatttcttttatttcgaaagaatgaaaagtagttacaaactgtacacgtgaggtatttataacctcttaccactaacttgatgaaaatacgggcttctctaaaacaaccctgacaagttggcgagcagaatgattgtgtcctatctccacttctttctatttaagttgaattgagcatggttaagtacgtgaagaatatcctcatattttcagacatgattaagaaacatgcattgctattcttgcaacggtaagcaaactaaaactgaacctaaataactagacatttccatggaattgcagaaattttaaaaatcttaaaaatgaaagaatttgagataataactacaagtatacgaaaaaaaaaaagataccttttttatatgatttccaaaatcaaagtaagcaccatgtgcatcatcaaaatgcatctgtatggtcatcaatcacaaattaggcattgacacagttatggtagtaacaaattgactctgggtcaccatgcaaacattaatctgctttcaattttcttttctcaaaaacatttaaaatagaaagaaaaatcagattattttctttatgttactacatcaattatccggactatattcaggaatcacggtgggaaacttcaattgctaaaagagaacatgtgaaaagattccgtgtacatgtagagtgtttatacttgaaggtttcatgcatgtaaatgcagcaggggtccttaaataagtcaacaattcactttaaataagtcaatagtctaacttggacacaacatcaatccacattaatcttttatagtgatcaattagtcattttctttgtaaaatccatgcccaacactttttacgagtccgtactttgtaaaatccatggtattgtaagggcccttgactagaaatctctaaacattatgttacctttgttttacatgaaataatctttttatgttttgaactctttcagctcactagtctaatcataagatatgctcccttactaattgcaacgaaattacttgtttataatgaagaacttcatgcctcttatcactaatttattatcatcatcgagtcgaaagaattttagaatcctgccttctgattaccaatgtagtacaattggaaatttcctggaatgttgcggtagcttctgaaaagtatgaaggtggaggaatgttttaaccccgaaaatgtgtaagaggatctttgatggtgatgcctaaacacacagatgaacttttggaatgataactttttgcctccacttatttttgttgacagaacttttaatttgaaatgacccatacattatacattattattgacaatttgactcccaccaagggagttggagggttattatacattgttgcagtatgatagccttatgagaaattagatgaccatcgtgtaatatgctatgaagatcttgttggtttgattactccacagtgaataaaaggtccagtgcttgggtaacgtggtttttctaaattatgtcatattcttccgccatgattaatactacaagtgatgtccagccggtaaatggatgagacccttttcccttaccgttattctgatcgtactgttcccacaaaaatccagtttgttgataattgcgtactatatttctgcagtaagatggcaattattatttaaaaaccaaccaatatcttgaaacaagattacaaaggtaccaaacaaaatcaaacaatacctaattaaattgcttctcagttctttgtagatagctttagctctgttctgatatggtccattctctacaacattcaccacaaggtatgaatgaagtgaaatatttgcagatatttggcctaggccagttcatattacctttggagtaatggtggagcgctgaaagaattctgtgattcatgtttatccaaatttgacctctccaatatggaccctcaagctcagagttgaatttcatgtacaaggaactgtgaaaaataattattttttggttaaccataagcaacataagctgaataagaccacacaaattcaatccattaaaaatgcatttgagcataggttgtaatataccttgtcgtggcaagcgatcgtagtccatagtcagtccaaaagagactgtgatttgaaatgagttcaagctgcttttccagaatccatgatccctgaatgagacagtcataataaaattatgcatatggagttattaggttgacttaatgatttaaggaagaagggaagaggaaaagattgtgggtttaaatgttttccactaacaaaaactaattaacaactaacatttgtccgtctataaaataaaatatgcatctaattgtgaagtcagtcaagcaaggaaaaatttctcagttcttcttagcataaaaaattcatgatattgagaatacatgcattacttacagatggaatgatcttccccatgaatgggaatagactaacataaccaatgtgaggaaccaatctcaatacgggcttctctaaaacaaccctgacaagttggcgagcaggatgattgtgtcctatctccacttctttccatttaagttgaatctagcatgattaagtacgtgaagaatatctcatattttcagacatgaataagaaaccatgcatagttattcttgcaacagtaagcatactaatactgaacctaaataagtagacatttccacggaattgcagaaattttagaaatcttaaaaatgaaagaattcaagataataactacaagtatactaaaaaaaaaaagataccttttctgtatgatttccaaaatcaaagtaagcaccatgtgcatcatcaaaatgcatctgtatggtcatcgatcaatcacaaattaggcatggacacaattatggtagtaacaaattgaatctgggtcaccatgcaaacattaatctgctttcaattttcttttcttaaaaacatttaaaatataaagaaaaatcagattattttctttatgttaaactacatcaattatccggactatattcaggaatcacggtgggaaacttcaattgctaaaagagaacatgtgaaaagattccatgtacatgtagtgtgtttaaacttgaaggtttcatgcatgtaaatgcagcaggggtccttaagaagttcacgttcctcaatatgttaattaataataatgagcttgaagaaggcccaaatgaagattacactcagatgagactcattttcattatttatatttaaggaaaaagtcaggcaaagccttgcttttcaaattggaacacttgatcttccattttggataaaagctcaataaataactaaataaatagtcttctaaataaagaaataaaaaagttttcttttccagaagcgtaatttgttttccatgttatttctagttctatttattctatagatgcatacactgttctatttcctcttttttcgtcccttttatttctctctcctctttatcttcacttgttttgctcctattccagtactgtatcaccaacagcaaagaagtgcaacaaccctgaagaaagggagagagggagcaaaggtaaaatacctggttcagtaactcgacatctgatagcaatttagcagtagaaccataattctgcatcatttcatacattatgtcaattattttaggttatttaactttctgctgcctacatttaccctacttgatatctaaaatttacaatgcataattacaatactgttgaatttacttttcaaatttatactttgccttgtttagtttccttattcaacaactcttcaatgtattgcagactatcggttgcaagtaacatccaacatctaagatccacgtggcgctcatctgcacttgggtgtgaagcacgtggataatcatcaaatccagaggacagtgtctgaaaatgccagaaataatgtttgttaggagcaagtgtcttcatcaaggataatgaacaccttgtcataatcaaccagcaaaacaccgatggctgtaataagtggtgcttgaatgtaataatagctcaaacatacctgcaagtgagaattcaggtttcatgctcatttttttggaataaaaaagtcctattattgtatcctattagtaccaccaaataaattgaccaccgatgccaaaaagccaaaaagtgacaagaaatctacaacaatcgtgtttgcagctttatgcttatgtaggttttggccttctgtaatagcaatctttcaataaatctcatttgtggttgccttaccattagcttctttttgaagcatgccaatggttgttttggtcaagttaatttgctgggctatctatatagttcagattgaaattgaattcacagaaagattaaaaataaatataccaagaatgcatattagaaccttgggacttaattcatatatagttctattgtttcgtccatgccaatagtagctactcatctgtttccctgataataataaaagggaggtgggggtcagaaagaagcaatctatttccagtgctcaatcagactacacgtgcattatagagtatacctgactgagtaatattgaaccattggaaccatgcttctaatcgaacaaaggcacgctccaggaacagagagatctcagttttatccgttgcagtaaactcattattcttcaatccattaattatacctacaaaaatagaattttaaccactttggtaagaattttttttcgtggtgtggcgagcagagagatcaagaaatatacagaaaaaaagttctgtactgcttcatagctaagtaaaagagggggcaataactttcatatacttgcattggatctatgtcccatataaagcatttttccacatttcagcagcaccaagatatttcaacaagtaatacatcaccaaactaatgttaaccatatttttttacctaaagatatagttatagatataattacttcatacaaattgtcaaactgtctccataaatttattactcggaaatattgaagtatcatcaaatccagatcaattatgcgtgataccaaagatctagaacaagcgaagttacaagggtatgttatcacagtcacagaagagacaaaaaaataaccaggcaggaagctagttgctaaagtatcgtccctcaagctcaaggaaacaaaaaaattaacatacacaaccaagcctaaagtcatgctagctcgaactcattaatggcatatatgtagccttcttttttaaataaagattctcataactagaagaaaaaaaggataatagaaaggaacattaacatataccacttaatgctaaaaacagagttggaggatttccatttgttggatgctgaggaacatattcctctggaacccgactgcaagtgcagaagaatctaagtcagtaggacagctaaaaattttacatttactgcaattatttgaactaaatgtttttactacacctgagtgcttcagccccgagaatttgttcacgtggtatccatccatcagcattcatcaaatctaaccagtgtccaatgatatccaatgaaatatggatatcccaacgcctggttaatgtgaacaatataaaaaaaaacatatttacagatcatatattatttgtttgctaaataataccagtaagtcttgtgcggtcaataaaactgtacttaaactgaatttcaaacaagacaaatgataatgatgatagtagtagtggttgaggtcatgaaggatattattagcacaagaaactaaccagattataagttgatgaaaaccttcatcccataaaaatcctcttggaaaggaaggtcgacatggtacagctgtgtaaagctccgcaggccaatatggtatataatcaacatgctcactaagctgaaaagggaaacaatccactgcatatctgcccaagttctaaattgatgacagctaattgaaaggtacaaaggatagaaatagctatacacagctatgcttatgcctatgacatactcttcaataagaactataaataacaaactacactaccaaagtaacttacattagagattcttgaaacagcaatctttgactgaccatagaagtagccaatgccacctaataagtttccaacagctgccttaccaacagatatggattctgaatccacctggaaatccactactatgataaataatttgttaacttctaaatcaatttactcaactaaatgaattatgaaagattcataacacatcaaaagacgaaacaagaagtataaatcatttaatatgagatagttaaacaaacaaaaaaaacaagtcaaaggacaataaagttggtaccttctcagctaaattgaaaattttctcaaacttttcatcaaatgcttgttctttgtatttcagctgattggacagtgaggttcctaacatcgagcagaagaacaaacaaacagatacacaaggacttagcatttagcaagctaatgtcaatcaaaataaaatattctacaaattcaataaaaagttgtctcgttctccttagaacatataatgtttaatgcaaaagaatcctgagataaaccaaaagttgttaaactatacaaataaacacattgaattcagaataaattatagaaataatttggtttttaagctagatttgaatacaaacacagggttttcccctaacacggagtttcctccttcaaaacaccagaaaaagcaatccgacatcttaattgccttctacaagtctgtcacacaacctatatatcactataactgtcattaatccgaaattaatataaaaataaatgcttaacaacttcctaatacaaaattatagtagcctaattcaaaacttggcctatcaaaagccaaaagaaataaaacaaaacacataagcccctatgtcgtccttcaacatgcgaagtaggttttcagagcaatgaccaactcctacaacagagtaaaaaactaaaattttatctgcttttacgtgaaagcacataaatataaagcgtagtttgaacaaacactataaagaagtagaagaaaacctgtaagactactggcacgcttttctactgttgaactttctgaatcagttccagagataaatataacatctgttgtgaaagaaaatccaccaataatctgtagcatgaataaaagaatgagaagtgcatatgaatatgataggaaaaccatgatattatccctccaggaccagaactttttgtttcagaaggtgaatctatcaaacttgatcagccattaacaagtaatccaaatgtgggtagatttggtcagggggatgcggaaatagtacttcaagtttgaagagatgaaatggaatgggatatactattcaattaagctatattcaataggagaaatagagttaggtccaagtcctgtgggcttgcctcaactaatgagactttgtaacaaggaaaattagtgacaagttagttagtaaattttactgatataaatagaatgtagaaagaaaaaggagtcccttttaattggatatcggaaatcattattccatgaaagaattcaccaataaagatagttccattctttctctatatacttgtattgcctgatacagttccttagagaatcttagaaaagtgtaaacgctgtattacctgaaaaactaatacatttggagaatcatctgatgagtcagatagcagcaatcgagcatgcttccttatctacaaagacatgcacaaaagcagagatatcaaagcaacacccaaattaataaataacttccataaccacatgctcttgaattacatgaaaattatatcatcagataaattgaattgaaataccctaacatacttgtgatgcaagattttcctcaacaagattggacaaattgtgaaagtgaggagtgtgaaatccagaataatgcagttccaaatcatcctaaaagagaaaaaacataggaaagtgaataaccggttactaccaggcataaattacagataatcaacatagggcaagagtggaaatggtttgtatgggataattaaaggtcaaaggaaagaggaggtatgaaaagtttgatataggtagttaaaatactaaataagggtgtgttacatgtttgctttaaaatgcggagattcataagtttagcatattctttgactgtttcaaagaaggaaacatgatcgtggactcttctttaaggaattgtagtatgactgtatgattaattaaccatgaactccaaaaaatgtagtacaagtaacagaatatttaatattcaaccataacatcacttcctagcattaccattgattttaaatgtagctgccaatctccaatgtcttctcgagagccagatgccaccaaagaatccctatgaactttcaagttttttctaattaagtttagagcattaccagcttcatcagccaaatagaaaaagacctgggcaccgctcccaaattcctcattccacttggacctgaggttggaccacgagaacaaattccctcaataaataaagtcactaaataaagcaatactaagagaggcagaggactcattaatttaatcaaatttgtttatcctaagaccccgtaggaggtttttattttattatttttctttctattttgatagtttgaataggttttatgcatttatcaaaaatatgaatggttcactcgtacaggtcaaaaataagaaacttgagccggaaaattaagatcagtgtttttattttatgtgttgtcattcgtcttgccttacttcaacagacctgctaggatctactttactataaggaaaagctacaaacaaaattgtttagcctcaatacatatatgaaaataatttgaagttgataacatcacttacttatcaatttgcacattaattcgaactgcccaatcccctccatagccactgccttccacttttgattttaaaaacccagtggtgatggccatgccatggtcaatcagcacttgatgtccaaaatctcgtccattgtgcttagtccaaccataagtactaaggttatcctcatgtttgcaaacatgtcgcaagtgatatctgccgtccttcacaacaatccacattaatcctgcaatcaaagattttggagtcctgaaatacaaagaccaccaccaccacccaaccaaaaatgaaagtaagaatgcttgcttgcttgatgagtcaaatgttgttgaccactttctctatgatgcacggtttgctgatataaatcagttagatttcatactacacaacacattcattataattagttattgcataaggagaaaggctaacaacatagtcttagagtgtatgtcagaaagtacaatcctcttggattaagtgtgaaaaatatttctaacaatcaattattgttataattaattatgaaaataagttttaaaattagatatattagatgaaagtaatttgaaaatattttgttacatttgaattgtttaaaaactattttttatggtaaaattagaaaaataatataaaattatttcaactaattagttttatagttaaaatgattaattcttgaaaataaaatagaaaaacaaatgcctgtttggtttaagcaaatgatttttatttttattttctgttctatttaacttttgtttatattttatttcttttttatatgatttgtaaaaaaaagtannnnnnnnnnnnnnnnnnnnnnnnnnnnnnnnnnnnnnnnnnnnnnnnnnnnnnnnnnnnnnnnnnnnnnnnaagttctaaaattttgcacctaataatgggaaaaacatcatttttataatttttccaaacaattagattttcttaaacaaaatgttttaaaccttaaaaaagtttctacaaaattaatcatatccaaacatccactttgagtgggaaaaaataagcccaaaacatttttaaaaacaaaattatatgtttgacaaaattatcaaaataaagaaaaagttgtttttaatataaaatatttactacaaacaaaattttaaagtttataactaaaacgtatcaattatttattattaaagttttatttttctattttatctcaagcaattaattaactaaaatgtaaaattaattattacaaaatatttcaatttattttctaatttcattgttaaaaaaggaatttattaaaaaatttaaagaaataatttatttaaaatttattcctttttaataattaattataaacataactcaaataatgttttttagctattaaaaaaatcaggtctgtttcactacagtaatacagtgtaaagtaagaaaaatatttcatggatacccatgctataatacatctacatttcatgagagagaaaaatataaatattataaaatttatgatatgataaaaaaaaataaaaaatattagtagaatgtttaaaataaatgagtatttgtatataattgctgataaagaaaatactcaaaatagaatacctggtacgaattccaagatagagctgaggacgataagttccccagtacaaactctctttgtgctcaccttcaaactgcaacaacgccaaccaagtcattcttctttcttcacttcacgtacgccaaaatcattaaattatcaaaaaatggaaagaaaagaaaaacagcaatggaatacctgaggaaggtccgttatctttggcgcgggaaacggcgtcacaacgcgaggaatacgatcttctgcagctgaattggcgaggtaataatggctcaaaaacaagacgataccgaacacaactttgttattgtcattgttgaacatgtacatcagattgaagcttcggtgtttgcttctttcggaagacgatctctctccgctgtgagtggttcttcttccatttccggtcattttaagtgcagacagtgtttgtgttaactgtttagcagggtaacgtagcggaagttcggggaaggaagaaacgagggagtgaagtgaagtgaagcaactttttttggtacttcaaataaaattctcatttcgataaatacaaatatcttctacttggagtttgatgcatacgtaagaaatgcaattgaaaaagttaagcttttttcttaagagtttaattcgtaagtgtacaaccaattaaaaataattgttggtaaaactttatgataatcattatgaaaaaatgataactatatttttcttgcacaattattacataaattatgagtttttttttttaatttggataaattagaaaactatatactgtaaaagacaaatacaccattattaattaatggtgaaaatcatcaggtagttaattcaagttataacatattcaatttccctgacgtaatgtcgttggttcaaatttgtagaaaactgagataaatcgatccgtttcattttatatgattcttaagattttggcataaacattaaaaaatgtaattaatattttgaatttcataaattatattatgtcactttctaatatactatttgtgtttctaattaattacatttttctcatttattacacaataataacttttttatcttcaataataactattcttgctaagggtattccatgaaaaatatttaatgtttcattattttttaaaacaacaattagtttgtaattttttttttaatttaaacgtcatcagaaatgaaaccgaagaagctatattatagatgtttttaactcaaataaaaatttatgggtgatttagacaaactctactgattacctataaaaatatttgggataacaataacaaaaaaatataacataaagaataaaccaaagttaatgacaaaaaaaaatagggtggaatcttccttttatttttttactttttttttataaatccttttttatcaataaaaataatatcattagcttaaaatagtcatattttgacatttgccctttctgaaaggttagaaaaagaaaatatacaaacattttggcatttgcaattaaaaacgttcacaaattcaaaaagagttggccttcggtgtggtcaaagagatgcaggcaattacaattacacttcatgttacttattttacttgttaaatttgtttatccactcttacgaataaaatagagtcaccattttaagatgaaataatttttaattataatattgctttaagacatgtaattttatgttttttaagagattatatattcttcaatagagagtaagagaccataactttccttacattgggaatgattactatataagattgtttctatttatatacaaaattaagtgttcttaaatttaaatatgattaaactgaaataataccgtggcaatttatttatttatttatgtgctcgataaaaaatattactatttactattttttaccttttatatttatttaaaaaatttaattatcaagtatacaaaattaacactatacgttaaaaaacaagttgacttttatatatatatatatatatatagatagatagatatatattagaaacaataaaatcaaatgattcaatgaataatagaatgagatccacacaaaaattttcaagttttagtcagttagtttgaatcctactttacaaaatattttaagttttaatgactctctcgttaggtaagacttgttacccaactttttagtacttgccattaaatgttgttgttgtgatattgaggccttgttgtctcgtgataggagtgagtcgcacttcaaaagaaacaaatgagtgtgtggattgattgactaaatttggaacaaaagagatgtttcattttaaaatcttcgaaagttaatctcctaaattatgtctatcattgaacttgccttctgatatattgagcgaaacttatattagagtagtcttttgtttgtctttcttctatcaatctagtttttaattgtactttcgttaaaattgagatcttcaaacgaagaagtcggtagtgccaaaactcttgaaaggaatgtaaggtaaggtgacaaatataagaattatcatatacccatctcaacattcttgaaaataaaaattttaacaaggaaacaaatccaaccttcatatagaaaataaagccaccaacaagaaacaataaatgccagacccgaaagaagaagaaaaaattgaggtaatcatattaaccgtagtagttcaatgattctaaataaataataaataaaaaatttccttgaggcattctatcaagcatatgctacagtcgaagagtctacccatgattctaaaactttaaaaagaaaattgttatcataattataatttcccaaatgaacattatttcactttatatgcatgaattcaaagatccaaatccaaacaaaatctaattgagcaatttaccattggatttcaagtacgtctaaaaccagtagggaattaaagattggatcaattaaatacataaggtcaagaaaggttgagttcaatgcacaaggtaagagtgttgctttatacactatataatatttctaatacactatatatctatagtgcaaatccgaaaatgcccttctcattattttgcagaaaatccgtatgcacatcccttggcaattacggatcaactaatccgtcctatcatccttggccaattacggatcatgcgatccgtgctctcatccctgccaattacccatttcataaattaaaactagcaacatagcccctatggatccaatgatccgtatgcacatccttggcctaataaggatcaatcaatccgtgtgtgtatgctggcctattgcagatcaaatgatccggacgcgcatcattggcaattaggcaattactaggcctactgcggatcaaatgatccgtacgactgtcatttggcaattacggattcattaatccgtgcccatcatttgaccaattcggactactaaatctgtgcgcattccatggccatcatttggtcaattacggatcattcaatccgtcagcattcatggcctatttccttgcttagcacggatcaatggatccgtaagcattccttgcttagcactgattattcaatccgtgtgaaattcattacggattattaaatccgtgggatttacacggattcgttaatccgtaacatgacatgaccaaaccggatgcattgatccgtattttatacactataccaccaacgaaacataactttactcacccagctgaaaatggcatctccgacgagtcctgagctcaacccagctaccaccgaccacgacctacctcctccaacaccaacagctccaatgcacaacaaaatcgcagcaagggaccaagcaaaatggaaatcgcagcaacggagaaagtaaaatggagagcacacagtgataagaaaagcacagaataaaaacaaacaaaaagggcagttttggcattttaaaaaattatatagtgtattagaaatattatatagtgtataaagcaatactcacaaggtaaagagtgaggcttaacctgatggtacgaagacccaaagaggatgggagcatgggccttgatagtacgaagacccaaaggcccagatctctgattgtgtgttttctcttaagtacagcacaaaacccaccaaaacaaattaattatgactccacacgagagattttacttgtgtttaaaaccataaagatatttgtttttgcttgaaaaaatctagatacaataactaacagagtaactaagatatcaatgttagttaatggaattgaaagtgatattgagtgcattttttaatacgtgtttgtaaaattaattttaaattaatgtgattttataaaattgattttaagttaagttgtaaatgttaaaatcatacggattgcttgatctgtaacactcttacggattaccaaatccgaatgccctccacggattccataatccatacgctgcacaatccttcctacggattgtccaatccgtttcctacccacggatcattcaatccgtacgagtccattttttaaaaatctgtgaaaattggcataggcagcagcatgtaacagcttttcaacaatgttatggttaatttgagaaactacaatggtgtatgtggtatgaaatatggattataagctttgtttaattgtgacattaacttatgaattagtatgttatttgagaaactacaatgttgtcaaacaatcctaaacctaaatagtacttcagtttatggtaagcacaaattcataattgttttctacatagtcattaggatcgctaatcagtattttgttctgcatcaataccctaaatcattgatatagcttctgcattgctttgggtaatagacatatgagtgttttttgatgcaggtcatgcaacatgttagcaaacaggatgttagacaatgaaatataaatgaaaattaaatagccacttatgaacagcaaaatatgcctaatactgagttcaaaattcaggatttcccaattgccaaaccaacaatcagtgcttatattcaccacatttttgacatgaatgcatggattatcatttggctgatgttttaagtttgatgttttgtttcttagttatgttactgtgacgactacttacccattgtgtgcatgaatatgtgttggatttatttttgtgcaggatatggtgaaaacattgaacttgcgtaaaaatctagggaggcctgttgaagcagaggaaggcgttcaacgccgtaggcctaccgcctttgctagaaggcgacgagcagctggtcctgttcttcaggaaccagttgttgaggaaccagttcttgaggaagtgcaggttgaggcagacacaacacatgtcgcagatgacatagttagtgagttggaaggatttgcaggtggtccggaagaccctaccattctgaaaggctttggtaaccacatcgcccttagagtgtgggccggagaggtaatgtgaccctgaagtgtatcctataatgatgatttaaatttaaaatttgatgtcgtataacaacttttctttcgcaggatcgtcctgagcttaagctggcctctcatggacgtaaggttgcgaagtttggtccccccgcacctgagatcgaaggattggtcgcttgtactgggttaagcccactggtttcagccttaatcgatacgggagaccggggattgatatccgcctttgtggagtggtggcacccagagactagtagttttcacctgtcgatcggggagatgaccctgacattagatgatgttgcttctctcttccacttgcctgtgatgggagccttctagacctacgatgtagttgacgtgggggaggccattacattattggtcgacttgcttgatgtgaccgtaactgatgcgcatgctgagaccgaacaatgccatggggcatatgttcgactctcgtggctccaagacttgtatgctcagaagtgtgaggcccgacagtgggttgtagcggccagagcatatttgctccaccttgttggttgcacactcttcgcgaacaagagtgccacgcacataagtgtgatattcttgaacgcttttcgggatgtggaccaagctggagatttttgctggggtgtagctgcactggtccacatgtatgatcatctaaactacgcctctcagcatcacgggaagcaccttgctggatatatatcactgttacaggtaattgtaaaacattatctaagttaactattattatgacatcatctaagtttactaagttcaattgttatttgataccgcagtactggatctatgaacactttccgaccatcggaagtgtgagtgctgatccttattatgatgagaggttgccctgggcctgccggtggaaagcttctaaggctttaccggttgcaacctacagacggcgattggataggttgaccatggatgacgtgtgctggatgccatacgtggaccatcgttcccacagacagttcgagatggtttcgctatttttaggtcaccttaggtggggaccacatattgtcagatatatgccggaaagggtgatgaggcagtttggttttgtccaagaaatccctgatttccaccactgtgatacgccttcagcagaggaggttgacgacatctggactcacttcgccgaccatcttgtccccactggagaccttgtcatttatcccagccaatgcgtcagtggctacatggagcggttttatcggatatcccatccatttgcccgtccgccagaggttggtgagcctagtcgacagccgactcgagtgacccgtgtgatgcatgatccccctcatgttgatggcgatggatgcgttggccagccaggtccagttcagccaggatcagatgtcactgacatgccccagcatgaagtggtagaatttcctataaacatttcttttacttatattttaataaattgacacttatcaaacacctaccaattttcatatgcaactgtgcgagcccatttcaatacgtcctcacgggaatcaaacacctaccaaaatggataattcatttttaatcaactaaattcattcatttaacaacttaaagtaaactcaacttcatatccatacctgagatgtactgaaagctgcagaacaatccacaaaagaattatcattttctggggcatcattttcttcttcaatgtcctcattcataatatactcgtcatacataacactgtcatacatccactcctcgtagttcatcttcacaaaacaaaaaaagattctaacatgcccaaccgacaattacgcaaactcaataatatttatcaataatgcattcacaaataatcacaaattacgttgaagcataccatacttaattatctaatttatccatactcattcatcatcaaacttttcaactcataaacaatttactttttaataacctattttaaatttttttaaattatttttcctttttttacaaaataacacatacggattatgtaatccgtatgtatataggtaatccgtatgatacatacggattacataatccgtaatagtaatacggattatgtaatccgtatgcatcatacgaattacctaatccggaaatgccatgatattgcctaatccgtaagtatcgtatggattaggtgatccgtaagtagcaaacggattatgtaatccgtacaatacttacggattacctaatccgtgtgctacttacggatcacctaatccatacgatgcgttaacagcagctcttacctttttagaccaccaccagccgccgacgaccaccgctaaccaccaatgaagctccgacgaagctcaaaacaatggatgcactcacaaagttacctataccagcagccacaacaacggaatcgtaaagcactgtgcaaaatcgacaactgagttgaaaaagcatggaatggcttaatattgtgctggaagggtactttggtcattagcagaaatatatagtgcatgttgaaatttatatagtgtatgtagaaattcccaaaaattggggttcatgattggacccacgaaactggttgggcttacttacttgtggggactccgagaaatcctgaacatgctcctagtccagattctaaacattcattatgctgctacagtcacaaatagatatagaccatgagtatgagtatgagtataagtatgagggagtgtaatagacaaacaaatgaacattgtggatttcaggggccatgcacttgtagttagctggattctttacttcccagtggtgttgtagctttcatgcaaagaacgtggcctctattacctctcttgtaggagacaatcacgtgccatccatgatccatcattaactccattctacaaagtaggtcatgctattttatttctattttttattttattgatcttggtcaatgaagataataataacgacagagttttagaagttcttaattaatttatgcttttcatccaaataaggggaatgtttacctgcattttagtaatgattgccataatattcctcaaacgaagtccacacagtttctaaatactcgttaaatgataacttgatattgcttaatccttttagacagtttaagcttaatttacaccatcattacaaaatcatacaatcaaattggttaaagtagaaaggaatgtgaaattattcaaattctgccaaattattcttgatcgttgatacaactatgtttctttcttctttttttttttcttaaataaaagggatgatgtattacgtactaaggtgagttgtggagaaatcataaaagcagtccgatggagaggggcagatgctaagggggacaagcgtgccccggtcccttcccttaatttttttaataatatatatatatatatatatatatatatatatatatatatataaacgtcatacattaatgggaaaaaacacttgattagatttgttctcttagatatattatttgtctatgctcaagtaggattcgtactactagatttatccacaagtaccgaaaattaacatacatcaacagtgttttatattatcatcattatgatgaaaaaacttacttctacaacacccctttaaaatactgctcaacaatattcttacactttcatatatccatttttctttaatgataaaaaaaaaattatagatattctcatacgacatctaaaaaaacgtattcaacactaactcatgaaaatagaatatttgatgaaaagatctctagtggaattttacaagtcaatatttggtatgaactctcctaattaaagactctatcattcaagtcgatcggcatttacaggatttctaaggtaaatgaattagagaatgtgtgtaacttttgccttttatgttagtaacgagcacgagcttttgagttggtactttttgcatcatgatgtgtggattaagatgttgggttgcttttcacgagatcatatattgagtcttatggttttggagtcaaacaattttgttttattttttctcttttgatttcatgaactgaagtgagcctataataatagctcagaatgaacagcatctaacttctatgcataattgttctcatcaatcaacccactatctttgaatttaagactcattttgtattgagaaccatcaacagtttaatcaccactatatctaatataattaaaataaagtttaaatatgttggagatctctaaaatagacttgaattttacaactgatctttgaaaaaaatttcttttttgttaggtccctaaaacttcaaaaattttgtaagagattcatatcgttagtctctgtccaaaacataatgatgtgtccgttagttagatacgtcaataatataagtatgaagccacttcagacgtccaaacgggtgaactacatcgataccatcttccccacctcctcccccctcctcggttggttctccacctgccgttcccccctctctctgcccctccattttttttcttttttctttctccctttattgttgtccctttcacctcaccaactcctatagcttcaacatcgacgtgttcttagatctttaagatatttgtttgggtgaaaataacattttttaactagaggtatgaagagagccattgccttttcacatttgtggttttccatatcattctctgacaagtgctttagttgggggcaacggcttcggagtggatgtggtgacgatgaaatgacattgtgctcacttgatctggttgtttcgacgtcatggttctcctactctacctccctattgtcaatttggttgtttcacaaaagctaaaccctcaagcaaaagccccttttcagaaaactccaatgtccagtaacatctcacacaggaagaatcgatgtcgatgcagatgttgctgtgatgttcaatctttttcgttgatgggaatactagacgtagagcaagagatagaaggagacaattacgtcgatgcattcacgtttattgtcgtgaagaggaaaaaccttgcaggatgttgcacatgacaatgaacgatcccaatgtcaccggcaacagagaagacagagataagaggacaaagggagaaagaaaaaaggtgtaaaaaatggaggggtagagggcagagcagcaacacgtggagaaccagtcaaggagggggaagaggggaaggtgaggaagctagtaatggtggcgaggaggaggaaacaatgtagttcacacattttgacatcgttattgttgacgtgtccaattaatggacacgaccatagagatctccaaaatttttgaaattttagagattcaacaagaaacaaaaaaaaaattctggaatcaactacaaaattcaagtatatttcaatgatctctaaaatatttaaagtttaaaataaaataaaaatatttcttcttcttcatatattgaaaaagcaaattattaatgcattttgttagaaaaaggttgctagttaaatgtataataacatgaaacgtaaatattttattttacatggtacaattttgagtcagctttatttttaaaactaattatttattatttataattaaataaaccgaatctagtttcctacatagaattttctctactaaaataatttaatgaaaacaatttccgtattatataagttctaacgtctaagtcaactaagtgacttctttgaaaggaaatatcagtcggccaacaagtacataaacaaatatctaagtttatgccttccaaaggttggtgatgaatcgctctcacggataagggttggttttcatatatatttagatttttcagccacgagaaaaagatttgcttgtttgatacttgtgataggtgaatcagaggaagagtcgttatttatttggaatctagtgacgttagattgtgatcgttaatctataatataacataacaagtcatgaacttgattatttgggtacaggtgatcattttttaagcaacggaggaaatcttggtcgtaaagctttaggtaatcatatcgttcacatgaacatcttaattcaaatatgctattgtggtgcttaaacatataaaataaatttgttatttaggtataacgtgaatttgtggtttttatttatttatttatttatttatgtccagtggttctgataaaaaaatgttcagaggtttaggagttgatagaatttaatgcagagagaattttagtatttagtaagttttttttttttttttttttttnnnnnnnnnngaacttgattatttgggtacaggtgatcattttttaagcaacggaggaaatcttggtcgtaaactttaggtaatcatatcgttcacatgaacatcttaattcaaatatgctattgtagtgcttaaacatataaaatatatttgttatttaggtataacgtgaatttaaggtttttatttatttatttatgtccagtggttctgataaaaaaaatgttcagcgtttaggagttgataaaatttaatgcgaagagaattttagtatttaataagtttttttttttttttttctggtgatatcaataaggtcacccagtttctcgcttctcataaacatatttgaagcattgatgaaaggtgaaaggttccacggcgtggatgagttgctgactcattcttcaaaagccacgcgatcagattcccgaaaggattgtcttgtgccagaactgattgcactaggagaagaaaatcaattgtttattcccattctcttttaagtcagggattcgtttaaagccttttgctaccattacaacaaaaacaatgacatcagattcataattgttgctataaaacttttctacaagatgattattttttattataagtaaaaattaaagataaataaaagatgatttataacaatttatatattttattcaactaattaaattagatttttttaattttatacacgttaatgtaagtatatgtttacattattaaaaaaaatatttagtgttattattattattttcattttatcattaagctaatatcataaactacatatataaagtaaatgagaaaaacaaatcacaacagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaattttttcaaaaaaacaactataaaatttagaaatattaatgtaataacttaatactagattataagaatattttgtctatacatacacaaatctgattttttaatgcaaatgcaacaaaatgatcttcgttcaagacgtcaaaataccatttgaaaccaaacatgatagcaccatgtcttttttatttaggattgcaccatgtttgagacgattaaacatgctcttaataattttggtcaacaaaatttctttcgaataatcaaatgtatttttctgacaataatttgttcgtcctacccataaataccttttaaagtctttttactaccccttgttataaaaaaaaacagacaaactttttaccccttcaaatgtgtctactccttttctatcgtttcaagtttttaacattnaaaaacaataactttgaacttcttataatctgtgtaggtagacgttacctaaatttttgagacattgatttggtgacaaaatcttataaaaaactgagagatgaattaagtaactaatttttttaaagaactaatgtgatgacgtttgtaaatttagaggactaaattaaaagttttcttcataatccaataaaaatgtaattcttcaaaagacttcttttaatgattttgtattaaagtaataacgcatttatctttaatatataagtgtgttaaatttatgaaagtttatattaaaataagaactgatatattattaccttctcacattatactatttattttatcttatgaaatagtaaatatttgtgtaagtgttctagagaatttatgaaaataatttataaactacccataagttgttttaatcttattttaggaatcttttcacgataatttatgaaaaaggattaattttatatgaaagcaatttaatcttatttttttcatttattataaaacaatttatacatatatatatatatataaataaaataaaaactgtgtcattacatgtttaataaatatctaaacagaaaaataatactactccactaaaaaagaatcttgtaagccattaataatcaaagcattcttacaaaactagatgttagaagtaatcatggcaaaagtatatttgaatttgaatttaaatttgaacatgaatagtaaaaatgaatccattgaacttcttccaaatttgagaaaataacagggagggacaaaactgtaattgcggaaaagtcatgacaattcgtcaattccgctgggggacaaaaacaacgcgaaaaggtcggtcggcaactgtgggccggaattgaaccgggggagataaaagcggcgcaaattctaactcttctctttcaaaaacaaaacccatttcaaaacgtcttgtaaccaaaactaatctcaaaacaaattaattaacattaacaataataaattaataattgttcatcctcaaacccatccacccaaacaaaaaactcaaacggataacgcaatacgtaagactcttctgagcctttatatatgggagaattatttatctaataaaggaatttatatttaattttgatgtgttaaattcttttgacccattataaaagaaattagtcggagtctgaaacacctttagtgtatgatccacaagactaaaaaaaataaaatcatccactcaaaaaataaaataaaaaacaaaaatagacactttggttttaattcccacttaactaacaacaaagtttcttaaaattccactctccaataaccatatcttcttcttctctctttctccctctaacttacttctcactgctctatccacactcaccctccgattccaacaccaataccctaattccgctattctccaactgttttcttcttcttcttcttctttcgttctctctctctcttttttatatgaagcctccttggctgtgatttttacttattactattatttttcagctcggtatgtcgttttgcttctaaaccctaatcctaatcctgcagattttactttaatttgttttggtgaaagttctggattgatgaaactgctgtatcttttaaaatcagtgttctgcttctgatagattgcgatgtttgtgttgtttccaagtgtgttttgaaaatttagcgacctttacaatctgtcctttttttttttttttcttgtggcctattattcagttcggtagaaaagtgttgcgaaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtagccgttgtttgtttgtttttattttctctgcctaaatggaataaccatgcctgggatatcatgatattttataattttataaattatgctctgcaagtaaaacaaggttgaatttgttgttttctgcttcctgattctttcaaagtttactgaaatttgattcgtgtgtttggcctttagtgatttactctctgcttacttcataataagtcttgatgtaaggaaagattagagagactgattgtgttttgaatttcgattctgagctgattttttatcgttgttttttttttttttttttnnnnnnnnnnnnnnnnnnnnnnnnnnnnnnnnnnnnnnnnnnnnnnnnnnnnnncagtagaagattatttggtacctaagttaacgaagaccgtgactgtgaatgatggatgttgctgaggttgaggaaaatctgtttgccgcaagtgatgccaaggtatgatcatgtctttgattattttgtatgctgttttgggaattgcttttacagcgtgcacagtcctcatgccaaggtttaattgaagattcaaatctgttttgtattaatttctttatgttcttcatttaattatgtaggaaaagaaaacccgtttctttattattgttttcctagttattgtatgcattcagctaagaaaacagttgaacctgtctaccttttaaggtgcatgaacaatctttttacattgtcatcgtatctgctatttaagccaatgtttttcattgctggcctaatgaaaaagaaaaacagcaaggggatgtttgagttctgtttttcttgctctgtttttttttgcatttgtatccaattcagttacaatttatttttattgtctgtaatgtagtctgactaatatctatctggtttcttatgcagttacatggacagatgtgcaagactctttctataatatattgcaaagtattgtctgtatttccttctttagaagctgctaggcctaggagtaaatctggtattcaggcattatgttcattgcatgtagccttggagaaagtcaagaatgttcttcagcactgctcagagtgtagtaaactttacttggtatgatttatttcttctatagttttatttgctgattatgtttctgagtacagtttttattttaccttatcccatgaagcagttatctcttcttggcgggtaaaattatttaacctgaaatacatttttgtaaaatatcttacaaatggcattaattatgatgcaggctataaccggagattctgtcctcctaaaatttgagaaggctaaatgtgctcttgaagatagtcttagacgggtggaagatattgttccacaatctattgggtgtcaggtaatattactcagcagcatggctggtgctgtaaacttttttttctccttgtgggtggtggtggttagttttaggttcatgatccttttattataatattatgtggagggtcttactcattcttgccaattgctgttgtgatcatatgaattctaggccctattgtagatgttttattttgttattccaaaataattgaaatattgaatgcaccttgattacattactctgggtttggttttctgtaacactggcctttgtatattcaaatgcacaaaattctctccttcttgttatcattgtcaatgttgaacccagtctgaggtttgattgatttcctcttcaggttcaggagattgtgaatgaatttgcgacaatagaatttgcacttgacccatcagagaagcaagttggtgatgacttaattgcattgctccaacagggaagaaagtttaatgactctaatgacagcaatgagcttgaatcttttcaccaggctgctactagacttggaataatatcttcaagaacagctcttgccgaaagaagagctctcaagaaactcatagaaagggctcaatctgaggaagacaagcggaaggaattaattattgcatatcttttacatcttatgaggaaatactccaagttatttagaaacgagttctcagatgacaatgattctcagggttctgcaccttgttctcccgttcagggatctattgaggatagtgttcctggtagtcattgtcaagcctttgacagacaactttccaaattcagttgctttaattttaaaccaaatattagtaggacatctgggcagctgcctcttccacctgaagagttaaggtgtccaatatctctgcaacttatgtatgatcctgttatcattgcttctgggcaaacttatgaaagggtttgtatagagaaatggttcagtgatgggcacaacaactgcccaaagacccagcagaaactttcacatctttgtttgactcctaattattgtgtcaagggccttgttgctagttggtgtgaacaaaatggagttcctattcctgaaggccctcctgaatctcttgatcttaactactggggattggtattatcagagtctgaatctacaaattcaaaatctgtcaatagtgtcagctcttgcaagttgaagggtgtccatgtggttcctttggaagagagtggtatctcagaggaatctgtggaaaatggaactgaaagtgtttctgcacaagaggaagacactgagcagtattttagctttctggaagtcttgactgaggggaacaattggaggaagcaatgtgaagtagtagaacaattaaggctgctgctgagggatgatgaagaagccaggatttttatgggggctaatgggtttgttgaagcacttttgcagtttttgcaatcagctgtgcgtgaaggtagtttgatggctctggaaagtggagcaatggctctcttcaacctggctgtgaataataacaggtctgctttgtatttctagttttaatcattaagtaaaagtaaaactgcttttcatatgattacaaaatcaaaataattcttgatatttgagattgatatttgagaatcacaaccttgtgttttagccaaagccattgatgatcaaaactgatcactgagatttgcatagtgctagtggatgtaaaaaattgatcactgcccacattgaattttgttcgttcagttaatatgttctaataataaatctggcttaaatttaccaatatggtagagttgatgtttcattagctccttctaaattcacataacttttgtttttttttaacctctgcaaactattaacttgaggttgatctttacttttcaacagaaataaggaaattatgttatcggctggagtattatcattgttggaggaaatgatttctaaaactagttcttatggttgtacaactgcactttatttgaatctctcttgcctcgaagaagccaagcctatgattggcaggagtcaggctatccagttcctaatccagcttcttcaatctgacgctgatgttcaatgcaagcaagattctctccatgctctctataatctttctactgtgccctccaatattccatacctcctttcatctggcatcatgagtggcttacaatcccttcttgtaggcgagggggattgcatttggacagaaaaatgcgtagctgttttgataaatttagctacttctcaagttggaagggaggaaatcgtatcctctcctggactcattggtgcattggcttcgatattggacaccggtgagctcatagaacaggagcaagctgtctcttgtctcctaattttgtgcaatagaagtgaggaatgttgtgagatggtcttgcaggaaggggttataccagcattggtttcaatatcagtgaatggaactccaagaggtcaagaaaaagctcagaaactcttgatgttgttccgagagcagcgacgagacccttcaccagttaagacacatcagtgcccacctgaagctagcgatttgtctatgccgcctgctgaaatgaaaccgctatgcaagtccatttcaagaagaaagtctgggagagcttttagctttttctggaaaaacaagagctattctgtataccagtgttaagttccattggttgttgtaaatctgtgttagcatctttacttttgtggccctgcttttatcctcctcccgtggggtgctgcttatttttggttcaaagcgaagaagatatgtacaggcctttgtaatttatggattttgttttcttctttcgctttcctctttgtaatatcatttttccaagtattgttgtttttcttttctttgttttttatgttcgagggtgtttatatttcaatggggcttcaattcttaggcttaccattttgaagttaactgtgaataataatatcttaaggtgtttcttggtgaacaaactataaaggtcacacaatagtagttagtaaagagtgcaagttttcttagaagctagcggatgtcgctttagccattagtttcagctttaaacagtcatgcttcttctttggtccgtgtttcttgattgctttaccgcaattcttctcaagtaggatttcttataattccttaaaaaaagatgtcttatataattcattttgaaacaccataaacgtcaagtaattaactatttctcatgaaattaaattaaatttctcttataattatactcagtcacttgatttatcacagtaaaaaaaacaaactataaaggtcacacaatagtagttagtaaagagtgcaagttttcttagaagctagcggatgtcgctttagccattagtttcagctttaaacagtcatgcttcttctttggtccgtgtttcttgattgctttaccgcaattcttctcaagtaggatttcttataattccttaaaaaaagatgtcttatataattcattttgaaacaccataaacgtcaagtaattaactatttctcatgaaattaaattaaatttctcttataattatactcagtcacttgatttatcacagtaaaaaaaacacattatagaagtcactaaaaaaaagtttaagagcctccaaaattgttattaacttaaacaaaataacatccattttgcaagtatcatcttttttttttgtcattcatttttattatattttataaattcaaattcatcactttttttttataacagaaacatatttttaaagaaaaatagtaattacaaaatgtaatttaattttttcttaataatatttcttattaatattatgtatatatcttatctaaatctaatctaagatatatacaaatgtgaatatacatataaagataatattttgaaaaacacataaattaaataaatattcttataactatttatatttatacaatataaaactgtaataaataactataatgtaaggtaggaattattaactataatgtaaggctagccttttacaacatttctaaaaaaataattagaccgcggggtggtactcctttaatttgattgaggaacatcacgctcagtcacttgcattacatctttttgctttctcgagaggaatacgatggtttctcttcccatagttcaatatgaagagaaaatcatcgaaactgttgagcgcaaccccgttgtcgtcgtcatcggagagaccggttccggcaagagcactcaactctctcagatgctccaccgccgcggctacggcaaaatcgccgtcactcagccccgtcgagtcgccgccgtctccgtcgccaggtaactattcttcattttcactgaattgtgcgtaggactcctcgcgtcgtgtttccgtttctcactaagacgtggccgtttaaatcccgcagacgagtcgcgcacgagctcggcgttcatctcggggaggaagtagggtacgcaattcggttcgaggataggacttcgcacagcacacacataaagtaattgcgttttcgttttttattattccattgacttcacttggttttattttcaaattgtctctgattgtggttgatttgattgaattaaggtatcttactgatggtgtccttctccgagaaagtttagctaatcctgagttgaatgagtattctgtgatcatattggacgaggctcatgaacggagtttaaacacgtaagattattgaatactgtgtgctcttgttgttgtcaagtgtttggtgtacaattgttctgcatgaaactttttatgattggtgtgtttattgtcagggatgtattgatggggctaatgagacgcttggtaaaaatccgttcctccgatctcaaggttttgatcacgtccgctactcttgatggcgaaaaagtatctaagttctttgccgattgtcctgtattgaacgtcccgggaaagttgtatccggttgaggttctttatagccgtgagcgtccctcaagctatcttgagtcttcgctgaaaacagctcttggtatggcatggaatttgaaccttatcagcgtgttaagttaaatgtctgcttgggtcaacatcaacatcaataacacctttaatctaagttaattgggatcaatgatagatgaacacaatgatagatagatgatgttgaaaaaaaggaaggtaaaagcaaagaaggggaaaaggagaggggagatgaagagaaaaaagactaaaaagagactatctaaaacttagagataacaatgggtctaaccctccaccaaatttataactttttttcattcgatcctaagacataccgtccatcaatctatatctcactccattaagtcttgtttaattacatttcctcacgtaagtttcggtctacctctacctctcttttgtcgaactcttggtaacaaacttttgtttttatgggagtatccaagggttgtctcattaaagtgtccaaaccatctcaatttatgtttcctcatcttttcactcaccagtactactgttctctttcatcgaatatcttcattttttattttatccatcttcgtataaccacacatccactttaatatcgtcatttctgctatgcttattttatgctgatgttgcctatgtgttggtcaacattcaactccatataacattgcaggtcttacagttgttctataaaattttccttttagcttaagggaattttgcagtcacacaacaacccagatgcgctctgtcatttcatccatcctgctttgattctatgatttacattctcatcaatcccttcatcttttagcaaaattgatcacaggtatctaaaaccatctttctcggataactcttgatcaagtagatgcacggggtcttgatgatcatttcttactagtgaaaactcacatttcatatacccagtcttgctctggcttaacgtgagtcttttagactccaaagtgcttctccacaattcaaatttcctattaactccgtctttggtctcatcagtaagcacaatatcatatgctaaaagcatacaccacgacacttttttttgaatatcttttgttagttcattcatcactaaagcaaagagataaggactaagagctgaaacttagtgtatatctaccgtaataggagaataacttgacatttcattacaagctttcacatatgtggtagtcctatcatacatatccttgattgcatttatatactttaatggtacttttttcttctcaaaagtccactataaaacttttcttgggactttatcgtatgctttctcaagatctatgaacatcatatgtaagtctttcttcttttcttgatatcttttcattaattgtcgcattaaggaaataacttccacggtacatcttcttgacataaatccaaattgattttacagaaaccttggtctctgtcctcaagcgatgttcaataactctctcccacaatttcatagtatcgctcataagcttaatgcttctatagttagaacaattttggatatctttcttatttttgtaaatagacacaaatatacttttcctgcaagcatcatgttgtatactttgcttgcttttgtatgtaaataaatttgccttggcatcatgtagttattccaatgctatgtcaaagtgttaaatgtttgccttgccctttgcttattgataaaaacttatacgagacatacctattttttttttccgttaaggtaacatttccttaaaactggtattggctcttaaaagataatggccatggttaaaattgtttcatgtgagaacataagctgctaagaggggggatgcattttaaatctgaattgggaaatctttcgttcatgacttcatgttgatgtaaataatcacattcacttccttcagctcctttactgattgaatggcttgtaactctgcaagtagaaagtcaggaaatgttgtcatattcctgttgttttgaacacattccgtttcagatgtattatttcctttagttgtatttttatttttatttctagtgattgactaagtattggttttgcagatatacatatttgtgaaccggaaggggatattttaatattcatgactggacaggtgaacatttttgttatgtgctatttatcgtatacttttctactccacaatttaaatcttagtatgtattttgattataacttatttaggggaaatagccccttttctgttttgaagtttcccgagatagatttcctgtttctgtgtgtataagtatttgttttccagaactaacctgtatcctaaatccctcgatttctgatatgatgcaatgcaatgattgaacatctttcaatgatcttcatgtaggatgacatagagaagttggtatctaagttagaagataaggttcgtgctctcgaggaaggttcctgcatggatgctataatcctccccctacatggttctttgccccctgaattgcaggcaagtagttactcactctaggttccaaatacaatcacaattctataaactgatgtgatgatgcatgctgatacttcagataaaagaaacagcaattgtgagaatatttggaaaggcattttaatttcattcttatacataattcttagttttctttttagttctgtctataaaaaacttgactaatttgcatttgaagattgttgctggcttaggtgtgaaactgccttgagtgtatttctcttagttcattcctcttttaacttgttgcttaccttgtttgctttgtattacatctcaaatgatatttcttagcttgcaattaacactcataattgttccttttcatatgggggaaaaccttaaatatacaatggttggtgtttgagatattttatcccagaaaataaaatttgaggcattataatttttttggtgcatttgatactcgtgtgtaaccgacttcacctagtggggtaaggctgttgttattattttgtcgttgaaactcatgcatttattatttaatctttcaggtgcgtgtatttagtcctccacctccaaattgtagacgaatcattgttgcaacaaatattgctgaaacttccttgactgttgatggtgtagtgtaaggacattgattcttgattaaatattgttattttatgatcatcatgaagataaattattgtgtattattattgttgttgtaattgctattattacttattattataattcaaatgttttttttttctctctctatagcctattaattttcatcttaaccagagaagagattaaaagttcgttgaaaaccaaaatttcctgtaatacatttattgaataagtactgaagttcatgattaagctattcctgtaaaagcaatgtcaatattgcttaatgttgcacccagacgagtatgaaaacattgttggcaaaataatagtgagtgcttaatatataccacaggcctcagctggtgatgcattctatttctttctgacaaaatttaaaaatcacatgcaacaggatgtatcattgctttaacttattttttagattgcatatgttttgaggtatgtaactatgcagtttttgtaacgacaattaatttaaagactaaataggggtaggggggagataatgacatgtagcatattatgagatgcaactattgagacaagtcagacaacaaaccctgctatttgaattcacctattgtgatttggagtgtttttcagtcatttactcctttagatcaagcacataaacttgtcttctcatagtttctgaaactgtttttaattttatgaattttaggtatgttattgactctgggtatgtgaagcaaaggcagtataatccatctagtggcatgtattctcttgatgttgttcaaattagcaagtaagcaattaatagtttggtacctcgttgtggccttcataaatttttaaatacccaattcagtagcggtaagatgatttcaaataattcatgtgcagagtgcaagctaaccagcgtgctggccgagctggacgaacacgtcctgggaaatgctaccgcctatatccttcccgtgtttacaatgatgagtttttggacgttacagttcctgaaattcagagatcttcccttgctggcagtgttctttacttgaagtcattggacctcccagatattgacattctaaaatttgactttctggatcctccatcatgtaacatactatcttgggaatctttttttgtcatctcaaacattttaattcctttttatatttttgggggagggggtcggtccttatattagtttcttgtagtttcaaatattctttatccttgactagcagctagcaagttaatgagttttgctcaagtttactctggtgatttaataactgggttttctgcagctgagtccttacaagatgccttgaagcagttatttctgattgatgctattgatgaaaatggtgcaattacaagtattggacagaaaatggctggtacttgatttctttctttacattttagtgttgaatttttaatatctgtatgtagaactaacacattatgtaacattgttatcttcatcaagattttgataatggctttcactagtttaccatatttctgtctattattttcatagaagtttctttctgctaggcttgacatgaaagttgtgcttggtgttgaccataaaatttattcttttcttacccattcattttcctaatcatgtgtacttctcttggttccctgagttgtttcttgattctatgcagagcttccattagaaccatcgttggcaaaaaccttaatggaggcaaacaattatggttgcttatatgaggctttgactgttgctgccatgttatcagctgaaactacattgctaccagggcagaggtggactagtctgaactctgaagtttatatagatagatagagatagagagggagagaaagagaaagagtaggaggatcttatcatcctccacgttttcaattatactgaaaaggctactgtctttcaaataaatccattcttataaaatgtttaacaatttacatacttgtgaataattctactatcagtgaacaaaacaaatgaaaaaaaaacaggaacataggatgatgtgtatcttgtgttttaccatgacgaggcttatacgtttatacatcgacaaggactgagtaactgagcagtaacaaaactcctttaatgtgcagaaagactgagaagaagaggaaacatacaatatctaaccttcctgatggctccggattgggtgatcacattcaattgctgcagatatacgagtgctgggatcaaactgattttgacattggctggtgcaaagataatggcttgcaggtacctatatgtgatctagtaatgtcaactgtcaaggctgacataaatttgggactgagcttttgcaatgtagtctgttaaaaatgtttagctagaaaggctagtaatatccttgtggaatatttgtcttcactcttcacacatttgattcagatatagtatcctttaaagaaaaattcttatgggtcattgtgaaagacgtactgttatttcttgattataatgcatgcttgcatttttattttacctgtcagttatctaaaatttcttgtcttcataggagagccattctaaaatatgaagtgatatttatgtacatatggatcttttgtatttgttcaatgcataatatatgtgatcattctggaatcaactgattgaaggtgcgagggatgttgtttgtcagagacgtccgtaagcagttatcccagataatgcagaaaatatcaaagggttcgtattccacaatattgaggaatttacctgtataaagtgaataataatatacttttagatgctgtgataatgtcactacactagtaaaaacgaaccagcattttgattttgacacattcgtatcctctttaatctttttattcgttaattttaattgctcttttccttttgccttgccttcatccttattgtgttgatatgagcttgtttgtaatttgtataggattaatggggtcaaaactctttaagttttggcaaaactattggtttccactatatctatcatgttatgtatgttgtttcctccccactttacatattttttcaatctcgcaataggaccactggatgtaagggaaagtgggaaaagagaagagttcaggcaggattatcgaaatttgaggaaggctttatgtatgggctatgcgaatcagctggctgaaagaaagatgcatcacaatggttatcgaactttgggtttccaagctcatgtagtccaggtaatataagtttctagtcactattgcatgtcaccattacttttagcagctcttttgattcatgttgtgttaatataatatctcctttaagttttttccttaaattcttacacttttactgtgaagtccatatctaagggtgatggaacttacagaaatgtcccaatgaaaaaaaaagtctatgtactgtgaatttgtggaagttcagaactagtaactagtctttgtgaatttcaaccgaatccttggtttgtagatacgttaattttctgaatcttctatactaggtgcatccgtcatctgtgttgagtcttgatgacctggggaagttcccagactatgttgtgtaccatgaactaattgcaacaccacggccgtacatgagaaatgtatgtgctgttgagatgagatgggttatacctattattaagaagctcaaaaccctggatgtgtacaaattaaggtaggtaaatatggcagatgtgtgcagttttttttctttttcattttttgggtgggagggggggctatgatcattgatggctctaattcctttatctgaagcagtggtggtgttcatcatgttgaggaggaacctgagaaaaagcttccagatttacccaagaaggatgttgaggtggctagtactgctgatgaccgtgaaagtagaatccaagctgctagagaacgatttcttgctcgtaaaggccaaaaatgagcctgaaaggatgaagaggtcaaatacactagagatgatcttggcttgtcaggcattttattaggtggtatagttacctgaaaggatggaagagtctggatgagctgatgcttttgagttttccacgttgtcacaacaccattttcgtgctatgatgttatctcagcttgatcctcatcagttgtctctcgcaaacattacaagatttatcacagaaacctgagatttggtctcatactgttctgataagttggttgagtggctgaatgcatatatactttgtgttcatgcttttggtttgaaatatacccaggaagaagaaagaaaaaggaagaggaaggaaagaggagacagaaagtagcaaatccccttgacaagtaaatgttaattaaacagttaaggggttttgaaatgcaatcgtggatactgacatctgattgagataattacctttgggtggcacactttgcctgatagttaaattacatttttgtttatattgaacccgtttagatggagataatgcctagctgagattgcgttgggagttaaacttacaaaacattatggtagttatgtatatgaaacaggatcaatctttgtctaataggttgttggttctcaacctgatgatcactaattcaaggtgtctggacatcacctataatcaatgattaaaaaaaatgaaaaaggttttcaatttgggtcttagtctaaaaaaaagattggattataatcaaagtaatccagaaaatagaaatcaaatatatttgatttctactatttgagaatttgtccatttttttttttaatttcatctatttaatttgtattgattctaatgaatctaaaataataaaaaaaaaacaactcttattcttttagattttggattcttcttactgttctggtatcataataagaaaagaaatggggaaagactgagttgattgtcctctaacgatggcatattctttgctttggtgtattaagatttcaatctttgcgtatctcttgtcatgtttaatcacgtcagcatacataccatagcatatgcaaaaatatttatgtttataaaaaatctttcctggccagtgagggtgactcaaatgataggatcaagagttatttagttcaactaatgttgattaagttaattagcggtaccgctgtgggtcaattgtaagtacttttatacattagaccatattaaaacggccatgattaaaaagtcatttaaatttgattcatacaatatatggatgattggaaaatgatttatatgcagtagtatatatataattttttacaataattaatactagttttcactttatatatatatatatatatattagtaatactaatacaaatattattgtttactattttccaatcgatcagtgaaggtcaattcaaatggtactactgtattaacaggtcaattagaaatttagatgtattttcatagactggattgtcattgagatttatggtgaacttttgactttagtgatatagtacttctttttacataaacttttatttcaaataaaaaaaaggaaaaaatacgtcattactactatatacggttgtacaccatgcattgaaagtagcaaaacagactcacgggacaatcgacagaaccgcctaacacgtaggagcccagaatgacgatgagagatattttgtcgatgcaatgtacgttccaaagttgataactagcgtacagaattaagtatgcaacagcaatttcaagtaagagaatttttatgataccttcatgaaaatgatatttaatgtgaattaattacaaagcgtttatcaattactaactttataataataattttaattttcaatatagttaataaaaaagcttcacaagtcagcttaataattatgcgcatcattcttaacatagtaagtagtaaggtgtttttttttataatcttttttatagaaccatgactttctttgatttaaataagattattatagacgataattatttgagtacttaatactttatattgcttcatgttctaagctcaaagtcaagattcaaaaatcaatcttgtatcaatttattttttgcacattatttaataaacaataagtttgatttttggacaaaaggagacactactcattccgatgctttcatttacgatagagggtccacacacttgcatgcagcttctatgccaaggtggcggcttgtatagctcctatattgcaaggtggcacttcgtctatatagtttctgctatatggcttattttttctggactcattgttgacaaggggaaaaactttctgctttaagtaagaaccatgaatctcatactcttctgactctctttgtttcatgaaagttaatgatgatatagtataatcactatactatcactcaaatattcaggatctagttatcattcttcttccccctataaaaatttcctttgagttttcagcttctgttccttaggagtttgaagttttcaatactgaaaaatgaaactgactccaagagaggtggagaaactaggccttcacaatgctggctaccttgctcagaagcgtcttgctcgtggtttaagactcaattatactgaagctgtggcactcattgccacgcaggtacttgcatttgtatatattttctctttttttttttggtgattaatgattatctaacttgcatgctttttttatttatttattaatgattatcttccttgcatgcatttgtttttatatatatagattatggaatttgctcgtgatggtgaaaagactgtggcacaactaatgtgcattgggaaacatctattggggaggtattgtatttttgtatatatatatattatgtcatttttcatcatctcattctcaaaccccatgacatatatatatatgctttagataagagtttcatcgaagtatatgaatggactccaagttcttttagtcattttgaactagaaaaagctgaatgagccattttaaacaggagacaagttcttccagaggttcaacatctcttgaatgcggttcaggtatttgtctcactatggaaatgtagctattatctaccaataaaagcactctcactaatggctttgtagacattacatgaagtctcgttagttcagttactaatgacaatctttctttttgcccgctataattcaaactacatatttttttcttatataaggtgttaatatatttcctcattatttaatctctgtattatggatcttaaacttcaaatggataagtgtatctccaattttgtcgttatttatcttaggactctactcttatccctctgattataaaattttgtagtcattattaattattattacctgtatttatgttttaatataggttgaagctacctttcctgatgggactaagctggtcacagttcatgatccaatttcgtgtgagcatggagatctagaacaagcactatttggttcttttcttccaggtttgcttctattatgatattgaaaattgataatttgttagttggtatatctctctctctgatgagtgtttccagatgtgatcatgccatgcatgtactttgaagcttcgcttaaccatcgcttacaaaactgcatcttttatttatattttattcttctgtaatatttttctgttttggtttataatcaacattttcattgtttattgggaaaggaggaatctcttgttttttctattttaatattgaattatgagaggttaaaatatctatgaagtgtaatttgaggctaaattttttgataaaagattattgactagtcaatgatggtcagccatctggtttttctttttaaattaaaatagcttgaaacatataaccagtcactacattattccaaaaagctaaatattcctccaatatgcatatggtttgaaaacattcactcctttagtgtatagtttgtatggtttcatgttgaaattgttgggtaccgagcaatcacacaacaatcgagatatgagaaagagagaaaggggaagaagaaaacaacacacagagtttaccttgattcacgcactcgtacaattgcactcagattacaaggaaatatataaacttagaaattctaagcatagtagctattcatgggtccaagtcaaactacaaataataaaacacgagaccaacaacagtactaggcctcgaaaaaaaagttctgggggcgctgccccctagccccctctaggaagactcccccgggccctcacctgctcacccccgtgcatatctgctgatggcatagtatgagccatatctaacaaaaatcacataacacacttaaaaaacatgaaaaagtgaaatctatatgaagttccttcgtgttaacatgaaaatttgacacgattttcctaaaactgatgcaaaaccaagcatattatggttatggatatgcgcaagtacaggtttatttctgtaggtacattagcatttctcttgattgggaggaaaatgtgtttgcagtaccttcacttgacaaatttgctgagatcaaagaagataatagaattcccggtgaaataatatatggagatggaagtctagttcttaaccctggaaggaatgcagtgattctcaaagttgtcaacaatggagaccggccaattcaggtgtttgccttatattgtctacaagattttttccattgtcttgttcctaccaccttaacattttaaacaatttttttagttttctttatgcattaaaatgtcaaactgatttatgcaatttaaaaatgcccaagatttgctattgttacatgcatggctgcagcttctgaatgcagtgtgataagctgtttttattaacttattgtagcgtatgaaataatgaagtgatgttaacgactgcttttcggtttgtactggtttcgttatgttgtttactggttcattatttgaggatttcatagggtcctctggagactaaaatctgagtatgtgcatgctgttgacctttttaatttcaagtgttgcaaatgtagacaatttttttcatctggtgtactactgtttcacaaatcagaagcttttgagtttttttcttgtcagaccaaatattgttacagttttgaaacttgtcagaataataaattttaggagttcaaatatccaaacaaatttatttcttgttagcttttccaagtgaattgaagcaaacattgcctaatagttatgaaaatttcaggttggcagccactatcattttattgaagtaaatccctacttgacttttgatcgaaggaaagcatatggcatgcgcctcaacatagctgcaggaactgctgttcgctttgaggtgcaattctacattgctgcaagttatttatttatttatttatgacatgttcaacagttgaacacttgaacttattaatttaataggttctaaatgattaaccacatacatatttgctcttaaaaagccaggggattgtaaaagtgttaagcttgtaagaattggaggtaacaaagtcattagaggaggtaatggcattgctgatagtcaagttaatgaaaccaatcttagagaagcaatggaggcagtgtgcaaacggggatttggacataaggaagaggaagatgcaaggtttatcatttgttactgaagtacttgttatatacctttgcttacatctttaactattccacatttgagaataaatgaagatttcttacctcaaatgtaaatttcccagtgaaggtattactggtgaccctgactgtccattcaccacaatcattcctcgtgaggaatatgctaacaagtacggtccaactactggtgacaaaatccgtcttggcgacactgatttgtttgctgaaattgagaaagattttgctctctatggtgatgaatgtgtttttggaggtggaaaagttttaagagatggaatgggtcagtcatgtgggcatccacctgcaatctccttggatactgttataacaaatgctgtgataattgattatattggaatcatcaaagcggatataggcattaaagatggtctcattgtctcaattggaaaagcaggaaatccagacatcatggatgatgtattttttaatatgatcattggggtaagttcccttccaaaaatctgaagcaattaactgaattcatacaccattatcttgacacaacttatttgcatgtcatccatatcaaggctaatactgaagttattgctggagaagggttgattgtaacagcaggggctatagattgtcacgtgcattatatatgccctcaattagtagatgaggccatatcaagtggtgagttttacaactagaatcaatttataaagaaagatttcattacagtgggtatcttttaaatattaacgaatggtcaaggaagtacaggttctcttactttctctcatgaataataatacactcccaatctttggttaaaggggagaggaattccttcttacatttctcacctcatctccttttccccatggtagatatcagcctatgcagatgaatttgatggactttaacgagtccttttgtactttgtatgtaggcatcacaacattagtgggaggtggaaccggaccgactgctggaacacgtgccacaacttgtacaccagcaccatctcagatgaaactaatgctgcaatcaactgatgacctgcctctaaactttggtttcactggaaaagtgtgttgcctttttgatatatcttctgtttatatgtcttgtttttcttggcatattgcaaagttatttttcttgttccttgctcaatgttatgtgatggatttaagacctctctttcttcaaataattcaattaactttctattggttgctttagggaagtagttccaagcctgatgaactacatgaaataatcaaggctggagcaatgggactgaagctgcatgaggactggggaagtactcccgctgcaatagacagttgcttgactgttgctgatcaatatgatatccaggcacaacattcttcattacattttattttgtaatttttatcaatatctgctgctaacttttatgattacagattaacatacatactgacaccttaaatgaagctggatttgtcgaacatagcattgctgcatttaaaggaagaactattcatacttaccacaggtataatactaacttcaaaattgtttcccccttataaatctcatacatgacatgtaagattcaatctataggagtattagtgtagggaaagcagctaacatatattttataatccatcatttttctattgttattgaatatgatttcatctgtgatgtaaataggtgatagattaaaacttatgtctttcctagaataaattttctcacttctacaaatgccctatgcttatggatattgctctttcctttgggaattatgacttggacatggtttatactttatgttacatattcacttcttgcaatcacaaatggaaatggaaaacacaatgcagcttttattttctggtctaagttgtcttggctgattcttgatgtttccatattatttacttgagcagtgaaggtgcaggtggtggtcatgctccagatatcatcaaagtatgtggtatgaagaatgttcttccctcatctacaaacccgacgcgccctttaacagtcaatactatagatgagcatcttgacatgttggtaagatataaatctggtagaggtactaatgatgtgcattgtgatgacatgtggttctcaatttagactttctatgacatgcagatggtctgccatcatctgaatagggatattccagaagacttagcttttgcatgttcaaggataagagaaggaacgattgctgctgaagatattttgcatgatattggggcaattagcatcatatcttctgattctcaggctatgggtcgagttggagaggtttttattcaagctcagccatctaaatatgattttcttcctaactcacctttattataaatgaaaaatgaaaaaataaatagggtgcttcatacatttgtctaagtgttgaaatgaaatgggataatgtgcatgtggcattttcacaatatgtgtttcttttaagatctgttactgtgtcatctttatgctgttgtgtccaatacccccatttgtttttttgtagttcactagtactagtaactattggtgaaaatttagtttttttccccctttttgaaccctcagggtttgataagttgcattatttcttccttaggtgataagcagaacttggcaaactgccaataagatgaaggtacaacgaggaccactccagcctggtgaatcagacaatgacaacttccggatcaaacgatacattgcaaaatacacaataaatccagctatagcaaatggtttctcacaatatgttggttcggtggaggtatatgtgatttttaaatgtttaatgcatgctcaatatatgcattaatttctaggaaaagaaaaaagaaaccctgagatttccttttgattaaataacttattgtatacaatgtgttttaccatttaactgattaaagtacaaggtcactgtttcatatttttttgtcaaaaaagaatgttacactttggcactttgccatagcctatgacaatctcattcaaaatgagaggagtgaaacagaaatgcagaaattactagtgatatttcccgtgaaaaagcaaggttgcaaatgtcatcaatacttgctgacctatgttgatgttggccattggcctcttgtttacctcaggaaagaagcacgcacatgttagttggtacttggtaagaatttagtggattagataagttcgtagtataatttatgagtagtgctataatagtgaatacttgtacttgcttagctattcacgtggctgcatataagttgtttaagcagttcttattgaacatttgaacttgaactttcagtttttttattttttattttttgaaaagttcagattgagaaaaatgaatagttaagcatataagctactatacaagtcggttttctcttctctcataatttaacttcaaacttaacatatcagaggacagctataaatctgactctaaaccttctaattttagcattatcatccagatcactgcatttatgtgcctaactttgcaggtgggaaagttagctgatcttgtgatgtggaagccatctttttttggggcaaaaccagaaatggtgatcaaaggtggggtggttgcatgggctgatatgggtgacccaaatgcaagcatccccactcctgaaccggtaaagtttttgtatctaactagtttggctagagtttttaagtagagtgcctcttgcttagtctttttggtatttagattccttaatgttgttctatatttcctgatttggccataaaagaatttaattgcttatactaatggagtctattttagttttcttaagggcacacacacctcacctcacatcggctaatgcattcaggaaaatgaaattggtgccaaacttccaatctaagattcgaacaccaagcgtctcgagtaaacgcgtgactgaaaattaaaattatataagatttgcttaatggtgacaatggtcaaacgtattacactaatgatgataaacttttcattacttgtttcattagcattcataatcaatttcatgcaccattgcacaagttctaatgtaaaatttgtggttgagactaatttggacacacacctcaatgagattagaaaatctatattactaaaatataaaacagacagacagacaattagtttgtgtttggattggcgtttcaaatgtcccaaacgtccgttcacactttctaatgcacaaatccaaaagctacaatactgaagctttgagaaaaatgtcttgcaaacatgctcttagttgttgggcaattagcattttgatgaacctgctgccactaaacttattaaacacaatattgtaggtgaagatgaggcctatgtttggaacactaggcaaggctggtggtgctttatccatagcttttgtgagcaaggcatggaaccctctatccctcatacttacgtaaacaatttagtactaaaattacaaactcacgttgttgttgttgtttcacaaacaggcagctgtagaactgagagtacatgctctatacggactgaacaagagggtggaagcagtaggcaatgtgaggaagctcaccaaactagacatgaaacttaatgactctcttccacaaatcactgtcgacccagaaaagtacactgttacagcagatggcgaggttctcaccagctttgcaaccacctttgttcccctttctcgaaattacttcctcttttaagtactagcttccataaataaagcttataaattatctctcttctaaggttttaatgtgtagcactacccttataaattttttagttcccctactcttgttcttatgaattcagatgcaataaaactaagtgtgttggtttggtatctgttatgttttttgttctttttaaggcatcaattatgctgtggtgaagatgcacaagatagaattaaatcactagatgaatccctgtttaaagaataagaagaaacttggtgaaaaagtagaacaaagctttaaggagaggcaacagcttttattgctgaattttttggtaacacatgcatggtgcaagagatgctcttcataaagtttttttttttttttnnnnnnnnnnnacttttggaattcagatatttttgtatttttttttctttagaaagaaattttatatatcatttttttccaaaaccgaaaaaacatatatctcttttatacatcttttttattggatgtctttttcaaaagcacatttaaaggttagaaagttcagttatataattaaaaattgaatagggccctaattggatgagacgcacataattgaatagatccctcatttttctcgtgtttgtttggaagtatatatcataacagtaaaaagttaaaatattattattattattattattttgctttataaaaatgtaaagaatattttacacaaaaattattcgaacccgagcaatcataaagtaataaaaaaatgacctcttaaaagtagcattctcgcgtttccattagggttgtaacctctattgattatcacatttctttagtagaataaaaataaaaaatattaaaattaaaataagtttatggatttagttaattaataaataaataataaaatattggtatatttttacataaataattaattaataaaaaaattttgtacaaattttaaaataattattataagaatcaatcatctnnnnnnnnnnatcatttttttccaaaaccgaaaaaacatatatctcttttatacatcttttttattggatgtctttttcaaaagcacatttaaaggttagaaagttcagttatataattaaaaattgaatagggccctaattggatgagacgcacataattgaatagatccctcatttttctcgtgtttgtttggaagtatatatcataacagtaaaaagttaaaatattattattattattattattttgctttataaaaatgtaaagaatattttacacaaaaattattcgaacccgagcaatcataaagtaataaaaaaatgacctcttaaaagtagcattctcgcgtttccattagggttgtaacnnnnnnnnnngtctaaagaatacgaatatataaatatatactctcaagttgaagggttatgtgatatacattaaaaaatataatggaactcaaacattgcgttagatacttaaatggaaattaagatttgttattcatggcggtcataattaacttgagcataattgcttccaataaaaaatttgtgatctataaaaaaaatcaactaactcaatatttacttagtacacgagataggaaatttgtaggtttaataagtgctttgagttttaacttgttcttatcatatatcattcatcaattgatttaagatttaagacatagggtttaatattttttaaatagacaattgcaaatagagatggaagagaaaaaattacaaatataataaaaaattatatataatgacaatgaagattgaatttaacatttcatgcatattatttgactcctatattacacttatcttagtggatatatgtgtatatataacagaaaatataagagaaatagactatacattatcatatctaattataaattatcatggatgaaaaaattattgacttgtataattgaattaccataaattaaaagtcatatttagagatgcaattaaatgaaaaaaagaaaaaaaaagtgacaattagatatttatgtacctatcactaccgtttactaaacctaagcttattaattagaaatgtatcgagagatattaaaagataagcagttattagtaaaagaaaattttattgaaaaagacaaaacttctttcagtaatttctatattttaaaaattatatcataatttttagttatgagaatacttcactttcagaagaaaaaagaaatataacatatgggtgataatatacaatatgatgttgccatgtcgggaggaaaagaaatgaataaaaatgagaaacgcgggaggaatggaggtactaggtggtgaggaaatcattattggtaagtttatttattttttttttatagaaaaatgttttataaacaacaatgttatctcatatctagaaagagttgaaaaaataatattataaatatgattaagtttataatgtaatagaaaaataaaataaaaataaaaaaacattaataaatgtttaaaataaatgaatgcacatgtattattatttttttaatagtggatgatagacagcacatgcagattgatacatccactgttttcaattatagtagttgtaatcacgccactgccagacgtacagactagtgctccatcatatccaatgttggcgcacaagcctctccactactcaattctacccttccgctcatctccggcgacgcttgccgtcaaccgccgccggaggattcacttcccggccttcacgcggcggaaggtggaggtccaagcggcggtaagcggcggagacaagagccagacgactacgtctccgttggacagcaaagagaggaaggggaagagttcagtggcatcatctggctctggcattgatgaagggatacaagtgaaggcagtggtgacaataaggaagaagatgaaggaaaatatcagtgacaagcttggggatcagtgggagaatttcgtcaacggcgttggtcaagggatccagattcaactcattagccaggaaattgacactggtacgtgtgtttctcaacttaattcaactctcttttttttttcctttttctctttctttctgttattaattgatcatgattttaaggttgtcgagatgatcattcagagatcacgacttcaacaccgtcctagactttctttttttctagctttattaattatttcacttgctgcacactgcacagtgagaactggtatgcacaagtacaacacaactgcaactgcaagctttttcatttgatttgatttcatgtccccttgttcaaccaaaagcaaggaccaggaggcctacaaattacaaaaggaaaaagttgtttggtctagctctactgaactacgtgccttggaagcacctcttttattttaatatttcctacagtaataaaatatcttatttaacattgctttcaattattatcacattattaatataattgttttatatatttaattaagtataagtcatcttagaatagatatagtttaacataaaggattcatctgatagagtaagacaaggtttaaatgtttaacaacgacagttgtaatcaacccttaattgtctctttagagcagaggaaacataaagaatagtaatatacaaatattttattattttaaatatctttttaacacttttcatttttcttcatctttttttctatcatatcataaattatattatatttatatttttctatattttgttttcctcttgatgttaaataatataatgaatattaatgtatcatttttcaaatataaaatgacttagtccgaagactttttatctgtcttgaacatggaagtcattcttttcttctaaaaaataaatatattataaaaatttaattcttaattatataataattagatgctagagtaagtactaaaaaagtgttattaatttcataaactataaataacaaattaatattttgatcaaattctctctttaaattaagatatatatatactatttatgtttttttttaaatcatgtttttcactaaatgaaatagaagatttaagatttaacgttgtaactaatattgatgtgatcgtgttaaattaacttcttgtgtctgtagtctgtactatataatatctttttctgattaatttgcggtattttttatgttttgttgctttaaataagttactaattctgggaaaagggtgcaatcctacgtgagagggtggctaccgaagccgtccaacgttgcttacattgtggaatacgctgctgatttcagcgtgccaagtgactttggatgccccggtgctgttctagtcaccaatcttcatggaaaagagttccacctagttgagatcatcgttcatggcttcagcggaggacccattttcttcccagcaaacacgtggattcattcgcggaatgacaaccccgaaagcagaatcattttcaagaaccaagtgagtcacagctcaaccctcttgtaaagtctaaaccaatgaaaatttattgcctgatggtcactttcattaagtgttcatgtaaaaattgtttcagaccatgaacactaaaacttgaccatgtgtcatgtaaagattaccggagaccatacgtacaaaaaaagtatagactacacttgaagattagttgaaatcatgaacaagtggtgatcattattctaatgacaaactattacgtggacaggcatacttaccatcgcaaactccagctggtatcaaagatcttcgacgtgaggacttgctaggcataaggggtaaccagcatgggcaaagaaagaagcacgatagaatctatgattatgctacgtacaatgagttgggcaaccctgataagggcgaggaacttgctaggccagttcttgggggtaacgagaggccttatcctcgtcgttgtagaactggaagacctcccactctctctggtacacttcattaatttgctttctcgttagttactttttgtgttgggttttggtatgagcaaatggcatgtctaatggggtgtgcaaaatgtggtgtgtaatggatgcaatgccaatgattagatccactgtcagagagtagaattgaaaagcctcatcctgtttacgtgccccgggatgaaacttttgaggagatcaagcaggacactttctctgctggaaggttgaaagctctgttccacaatctgttaccttcacttgctgctactctgtcgagttctgacattcctttcaagtgcttctccgacattgacaagctttatatcgatggtgttgttttaagagatgaagagcaaaaaggggtagtggaaaatctcctagttggcaagttgatgaaacaggtccttagtgctggggagagtttgttgaaatatgaaattcctgtggttataaaaggtgcgatagtgaaacaaatacaacacaaccttgtattcgcggaaaacaacattcatttcacttgtttcttttgtatggttccaggggataaattttgttggttgcgggacaatgaatttgcaaggcagatcttagctggggtcaatccagtgaatattgagctgttgaaggtagtttttttatacctgtataggaagaaattgtgtggtactgtccatagctctggtcaatgtccacataacatgcaaccgaacttatcaattttcgacaaagagctaataaaactttattatatgtcacgtggagattgtctgagaccatgctagtcctaaatcatgtaataatttctccaatctaggaggttgtaggagtattaatatgttttctttgtcatttctttagccattctctttgtctttcacaggaatttcccatctgcagcaagctagatcctgctgtttatggccctgctgaatccgcaataacaaaggaaattctagagcaagaacttagtggaatgagcttggaacaggtttgctctgtatttctcttgctaattgagcttgacctgtttatctggaagaaatttgttagctctattaccaattatttttatattggtaggctattgaggaaaagagactttttatccttgattaccatgacatgcttttgccgttcatcaagaagatgaactctttacctgggcggaaagcttatgcctctcggacaattctcttcaatacaaagactggtattctgcgtcctgtagcaattgagctttcacttcctcaaacgcactcttccccacaaaacaaaagagtttacacacaagggcatgatgccacaacacactggatttggaagttggcaaaagctcatgtttgctcaaatgatgccggcattcatcaactagtaaatcattggtaaggcaattgaatggaaattccaaagtattgaataaatggctagattcagttagtttaattttgcaaaatcagatttcataaatgacttattcagaagaaatggtggattttctcaaatttagccaagagtaaaatacagtggaaaattgttgtgtgcaggttgaggactcatgcatgcatggagccatatattattgctactcatagacagctaagctcaatgcatccaatttacaagcttctacatcctcatatgcgctacacgttagaaattaatgcacttgctcggcaaaatctgataaacggaggtggtataattgaggcatctttcagtccaggaaagtacgccatggagcttagttcagcagcttacaagaacttgtggcgatttgatatggagtcattgccagcagatcttattcggaggtaacactaattttaaggcttttaaaaccccacatttaaatcttgctttgctgtcctttttgcacttattggtaacataacttagctaccattttaacttttgtgcataggacatagcatactatcaatctgttaatagtgctctcttcttttcaggggcatggcagtagaagacccttcaatgccctgtggtgtaaaacttgtgattgatgactacccttatgctgaagatggactcttgatctggtctgcaataaaagaatgggtagaatcttatgttgcacacttctactctgatccaaattcagtcacatctgatgttgagctccaagcatggtggagtgaaatcaagttaaagggtcactctgacaaaaagaatgaaccttggtggcctaaactcgataccaaggaggacctatctggtatacttaccacaattatatggactgcttcaggccaacatgctgccataaactttggacaataccccttcggaggatatgtgcctaaccgccctaccctcatgagaaaactcatccctcaggagaatgatcctgattatgagaagtttatccaaaatcctcaacttgttttcctatcatcactgcctactcaacttcaagctaccaaagttatggctgttcaggacacgctgtccactcattcccctgatgaagagtatttgggtcaacttaaacctcggcataatcattggatcaatgatcatgaaatccatgtattgtttaataagttttctgctagactggaggaaatagaggaaataataaatgcaagaaacaaggaccccagtttgagaaacagaagtggtgcaggtgtccctccctatgaactgttgcttccctcgtcaggaccaggggttaccggtcgtggaattcccaacagcatatctatatgatcaatttgataattgtttagtatgtcatcttatcctatccactagtatttgcttagcggaaaccacgtacgtacaagcatacatatttttatgggaaataaatgttccaatatttagtttcgtactgcattttattcgtgcgtcaaagtgaaaaatcacgtcgaaaccaagaaaatatacagaagatacaaatattaaacaaggattcccacttagtaaaatgagatattcatattatattagggaagctcattatttttttggagaattacataaactagaggcttagaatcctctaggaaaagaaacttgagctacatcaactactaaagcattaacgatacaacctagagcaaaatcaaaaacatgatagggttgttgagacttcaacacatacttatagccaaaccatctacaacttgatgggcttccctcaaaatatgattccacgtgatttgacccataccaccatgcaccatgtgaatttctcaaataatatcatagcagggatgcaaattactcccttctccaagaatgaggctgatagcattaagggaatcagagtctacccttattttccaaaaacctctggaccacgccaatttaaagccgaaaaggatagccataagctctgccttcaaaactgaagcagatcctatgtaagctccaaaaccacacaagcccccatatgatcacgtataacaccactacaagcagcattactatcagcattagttattaagcattcatggtattacttccagagcaaaattctcactctttccggcccattccaacggaaaaaaattttacatgagggctgatctgggatctcatccgtgttattgacttttgcataaactgatttcatagaaaatctcctatcacctgatccattccaagctatagtatcattgctgaattccagggtcgggggtatcaaagataagattttagacccaatatgagcagggagagaattcctgaaatcatccaccttccaactcctattcatatcaacatactcgtccaaagtcctattcgactccgtttcagaaatagagttttccattacactcgtcaaggcaccacaactgggcagtcagttgtcgctccagaatcatataatagaaccattcccaattctccagattacatttctgcataatatatcccaagccgagcaaaaacccttgtaccagtgttttaaaatccgaactgcccgatcgatcggactgggttgacacagcaatctgaggatcaaattgaactgacaatcggatcaatcataaattaaacatggtcattaaataattttattagtgtgttggaaacattctagtatggattgtgtctgctatgcaatacttttaatcctaaaaaagattattgtgaatttgctctttctagttttttttaaaacatttaatatttttttcatcactagtttattgttaattttttaatatatattgataacgcaatatctaaatgataatataatattgataatgtgatattggtatgatagtatgatatataaggtgataatctaatatgtgttgacgcatcatatatgggccaaattttgttcctactattagtcagcaccttattaatgtcacattcataaattattaaattgacaaattatttatcgcatcaccatgttagcgtgtcagatcattaaattacattaaaaaattgatactaagtgaatcagaatttctaaaatttaacaatatgagaatcaaacatgttatagtttttttcttggaaactaaaattgtattatctaaaaatttaaatatatttttgttcttataaaattaatatatattttatttctgtaaattattaatatattttttattttcataaaattaaactatattattttttaggttaaagtaaagtttagatgttcaaatctataaaaatataaccattttatattaattatatataatcaatatgaaaaatattatatttacatgttatttgcataatatacataaaaatcataatagtaaatttggataaactgagttttgtccatgaacaaaaattatacattttaattttatgttaacaaaaagtatatttttaattttacatgaaaaaaaatattttagccattcaaaaattataaaaataaaaagtgaatcattaattagttgaagaaatctaaagtcgtcgttatgcggcattgtcttgtctgtgtaagatcctctgaactttcaactttgtcacttgctgcacctaggaagaatggaagatattatatttttcaagaaaatactaataaatatttttaaggtattaattaaaaaatcctctgatcgaaaggtattaattaaaatataaaaaaaagttatagaaaaattattaataattataaatacttttaatttgttaagattttcttattttcagaaagaaatgagacaggtaagcagatgcatcatacatgagttaccattaataaaaagcagggtaagaaaataaaaatataaaataatggaatcatttctattttctcacgtcaccgctttgataacggcttaagaaatcagcaatggaaaatgctcgcccactccgccaacccaccccgttcttttccttttcatacatccaacggctcagcatttcccccaatgccacgcgtcacgaggcaacgcagattgcatttgatctcacgattccgcgccacaccgtgagcacctgggttcgcgatgcgattcgttctctgaggaacaaaagatgaatgcagtggatttaagagagtcctattagtctcgtaagtaaaagaagaaagatgaccaatctgcaaatacaaacagaggaaccccctcagagtcaaacaccgcttctaatttcaattcagcagcaactagagaacgagaatgagggaaatcatcatcataataataattataatgagagtaagaaggaccaagacgttgaagttgacgatgacggtgacggagagattgtggaggcgagcctggtgcgcttggagcggtttcttacggtgttagggttcaaccaggactcggcgttgagcttggtggtttcgtggactgtgttcgcggcggtgggagtggtggcgccgctggtggcgctgtccatgtgcgagtgtccggagtgcgacaggtacgagattcagagcttcgagatggcgatcgtggcgtttcaggcgagcctagccgccgtctccttgctctgcctctcccacaacctccgcaagtacggtctccgccgattcctcttcgttgaccgcgactccgggaagatgcattgctttcaccgcgactacgtcgctcagatttcggtctgtttccttttctctttcgctagctccaatgtgcaagcctctgtttctgatctgaatgcatgatagcttgattactttgcttgacacgagttatttgtgaaaaacgtttttattttttttactgtatttggtgtagtcagggttgttgctcgaaaccagaatttgtcgctgtttcttctattcgtattattattagacattcgccttatttgaaaactttttcaatatgtgaggagtcaaatcatggacgattattgtgtaacctttcagttcttccttattcttttatgaacatgttattattctcttagctttgaaatgaaaagttaactattccccattaaggagatcttaaatacttttttttaataaataacatacaaaatctagatatagttccttggatgcttttgctgatgcttttcaatcaaaattagagtttcactctgcgcattaaaggtttccattaaatttcaacatagctgaagtgaaactccaattttgattgtagaacagtagcaaaagtgcctcagtgtatttatattttttcataaacaatacatgcatgatagtgtaatccgatcataaactgccttgtaaggttagtttgttaccttttataaaaactacctttccaagtcataccaatatgatttctgattaattcagagtacattcttttattgcctattaaactctttttctttttcactgtcaccagggatctatgcgcatgctttttctgtgggtgttgccgtgtttcattctgaagacagtgcgagaaatcattcgcattttttatgtacaacctgggtcctggtggctctcacttgctattttatcagctttgattatatcttggacttatatgagtacaatctctctgtcagcctgcattttgtttcacttggtctgtagtttgcaagtgatccattttgatgattatgggaagctcttgcaaagggaaagtgatgttttagtctttatggaggagcacattcggttgcgctatcatctctccaagataagtcataggttcagaatctatcttcttctagagttcttggtcgtcacagcaagccaggttgtgacgcttttgcaggtcactggatatggtcaaatgcttaccttcattaatggtggagattttgctgtaagtccaactctttatgttcaaagtatttatgcatttagattgaaggaactaattcctttcatttcaccatttctttttggactgttgtttcttttaggtatccacacttgttcaggtggtgggcatcattatttgtctgcatgctgcaacaagaatttctcatagagctcaaaacattgtttcccttgcgagcaggtggcatgcaatgctaacatgcacatcttctgatgcaccctctcaattgagaagctctgctagtgcagggagcttggaagctgccaaccatttgaacgcaatacaagtagactattctgaaagtgatctagagtcaatggattatgctggaatgtttacaaatacccaatggacttcctatgtgtcttcacatcacaagagacaagcttttggtatgtaaatcaaccaccgtctgtaaactgatgaattttacaagtttttctaattcgtgataaaagtaaaatgtttatagaaacatcatatatgcttcattagtgttatcttgtaacttcatcttgcatgagaacctacaataatctgataatgttacatgaaatggtgtaagtggtacaggtgtgttgcaagaccaaattgagatgaaataatacttaaaacatcaacatcaacagcacctttaacccaaattaattggggtcggtatgaaataatacttaaaagacattagtaaaattacaacttggaaagatccaaggaaacatgtatgttagagagtagttttctggattcattaatttttacttatattttggtgaattctggattcattaatttgtgattactatattgtaaaatttgttgaacattcaaggcacattgaaaacatttagtcctgctaaaaaggtagttgacttgtctaagagaaggaaagggtatattctgctatttccaccaaggtcatatctgattgatattcatttgcattattcatctctcatgttcatggaccaaaactagcttcatatggctacttcattttaatacagctgactatgcaagcttttatatatgatactatcttattagattagcaaattagattctcagaaccatcttctatatgtaatgtaatgtgcaataaacatgtcatctctctagaaaatactgaatgcttaaagtttcattttacatgattactaggtcattctattgttctcataataattactatgtaaatcactatttttatcaaatattttgcaaatgtgaattttctcattttgtgtattttgtgatattagtgtacttattttccttgttcatatgtatagctttatttactatcaatatgttggcaatcatgctaaattacacaagactttctgcataactgcttttggaatgtatttttaagttgagaaatcgtgttctttctggtttcatcacttgaatgcaggctgttagcttgttttatgtctagcaggaggatctcatgcttgttggttcttttaaatatgcagtgatgtatttgcagacgaatccaggaggaatcactatatttggatggacagtcgaccggtctctagtcaacaccatatttttccttgaattaagtctggttacctttgttctcggtcagaccctaatctaaggataaaatttgcaaaatgacatgaaaaaaaccctttggttttaggtcttcctggttaccaccatcaatttgattgaaagtcctccacatgccgagccagaatgtcgcatgcacacggtagtcatgcaaagtagagaaacagtgtgtattgtccacccggggtctggaccaggcacactactgctaaatgccgaggcctcttccccaatccccagcaaaacagatgtctccaaaattctattcgtcattctcattcctcagtcagcatacttatgttcgtggatcttgtggcttctaattggcacaatatgcaatcaaacaacatagcttaaacttataccaccttaagatacttggcagttttctgcctacgtgggctcctcgaagcagtctttctccaattgtttcgattcataacctaaggtttgcaccatctcatttgaaatcgaaggatcatagctatagtcatgtcaccccctgcgttgaagattccagcctctggacatctctgacctttaagagcgttctcatgttgaactcgtatgtgttttgctttgtagttggaagcaagaaaaggtgttgggcaccaggaaggacagaggtttaaattttcaactaggaatatggaggttggcccaatcgtgttgggtgtgcaagtgtcggtggacagtcatattaccgagtaatgttgcttgcaaattctgatctagttagattacagtgattgtttttattattattatttgagatatggttaaggatgaaacaagggcctataacttccaacaagtaacctattcccatacttcatctcagaaacaagggcattaaaattaagcgacgataaaaggatgttttccgtacttcgaaagacaagtttataattattggttggtcgtgcaccaaccctctttcattttcttcacgaaatttataaatttctttttaaacaaagaaaaattcaataaattttacttattcagtaatcttcaatcaattgcaaattgatattttctgttctttacttgtacgttgatgcatttgctctgaaatcaattggagtaaggttattttagtttaattagtagttttgtattttagtccttgataataatgtgtcatgtacttggaattgaaatgagaacttcgtcttgatatgtatgagttaagtacttgtaatgagaactttatgagtcagtgttcttgggtggttcgagtaagattacttcacatggaatatatttatctcagaaaaaacattcatgcttttaccacaggtatttgtcgtacttgttactatattcaagtccatattttgaaattatttgataaataaagaagcttaataaaaatcttagcctaatggttatagtacaataaaacattcaacaacttactgttggttttatcattacttaattaacgatccactagcatacttttctattcataataaaatattattataaaataaataaaactcattaaataagtaggagttgttgaaatcaaattgttgcttcaatctttaaattcaagattttcccatcctccctcatgcgccaaaatttaggtatggtgagtcttctcggatcttggactcatctttaaattctaaggtttcaccatcctcccatcataagcaagtaaaccttgtctttctctatgttttgaccactttcagtcatcaaaatcctagaataatagttaattagtccattttagcctcccacaatacttcaaaatagttaactagtctccatttaccaaaagatgcaatctcatacaacacaacaagtaaacatgatatggacattctcacgtaaaacactggcagcctgtgaaatagaagtagaaccccaccaacccgcacttggcaaacctaatatatttttcgtcaaaacctgcctattgaaagagagagagagagggaggggggggaagtacagcttatgcttactgcatcatcgcccatccagtgagtgatgcttaatgagaagtggatgctttacatctcttagcaaccccatctcccagctgtaccaattaatagagttatcaattacattatgagcattataaaaatgcatcagttattgcagaaatcatgaaagcaaaacaagtggatcccatcttaaattaaataaaaaaccctcacccacgatgtcaatgttcaaaaagtaaaggatgttctatcatggtgtgtaaacagggggaagggactcctttaatgggtagaaggataattgaaatattcagaaaggaatcacaggtaaccgtgaaaacaaccaacatttaattcccaattaagatttaagatctagttctggcctccagattcaacagcaaaacacctcatagtcatattttaaaactagcaaaggaataatcgccacaatattagacaacaggacaattttccggtgacaaaattcatcatttcaaattgccaacaatgtagccagtgagtcagcaaactcaaatagtcatttggtgcagggtgcaaattgtgtagaggcaacatagtatttagtggtaacttgtataaagtgaacatagattttagcacaggaaaagcctcaaatatactgaaactaacatatagattttagcacaggaaaatcctcaaatttactgaaacttaacataaatagcgagttaggttagagccaaaaagaatcgttacagtacatcatacggaccctggtcaattttcttccaactagttaagggataatttcataatcattacccatagggaggcggggggcagggataagtttctaaacacagattagtaatgctgtgtttggttgagggggagagtagagaaatagagaagaaagtgtgtggggcccatgtggatcctacacctcctacaatcaacttcaattcaaaaatttatcttctatttctatcatctctcgttccatcctctaatcaaacacaagcataattgctccaaaagatgttttaatcaaaacaatttaccataaatttaactgaacatccaagcaatcaatgataattcaatgtcataatccatcacatcctattttaaggaaaaaaatgggtgagggtgactatatcaccatgatatataataaataagaaattattaaaacatagcaaaagtcaatatttcagatcttaaaaacctataaggataaaacaaagggaaaaacacattataacaaaccaagttttgcattgtacctctagagagactgaaggaacaactaattgaagttctatactttacgatatactggtaacctcttcaacctgcttgctttgatacttgatactgcagtgacatttgcagacaaatatcataaaatattcttgtacttgtcaaaactttaatcttcagacgatgaatacatatgataaaatgataacttttgctaacttttgacttcttgcattaaagaattttatactcttagtgaatgaacaccagggggatgaaaaactcaaaattagtgtatgtttccttgtcatgggaaagagggataaaaaataaacatcgttaaaaaaggttaaaaacaggcttaaagtacaataataagaacccaggaaaaaaaaacaaagttggatatttaaggaatatcagtttggcctcgcctcagaacaattggcaaaataaaatagtcattaatacaagacagcacttcaaaccaagaagaacacaaaaatgttttcaaacacagctgttatacatcattattagggtataattttctaaccagtatatatgatggaaaaaagaaagacccatttttcacatttattgaggcttagtgttcacaatctaaatgtaaataaaaatacaataactcgtaaacaaagctagtgcaatatatatcatggcctaccgttaaccatggaaactcatgaaattcttggcaaatcacttcacttagatacaacaatctgaagcattcaccaataacaggaattaaattattgtataataaatccattatagaatgccatttcatttaagagtcggtcattgtgctcacagaggaagaggttgcaccacttggaatcaaaagaagtgatgattcacatccgcaataaaacaatgcatggtaccatcatgtcattcacaaaattaaatttgagagaatgtttcaaaatgcaattgctgacttatataatagaccaataatatgagcaagtagcaattaaaccctccatcatctccaacctccccccccccccccaaaaaaaaaanacttcagattctagacattatttctctcacagataatacatatcctcattccttaatatcaaaggaatgcattacctttcaatgcatataatgtcactcaatttctttggtaagatgcacagaaggtcctcttccacttcacaccaaccgtctcttgcaaacacaaggtgaatattaaaaaagaaagaagatatagctgctagaaaatccatagtgctttaatactcaaaaccagatcaaatttgtttatacagtatgccaatggatatgttacaaagcttcagctgacactgacaattcctaagccaataatgccacactttgagcagcaagccatgtcccagatgcatttctatataatgatcaagcatcaagaatgttaaccttaaataatctggttcccgggaggtaaaagaatacatctccgccaaaccaacaagttcctgctaaaaaacagcacgagtaatcgtctaacaaacaatgcttccaacttccattcagtgcataccctcacctcatacactaaaccattcagcagagtgtgttagaatgattattgagagttgagacatagctttagtaaacaccattcttagccaaaaattccaccagtccctgtttcaccctgctgcaactccttccggcgctgctcctctaaaggatctggactcttgtatattctccgcatgcgcctatttatatgatgattgatgaaattatgaaaacttgtcaaaaataaatgttgataaatgttatagagtcaacaaatatttacacaacttccctcttttatccagactagagaattacataaagttattatttaataaaattgatccagcatttcctattaggtcaaaatacctgtcctgagcatgttgagcaggaaatgtaggcatgaattctttacttttggggagaggaacttcacggaaccactcatgatttagagcagcttcggcagtgatccgctgcataaaatagtaggtcttatattaatattcagaaaaatatttatttaccaaattaattcatgtagctcatgtaacctttaccttctcagggtcataagttagaagcttgttcaacaaatcaaatccagaatcagaaagaacaggagatccagtgaatgatgtggcaggaaactttttacgcaggaggttgtacctgaaaggaacattccgtggttaatacaaaatagaaaatttgttcaacagtacaagtcaccaagggaggccagatagtcagaccagaaccacccaaagttggaaaagcctgggaaaacagtggcaaaacataagcacaatataatcaaacagtaactttttaaataaaggaaatcgtaagcacttactgatgtttgacaaaattgaccttgactccaggtaatttggagaacccaggccaaattgtttcatttggtgtgccaagaatccggaaaatctacaagtagaataacaggtcaatagagtaaaacaaccaccaagtggttaagcacaagacacgcaagggttaaaaggaaagagaaatatgaagcaagagtgtaccaaacattacacataccttgtcaagttgatcaaactctgttttcccattaaacagtggttccttagacaatagctcagccattatacaacctaaagaccacatgtcaatggctgttgaatactgttttgcccccagaagaagttcaggtgccctgaaacatatagacagccattacgtaaatgatcgcatcactgcaagagaatttagtcaaagacattaagataaacaggtaaaatgaaggcaagtgcaacaaatgaaacaccatagtgtgatgacagactaacaggtattctcatatgcaaaagcatcgatgctgcataaaaaggatggataattatgtacatgtgaacctaaagtaacaactaattagcaataaggctactttattattattgcagaatagcttcaaacaaattttagttttattacaaacattgaacatggctatataactacatggtttcaaaattcattagaaaacctttaactatacttaaaaatgtaatacacatacagagaaatatcatgagaaacaaatagcatatagaagcaaattagcattcacctgtaccaaagagtaaccaccaggtgtgtatatggctttaaaggactcccatactgacgagccaagccaaaatcacaaattttgagatcacccctattatttagaagcaggtttgaagtctttaaatccctatgaagcacccagttgtcatgaagatacttcacaccttctaaaagctggatcatcaagcacttcgcttcactctggctaaaaggctgcttcattgcctccattagtcctttaaggtcatgttccatatattccatgaccatgaaaatactatcaaggctacttcctaccactacttctttaacgtcaactatggatgggtggtgaaaagaaagaagaatgtttatttccctaagagaagtcagtgggaagccttctttttccttctccatcttgaccttctttaatgctacaatttctccagtctttttatccctagccctatatacaacaccgtatgttccttcatctatcttgttaagtctctcaaactcatcaacacttctacaaccctgaagcatgttgactgctctttgaggttgagcaggaggttctggagtctcctggccatcatcttcatcttcagaatccgtgtctgagtgactgacactggtttcacttttcccaccttgagcatcaatctctgactcaataccaggataatcgtcaccactggaagttctcccacggacacctctttcttcagattcagatgatctggccctagctctttcaataccttctacattagattcctcagggctcaatagcttgttccttagtctaccatccaataactcaggagacaccttcctcctccgtttgggcatttcctcatcattgaggatctcaccctcatcaacaggagagttatctccagctgcccatcttgaggacgatatattgcgagttggaatataatcttcaccttctggatgttcagcttcctgatcattatcccacctccctttcgggggcgatgaatgcaaacctgaaggagagggcaaggtaaccttagatactgcattcaactgaagttcctcagtttccctgttcttgacaggaagtatttcaactccaccatttggaacattcggcgactgcgactgacggaacacctttggcaacggaggtggaggaggagaaggaagcgcccccttcaccacagaagcggaaaccctaactctggatgactcgttgacttccttgtcatcctgatcccatactatgggtgaaaagttccttttcctctccggcgctggtggagaccgagtcctggtttcttccaacatggcaacctcggagtctttcacacccggttctgattcaatagcatcatcagaaccactctcactggaaagttcaccaggctctctatcaactgccttgacagagaaaccacattggcgaggaccaaggccactgctgccagagtcactcctactcgaagaggatcgataaccaccaccattaacaccttccatctctttaatatccttctgcctcaccctaaccctatcccttgacccacccctcaaaccatcaccgccaccattcctaacacgatcgtaatcctctttcgaattcgcgaatccgccgcgtctggaaacttccaacttcgactcgcgctctctgaactcgttttcgcggtaaccgccatgtctgccagccgccatatatttctctatatacctaagtttgtgaattacaaaggaaaaccctaatcccccctttgaaacaatttttttgtatttttgtttaatagagccctaaacccaaaacaaaacgaatccccgagaattcaaaattgaagaacgcaaaagagatctaacggagattggagatgaaaggacaagataaaatcgagaaaatacgaagggggaataaaataggaatttaaagaggggattagaaacccgaaaaaattaggatcaggcgaagaagaagagatagattgatagggcttaccgacgaatgatgaagaaattggatattaaaagggagagaacgagggaggcaacgaaatggaataggcttagcgatgtgatgcggctgcggagaagagagagagagaccccttcgtagagaaagaaaattgggcccaaaagaaacaagggtgacaaaaaacggggatattatcgggacactccgttttttttttttctccaaataagataacctccttttttatttttaaaacatttaacttcgtatgttttaaaacaaaacatcatgatacagtatgggatagtcccatattttattcaatcaattttgatctcctcatattaaaatttgattctaaactttcaaaaataagtgattttaatttaattttaaattttatatacattttatttattttattttgatttaattgaactctaataataacatattcatttaaaatattattagtaaataatataattaaaaatatataaaaatttgaaaaatgaatcaaaattacatattttaaaaaatcatgagactaagtatttttattttaaaatttgatgatgaaaattatatattagatcaaacaggaggacaaaagttgtattatagcctataatcctttaacataattttgaatacattttttattatcaaaataatttcttgaaaattatataaattttgtatttttatcattattatgtgtgtgagaatgtcatttattagttaataactttcactaattattagtatgattatggattttaaatatgtaggcaactagtatgggtacataagtaacataataataaccatctatttctcgtactaaagtttgcttgctggtattggcaggaaaaagccaatgaaatgaatgaatggcattaattagagggagttggtgtatatggggaaaaaaaaaccttttcctcatcctaaaacaaatctgcgcgttcttttttcctcggtggcgtcacgatctgcgcctctccctctcttctttgtggtgtcgcgccgccatcacctccctggccaccatcgttgggcgccgccgccaccaacacattgtgattccacctcgagtgcctccgtagacagctctcagaaaccgtcgcgctccatcaccgacagcctccacaacgcagtattgtttcctaggagatcgtatgcaaccatcatgctaagagcgttgcttgagagaatagtgagagagtcgagaaaccacaccgtttcggcgacgagggaggtgtggttgatatatttgaggccgttccagaagccgtattaatagccgagggaggcgctcatccaggtgcaggtgaacttagcggcggcgcgatggggggtgcggtggcggagagggaggtgctgtaatgggagtagtggaggacctggaggcagttcgtgccggcgatggagcggatgtggttgtttgcggaggcgtccacaatggactgcaccttggatcgcgcgaggaggaggttggaggttgagggtgagggaggagtggcattggagggggaagcacgtggctttacaggcttggtggatctccacggcggagtggggatgggagtggaggaagaagaagaaaatggagatgcgaaagaggaggaaggtgggtttcacaggattgagaccgggaatgggaggaatatgaggattttagttttttatttttttaaataaaataaaaaaagtgacaatttttaacttactatattaaattaattatttcaaatttttaaaagttaacataatgcaatatttcaaaaagtgacaattgtgttttgctcatctatagatatttttatacaaaaattgtaagttaaaatttatcatttaacaaattaaccgaccatattttagatttagttttctgataaattctgaattatttttaagacattactcaaattacaaatctcatcgacaaaaagttgattagtattttaaaaaatataagagttttccttttaccactatagatcttcttactgcacaccaagagagcaagaaaagcatcatgtaacttgcaacattattgaagtagcacaattatgttgggctagactgaaaaggttttatatttcacacaagatattacatatatttggttgcaaaattgctactagcagcaaatggaaggaaacttaaagctgaaagagaaagaagaaggcacatgtcctgtccttcttatatactcaaccctttcagtagtcctcaaagctttgtcattcagcttcacttgtgcattagctcgtttctcttcagctatcctcttagtcgaagccagtttatttgcaaacctttcttgtgccaaagctttcatcctctcagctttcacctagtaattcaaataaacccatttattaaagaatagaaatggtgtcaagcaattttgaataattctgtttttgtttttaacctggaaatctcaaactgaaaacgagtttctaagatctatttaagagattatctcaacaaatgtttctataaaatccttaatcatatgtttagaaggcatgattatttgttaatcatatcacacattacaccaatgtttgttttttgcgtcagacagtaatgatgattctacatacacatcggcagacccaggattgaagaatagggggccaataatcacacaaattttctaaaaatttattttcatttgtcaaatacataaatcaaaataattaaattatacatacaaatatttaaattaattatattttcatttgtataacacatgaaaatataaattatatttacgcatacaatataaattaacacatgaaaataaataaataaagttcattttatgagataaaaacaaataaaactatcaaaacatgcttgttaatattacaatatgaaaaaagggatatgcactaataaactatagaataattttacagttaattacaaattatcatgtataataaatttgttaattttataatgactatcttaaaaattatatatgtttattaagatatgttatacacttctactaataaaagaattccaaaatttcaaaaaagtttaaattgaatgaattttcaaaaaacttatactatatttttataagatatctatttacattcatggaccggagccacaaagagaagcccacaggccacattcgatatttaacaaagcctttaaaataaagtaaaatcttatctaataattaaaaattaacaaaataaatcacttaataattaaaacatttatactaattacaaaaaattaaaaaatgagggggagggggacagtccccccttggttaacacccctgaaaatgcatgtttagtttttaggtaaaaaaaattcttttattttcatttgtataacatttataatttcaatcaaaacggacacaattgcagatgtaaaaactttaaattgtacgattgtatgcagtgaaaagcaactttttcctcaaaccagagccttactcgtgaaagcaatgcatgtctgctacctagaggaggttccatcagtataacataggaactatgaatcagaagagtactggtttgaacctatcaattacagagagtacttactttacttaaaaacccttgtgcaatttcagtggattcatgacaactcgagcgagtttcaaatataaatattttttctattctatattccctgcatcgggaaagaatccaggaagaaatataaaaatgaaagatcaaagatccctgccatgccatggtttcttttcaagaattattctctttgtcagtctatttcacagacctttcaactcttctctactcatgagctttttcccgttgctaacagggcatgaaaagatgagccatcatcttcagccttggaaaaggttaaaatcattgacaacagatcgagggaaaatggttgttgtactactatgccaaactacttttgggagtgccagtttcagaacatcttaataatagtaatatgctacactgtaagaacaagaacaaagcaagtaaagatggtacctccattttcttcatttccatttcagcttttcttatctgatgattttcccaggcttgaatcttcacctcttcacgcttgaacctaaataaagttttaacaagcaaactttgttaacactcaacaatttatcattaattcattgactcctaaggtccatgaaccgtcccataaaactaacctggaacatttttctgaacatgagtacaatttacggcaagtgtttaataattaaaataaactttagtattaacatactagaaaaataaaataaaaaatagtaatgaaataatttatatgtaaaatatgtcactaaaattgatgagtgtcacattttataattctgcactctattttaatttaaatctttcattttatttcactttcacatttatttcattcttttaaactaaacataccattagtgattaccataatcagagaaaaaaacaaattttttgttactaaatttgatcactaattgtttggtttttagtatttgatcataaaacaaggtcaatagcaaattaattacctggccataaatttggcacgttctgcctcatcccaagccattgcacggctttctagaggactaaattttctagcttgatgatcttcatgagtcttcttgcaagggcttgttgatccttgatctccacacttcctattagtgccattgccaccttcagcaacttgttgcaacccattttgacccctcattggagttgaagtccctgaatgaattgggcttctagtagcaggagttgtggctctaattggtgtcccagttcttgaaggctcttggctagcaatcggtgtcatctcagtccccatgtctctgaaacatatcggttgcacttggattgtgtttcctgaagacctattgtcattattattattattgtttctccaatttgactcatcacattctacccttttggcttcagcttcatattgagcagcaatagcattagcactaataatattagtcatgaaatcatggcaagcattattttcctcctcttccttctcactacttgagtaatcatgctccttctgtggcacaggagctatgagtctcaaatcatctgcgtttgagtttcttggcttgcttttggagtggcttttctctccaccttttgacaaccccacaagccatttttgtgcatcatcccacttagaaggggttggttttcccatggttgctcgatgatggtggttggagacacgagtagcatcttttcctttgtgaaaccctgagtacatggcactgctatttggggtctcttgtgttggtccattgttgttatagcaccctttgtcctccacgtatctcattctcaaagatttctctcacaaactcttaactttggcccaaacactacgcagggaaaatttcaggatctacaatttctgttccagatcctatatatggaaaagtcagtatgatctatgttatgtcttgaaatacctgttaacaccgttccatatatctgacgaaaaaaaatacatagtgcactggcatgtatatttaatttgtctttacaaacatgaaaaacagatccaactgccaaaatagctatgtaatgttaactcttgttgattcagcaaggagaccctaatgaactttgacaaatacttcagtctcaagcattaaaaattctgctgaagacctttttactaagctgaaaaagaagaactaaacaaagcctaatgtgcaatgtttgaaagcaaaatacactcactcattgagttaaaactttggaatctaaggttgttaagtgctttggaaatgtagtgagaggaattaaaacagagtaactgaagctgaaaatgtagttcacagagtaaagcttggtatttaagagaatgataccttatttcagagcatgaaattctgagagttgcagaggcagagatgaatttcagatccattgaacattataatactacccaaataatatgcatggtttcagaaaaaaggtttatcgttacgacaacaataaataaaaaatggtcagagggaagaaacatagatgcatagaatagccatttatcttgggcattggtggacttttattactgaacaatgcaggtgccatgtggggtggaatccacatttcatcttcaatgtaaggtggcagaggaatcatggaagtagtattttggcagagaatgactaagcaatatactatcatagattttttcctaactattctgcatttgagataaagttatatttaaaattaaaaaattattaagaaaataatatttgatcttaagtctttaatttactgtatctctaaatatttattattttatcatgatagtattaaaaaaaatattatttttaattctatataggcaaaacgaatattattaatacttgtaagaaagacttaacacaaggcgtataaaattcagctacggaaatttatctttaattattatttttttataatattctcatttattgatatattaatattacttacatacttaaatgaaatttgtaattgcattttaacttttttaatatgaatattttataaaaaattatattaattataatttataggtttaatattcattatatttataattatgttattttagtatattaaaatttaaaaattttattttgatcatttatttttttaaaatatatttttttaatctttttgctaattttacaataaaaatgtcacattttaaataattaatctaatataatcatttttaatcatcattatcttaaattaactatttaaatttttaaacaataatgaagagtaatgtttctaactgaaaaaaaagacaataatacattttgaaaacataaaaaaataaaagaaagaataatatttttaattagggtaaaaaatgatgataaataatgcgacagcaggattatttttggattgaagtgtccatgagatgtccactatgaagaaaaataatatagtactgtttcctagagacagcatgttaaaactttggttgtcctattaacggctactagattgagaaaaaataatataaaagggagacacgtggacggtgggatgtttgcaagaacatagacgaactgtgatactcctgattcctgaccttttcagttttcacgtgcccatgagagagagagccgtgcttccgaagatacggacagtttcataaatttgattgtttccacatgggtccatcttcaccaaaaactatcttatgccattccactcacaattactatcaatagataaataactcaccaggtgcaaagttaagtgtttgatgaatcactatgatttattcttataaaagatatgtctgtgggttgagaatagagatgatatttataagtaatctttagttttgactcttgactaatgtgagatttaatgactataacaacatattcgaataagatttaattgtgagaagagatcaataatattagttacattttaaaatcattaattatttttcttttgaaaaaactgattaagatattttaaagttactctcaaaatatcaaaacttggtaagtgagtgtaagttttaaatcacatggtgcaatgtgaagaattggaatagtatgggaccatatctgccatctgggaagtaccaactgacagaactggcatacaaacaaggaaatttcctctgctagaagaggaaacaagatggctctgtttatttacccatgcttgctccattcccccaacccaacaaacttagtggatttattttaagagtattaattaactgttctattctttctttctagtatctacgggactctgaaaggggttgcgagtggatcgtcattgtgttgtctagttggcgtgtgaagatagtaatgaattaacaaaataacaactaattagctactgttaagagaccgtatctaaagagaaggaacgttagtatacatacaagtgtatgagaggcagaatggaacgtaggtgataaaggtgttttaatgatccaattcaatttcaattacaacatccaatctaaaaaatataaccaaaacactgcaaaataaatgtttgaaaaaatgttgggttgatcttaacccatgttttttttttcaatccacaagtatatttcctttttggcttgaaaaagtgtgaaagaatgttccatgtctaaacatgtactaaatgtgtttggaaatatgtcatgaatgcaagtctagttaaatttttacgtcaacaacaacgcagaagtcagctactcattgtagcttctgccttaatgtagattgtggatatgatgttaggatgtgtttccaaacatatagtaagaaaaatttaaaatctgcataaaatccaatatttttttggataatataaatggaataaaattattatacacttattaacattaaaattactttgtcgcccttgttgatatgatgcgctccatatttgcaatgtaaatatgtttttatccaaacaaaattatttttatattgtttcgtattttcaatctcaatttgtaatattaagggagtctatataaattagttgactaagaagtatgagttattataaattcttaatatttatatttgaaacatatagataaaaaatctgaatttataatgtatataactatgattttattcataatttttaatcgtaaattagtgaaaaacaaacaaagttacgactgacaaaagttaagaattgatgtgaaatttttaatttttttatttgatttactagttatatcattgttttataatttactttattatttaaaatgctcatttgttatatcttatttgattgacaagtttaatatttataagtttttaaaaaattgaaaattaatccaaaccaaatcgacttaaattggattggataagatttggagaataaaaattcaaaacgaatggatgattaaacttaaaaatgattggatcatatgattcttttacctaaaaaatgttccaatccaaataagaaaacctttcgtttgattattttaacatttgtcttagttttttctccataatcatttgttgggtggtaaattgtctttgacctgaaaaaatgatccgagttctgatcaattgcatcgccctttcctctgaaaaagttgtcttagattgtgatgcagaacaaaatagacaccaactgaagggtcctcaataagaaaatatgatggcatgattggtgactatagaagtgccaaaatgttggccgaaacagcaaagtaaatgagtaagaaaaacaacaaaaagaaaattattagggaaacggataagatctaaaatgattggatccttatagatgagatatttatattcctttgagcataacaaaattggaagtatgagatgctatcaacaattatctccttcacatacattgatggagagatccgatcgagatccaagttgtgaagtacggtggttgagaaatttatggaatggaattatagcaagagaaaataattgaatggtaagtgtaccctggtgctgtagtctgtttgagatgaattagcaaaatttgactttgagggagaggatgagttccttatctggtggaaggtgcagtagttacaaccggtgactatgacaactttattactcatttaaaggttcagttaatattaggtgaacgcaatatgaaatttggacttgatatgatttgttagggattttttttctttattcgtagtttttgaaagcaatatattttaaaaaataaattttctaaaatgactcagattaaaataaaaaccttaaatatgttcttatttatgatatatacttgaattttgcttttaattcttgatataaaaatttattcttaagtattgttttagattcttacattagttaattgatgacgtaaaatatttgataatgagatttgtgacgactaaaaactaatacgattattttaaaatcaaatttaaattttaaaaaaaactgtcataatgaattaaagtaaaaaataaattttaattgaagaaaaaaattagagttgaaataaggatgttaagatagatgtatggataagataaaaaattgagatattcagaaaaagatataaatgatatctatatgtgaaaagatgaaagaacagacattgatcgaaacttacatgaaaaataatagttaaacaagacctaatggaatgaaatatagattgataaagagtatatcttagaacagagtagaaaaaagttataaacttagtagaggaataaacccattaacagattcccattatttctttattttaattattttcttcttcttttttcccttttgtcttatttcaacttttttttttcacttctctttctctttcaatctcttttatgatttatcattgaattcatatatcactaatttcatttaacttgaattaaagatgttattgatgttaaaaaaaaaaaaccagatttgaaaccaagcgaaccagaactaccaaaatattgtcgcaatcaatcatattagactcaagtttctcctcacaaaccaaaatcttaatcaaatcaaatacaacaacaaatcataaaaaatattgtcgcaaaacctagaacagagaaaccattaattctacaacattttcaccatgcagaatgtggaccaaggacaaaaatggggacgaagggcaccgtttggcgaaaatggtgatgaacaaatcaagatgagttcgacctcctcactgacattgcaaacgatggtagtggagacgtagaagaatcaacgaacgtctacctggactgggcggtaggggcgacggtgaggacgtcgtgcacggaggagttgcgagatcgagagagcgtctggaaccacaaacgcaccataccacaaaagctccaaatttttatatctaagttagatctagattgtgacgaaaggaggtggagtcagatctatggggtttcgagtgagaatgaaataaatgttaaggttgccagttgtcggtgataacaagagttgcgatggttgtcgcggaggtgcggtggttcgcaaggtagagaagaacacgatcaatttgcttccaccagagtcttcatgtcatagatctcacatcaccagaactttcgattgttggtggtgctatattgggttcagtggtgtcgctggggttgcaatgtgtggggtggcaggtttggatgtgggtatgtgttttgttggagtggagacaatggaataggaggtgggtcagcttaggacttttttttaatatatttatttgtttattttaattaattttggcagtttttaattataaaaatattgaatttgattttaaaataaatattgaaagattatgttatcaaataaatatttaatagatgcgtcattatttaaatgacagatattttaaaacaatttttttttttgtatcaaagaacagttgaaaggagtttttttttatcaaaaatcaaacataaaatttggatatatatcataaagattggatgacccctgatccaaatttgtcagatggtaaactcaatcaattctagacggctaaagggtatctttaccaacaaaattcttaagctcttcctttgctgcttccatcaccaccttaaagtctatatgcgtataccttcccctgtaatccataataaaatgttcaggtttagcactttgttctaaagaattatttaaaacctgcacaccataaaaaacaaaaataggagggggaaaatatgaaaggaacggttgctgctcactagattttcctcctctttttgtttcccaaacaaaagctaaaagttttgggacagcaaatcatgactaatgttggtctattgagatattgacgcatgtgtgtacacaattctaactaactaaacgcacaacagttcaaactcacccaatttatttcctattttcgagcagtattaaggtcatgaagtagaaaaaattgaatttcaatgtaccagaaatgagttttactccatgctgttgaaggataagctggacttgcaattccatgcattaccctcgcaacagctcttggtgtaaatcgagcctgtgaattgctctgcagaaagacctggtgatacccaaaggaactgttaagatttcaaaactttttcttccaatttttttttaagattattagaatgctcaaatgacagcttacctttagatctgcccgcaggaaagggctgcatatgtaaataccaccaattttagtacaagaaaatgtagcatataagtcataggttaaatttttgttctatagtacagagcttagctcaaagaaattagaaataacctgctttgaccgattttcttgcagaaatcagcattatcaactccagaaaagtaatccaatattttcctttgcaagcatggtgtatgattggcaccactgcaaccttgcatattatcacatatatttaatgcaaaatatgcagcattaaacattgcatccatttttcgtacctactcaaaaaatagaaccatgagaaaatgaatcaatcattgataacttggacatcaaatttgactacccaaacccaatggatgcaacgtttcatctaaaacgaatgatccgacaagtactaactcaaggttcagggtttctgattatgagaggaatacgggacaatgtcataacaacattacatttcaatttttgaacccccaaaaggaaaacaattgagcaaaggatacaacattctagatgaacatatttaaaaaaaatcccaaataaataaacatctcccaagtttatcagaatttacttaccttacaattttcaacttctgataaccatcgcgtaatatctgctgatagagataacaggtctgttgggacttcaatgatcctataacagtaggccaagtccttcatttcataagttatttctcccatcaactgagaacatttcaaaaataatgaggtcagattgtatttatattattgcttcagtaccacacacaagggtagagagccatgtgcctatgccaaatggttaggtgtcccaaatcagaatcagattagaagcatattttgaataaaaaattatgggcaagattaatctcaataaaaaaaaagaatgcactactcggctaaacctttccagatcataacaaaatatacagcttcagtgtattgattaatgaacgtatcatgtattgtgccgaaaattttcaagacaaggaaaactagcagagttttaagatgattacgataatcaatacataaatcacgttgtaagtatttatggctataatattataaatctaaaaaatataataactttgtttttctttcaatcacattcatcagtatgtaccatgagtactgttggctaattggaggtttaatgcagtggcaagtatcggaagcatttgtcctttggactactattcagaatctaaacttggtaactacattattgtattcattcccagtttcatttgaaaattttaagaatgacatagtgatatgaagatgtttcccatatcaaccttcaatcatagcatctgacatcttcccttgaagtgtagttactcagaagaaagaagacttgtgcacttttgaaacatatttgttaagcacacatgcgaactcaagaaaaaaatatatcccctaatccaaaccttcaggttgtacaactgatttgttaattccactgctgtaacccccatgtcatttgccacagttggaatatcaaaaatatattgcccatgcttgttttcagatctgaaaaatcacacaacaaagattcaattaaacagaagtatgagtgtaagtagaattaaacggcttttctatataacttcactttatagaaactaaaaatttggagccagactccatgttgaggtttacaacattaacataactcagttggaaaacagtaccatccagtggaaacagggggaaaggtgaaaggccaagaaatgtaatatgcttactattattacctttttagaattacagctatagcagaaaccttctgagcaagtaatggcggaggagactgcaatagtgccaaaagttaaaaatacaagcaactaaataattacggaaaccatatttagtttctagatttcagttaaaaattaacaaatagtagtataagattgagatgtcctatctgaaaattcaagtttaaatatatagatttagagagatggcactcaaatttatctatcttgcgtggcaaattctacatgcaaaggtgagtctggcacccaccttgtgaaaattcaaagtgcaagttatatttatctgtggatgtaactgcaggtactgtacatcacccaactccaagcgtgtcaaaagtgtaagcatcacctggtaaaggaaaatataggagaaatattttaaactgtagacctagactaaaataggcaacgtatgattatcttgagtttccttacaggaacatgtttcatttctagcatgttaaatctcatacaaatggatagagattagtgacccctatatctagatgattgtccaaaaagaaaagaatcttaatcactggaaagaatcccaccttagctttatctggttcaaagttaatcttgatctctttggtttcaagtacttagcaaagaaagataaaacaaaaccagattttttgtacaaacacagatatcatctacaatcaatatggcaaaaaatggcattttggcatagcatgcatatcctacagatatcatcctaatgacaaaaacttgggagctatccccccagcccctctttatttatcatcaaaatatcaagagaatgttatgaaatctgtctgaaattttaattgaaagttatttgtctgagaaattagacttaataaattaaaatgaatagtagtacagagtagaggacctcttctttcatatcaaacctgcgtgcagcagattctttgattaatgaacagattttcccacagtagtttttgtcagcaggaaacacttcacgcagaaatttgttcactgcatattcatccactccttcactgaggataaaaaaaatgcattaagaacattttgacagtgagaaaaagttaaaaataaaaaaagaatcgtattacctgtgtgttagactacgaagtttgaaatatatctcatcatcataaaatagatgacagtaggacaacctcccatcccttccagcacgacctatttcctaaaataccaattccctttattaagcaaagcatatgatagaatatcttgctatgctactactaaagtttagaagaaatcatatacctgtacatactcttccagactttcaggcaaactgtaatgaattacctaaacacagatatgataatggagttccagtatgaattactgtaatatgcaagataacttatattgcaatacaaatatgtagtgtgtaaaatacaagagaaaagtatacaagtaatgctcaaaaacttcattttttgaatattgaactattaactaaagtaactaccagtgcatttgcatgaacagagaccagggaaagagattagatgtccaagaccatgcgtccccattttgggattttaagcataaataaaaatcttttgaagaagaatcagttgttcctgatagagtcaggcttcaaaggtttgaatcataagacacatggaaaagcaggttaccatgcaacaagagcacaatgagaatcagtaaaccactatatgagcataccatcctagggaacttctattgtcataaaccagttcatgcaaattaatgcagaaaaccataacatgttgataagccttacagctccaacatctcttttatctagtcccatgccaaatgccactgttgcaacaaccttcataaaaaaatacaaggtatcagttggctaaaaaataaaacaagcaaacacaaagaatactagtatattatccctgcattgcatggtaaaataattaaaagttgctaaattttatatatagttgactgtataaaaaaatgcgtgtcataaattcacaatattaatgattgaaccatagaatttgtctcaccactctgatcttgttggaattaaacaactcctgtacatagctacgttcctttgcagtgataccactatgataactctacatggtaaatcacatcaatcatcagatttaaccctcagtgtcaaatatacagaaagacatacaatgtcaaaaaaaaaaattcggagctaacctttgccaagatattgttatcattcaaatatctgctaatttgatcagtttcatactggaacaagaagaagcatcattaattcccaccaatatagaaacgttacaatagattcaattatccactatataaaaccacattttaaatctgagccataaggatctcactaaattttttcagccaacaatattatacatatcaaatgctctgagctagaagcaagaatatattgcaatacaataacagttgagtttaagaaaccatagaacatcctgtactttaaagttgacaaaaaccagtccatatacacacctgaaatttgcagtatatgatgatgctttgaacttcaacaaaaggaggagactttatcaaattcagtaggtctttcattctatcatgatcaaaatgttcaacgtatataagttcattgatgtataagtttaacaaagttgaaatgacaaaagtatacaagctgaagcagtaaatagaagcatgtgacttgcctatttctgaccatggatactgataaatgaaaattgtcccttaactgcgccttctgaataagatttgtggaaggaatatctagagcagacatgatggcatctaaagttgtggttgtagcagttgccgtcatagcaagcacagaacgaacattaagtgtcttatgaagcagagatgctctaagtctcataaaagatggtcggaaattgtgagacctgtaaaaatgttcaaaatttcaagatcaaccaaaaagcagattaatatcagcaaaaaacattggaattccctcaccattcagatatacaatgtgcttcatcaataacaacaagtgagatggctggcaaagaagaaatagtagacagaaagtcctcattcagaaaccgctctggtgaaacaaaaagcacctatataaattaaaatttccaacattagcattagctttatgcaagagtactaccatcacccacagataaacctagaaacacaacatgtcatacaacaatgtcatgtaaacaatcaactccattgtatgcaaacaatctgcaagagtgctacacaatttgagccaaagttgcattcggaaattcagttgttgaaagtcctacctttatccccccttgacgaagctgcttgagtgattcagaggcttcttcaggtgtctaacataagtagacataaaaagatgaattaaacatgaagaggtgaaatgatgatatcctgtataacaataagcacttataggactataccactcgctaagatgctaactagtctctcatccaaaatccatttaagttttaaaaattattttcaaaacaagtgtttagatgttttctattttattctattttcatcttattcaacatctcccttaatttcagtgtctgttttgtacctttccaccagttgtccttgttatagttgtattttgaaaattaaagacagtttttgaaaatagaaatcaaatacaccctaaagttctcccataaattaaaaattaacttatgcataagctaaaatcagtttttgaataagttaaatgaaagagtctcaataaaagttaaagtcaataagttgattttaccttatgtgaaaaccttaattcgttttacccttttattattatttttttctcttacaagtgtttattgagaattttatcctatcaaaatcaattaaccaaagtatataataacactgcacaagggagaatgtataagagtttacaacacctgagtgctggatagaagaccacccttaatcacatgaggcaattgccttagctgatcaatcatcaaagccaccaatggactaacaaccaacgtaaccccaggtaagatcacagcaggcaactgataacacagcgacttcccagcgccggttggcaaaacaaccacactagacttcccagcaagaaccatcttaatcgcctgaacctgcccatctcgaaaacaatcatagccataaaccaatctcaacagcttcaccaaattctcctccgaaggctcgtcacgtgcggcggccgcagcctcctccaccgcatcgccatcgatctccctactcttactaccccctctctgcttgaattctccaattgcctcctcttgctcctcctcctcctcctttttgggctgcgatttgaacctccctctcttgtaccttttcccgccaattttccctctcttgttcaggaacttctttctcttgccattcaagttgagcttcacgaagttcccatcgcctgctccgcttgttcgcggcttcacgctcggtatcggagcactggagccgatcaggttgggaagctggctctttctgcgtttcctcgggtcggcactctcggcgcgtgaatcagacacgccggaagtaaaaaccggttgttcgatttcagaaggttctagattgaggagaggtcttcgaatcttcgagaaggaagcggagagggaggaggagaagtagccggcagggagggtttcaatggagtttgaaatcgacggagcgtcggaaggtcgccggatttggaaggggagatcggtggggagggagagaagggtgccttgctggaatgggtcgggtttggacagggttttggaggatccggtagggttcggttttgattttgattttgaaggtttgattctgattctggatttgtttgaaactactacaggtggtgatggaattggttttcttggaggagtagtggagatgtgagatccgtcggagtctgaatcggactccatttggattctcttggatcggaacacgaaaatgaagaatggggaaggaaaacaaaagaagatcactgaataaaagctagctcccgccaacgcgaatgttcccgccagttttgtattttgtttttttaattgttcgagctcgggttttgggcctattggccctaatcgggtcttaaggtcaccattacaggcacaggctacggtggtcacttaaattccttgtgttttgtggtcaagtttaaggatggccgttagatttatgtttttttatattcgaagactagatttagtccatggacgtgtgtaccagttatttgttttttttaatgattgtgtgataatttacatgtttggccttgttaattattatatatttttaatacaaaatctgaatgtaattgttaagtcaaatttacccattgttgattgaatggtgattttttttatttattaattattgaaaattaaatgtttaagttgtgttcgttaagaatactgatgtagttgagagtgttgatattggtggcggtgcaatgaatgtgatgtaatgaccattttagatcaacacgtatatgggctttacaagaaaaacaaatctttaaaaaaaagaaaagattttcccacttggaagaaaatttgagattttaaaatgttaagattttactaagaattttttctaacttctcattttattactaacaatattatataatggtatttattaaaggcctaagatcttatctagtaacatttgtttggagaggatccatcttaaaaggaaataaacacaagaaaaaagagacattgatcgatatactaaataatgtaacaataaaagaataaaaattgagatggggataagatggaagagaagttggatatataacaataacaataatccagagttattaaatcgcctattatccatcatgtcacaaaagacgatttccttttagccaataaataaatgaaaaatgtttgtttgcggaaattcatgtagtatgaaaagtgttatacagataaatgactcctgattaatagaatagcagaaacaacgcatgtactgataaaaaaaaaacacgtgaaaaatgttctcaactccgaactatgacactacaaatcgaaatgcatgtttgaatggtatcataataaaaaacagcaacaacaaaacaagaacaagcacaaaactaaaggggctgacctcccaagtcgatactcagaatcaccaccttcgatttcctacaacttgaaagacgcctctatttcaacccaatcaacatgacggagtactagaaacgccaacaatcaaccttcttcaacgaaattaatcttcaaaacagaaccctacaaagacaacatagggcttatctttctgcctggaagggcaaaacagtatctcaagttcgtaaaggacattctcgtctttctatgttaacttaaatataaaaaattaaatttttaaatacggacccacttactatacccagtttgtatttccttgaccacaaaggaacttaggtgactacattgataaagaatatttatcaattttattaataattaatttttattgaagaatttgattaatcatttttaataagattttttttttacaatcatattttttttatttacaagacttaaatccgacagtttacttaagataactaaatcgattacctctccacaatgacttgttggtttgattgcagctttagattgtgttatttgataacaataaaaaaaaaaaacttgtttttgcatggttccatttggtctgcaaccgaaaaagcttttggtgggtttagggttgctgcaatggacttatcccttgttttagctgaaaaaatagttgcaaaataagctgattgatgaaagaagagagggaaatgtagcttttaaaaatgtattgtatactttaacagtttaagtgtttaacctctttctctcatcttaaactaatctaaagagttttaatttaaaaaattgtcatacattttctacttcatttttatatttcttattttaaaccttaactttaaaacaaattttaagctaaaaaaaatactaggccaaacatatcgcatgccatatcatttaatttttcctatattataaatcggaattctcttatttgaataagaatgtttttagaaattattctcactctcattatcataaaattatatctcaaaaacttaaccagaagcatttcaaaaatataccatcaacaatagttaacgttagctagtacccaactcctattttccccggtggaaaaacaaagtcaacccaatttaattcacactgatatgttatttcattcatatttttcttttctttctattgcttttttataacaggggaggaatgatgcacatgaataaacttctagcaaagaaatcagaatgcgtttcacaatattaacgaatatgaatgagttatacttcacacttccattgatggatcatcatctcaatggaaatcaaataacaagaatggagcaacttgaggagcacaatcctccaattgcctcaaattaatggcctacccacaaaaaaagaaggggaaaaaaaaaataactttacaattatgttaaacacaaagttgcatatcttacgatatatattggagccgacaaataacaattggctattatcccaaacagccataaacctaaagccatgcgcaagcatttggctaagctctgctctggtgtatatataggccaacgagaagagaagaaatgctggcacaaattataagggcaatttaaactttgaactctcacattatgatgcaattacactttgattcaagcttatctggaagaggcttcatgttgtctactttgttaggaagcccaacattgagtgtcgaagactcggcaatattttcatcattctcagccttggaaggggattttacattagtttccaccatcttgggccttgccgccttctggggtttcatagcatgcttgccagcagttcggctgcaagagtcctttgtatcggaattgggtttcgccaatatagtcaccgtcggctcagaaccttccaatggttctgagtgctccttttccattgctatcgttgcagcctgatatgcaagatcatggatgacagagctgcaaaaaagtatagtatttgttgcctcttcaagtgtcaggcttctagtatttcctctatcttgacactccaacgtaactgtggatctctctggcataaaccattagaaatctgtcagaaatttgccaagtactaatattttctccaaataaagctttagcggataaaatatattacaagcactaaagaaaccatgtacaacatagagaagcagaatctcttttcaatagaaaactgaagcgaacttatcctcccccactaataataaagtatctgatcagatttcagaaagctcataaaaagatagcaaaatacagccacaatgttagtagtataaaacacacaggttcctgtttacaagtgccctaagggcactggttatggaatcaataaataaaatgtttttttattgaatattacctaaggttgcattgggaatcatgggggaatgcattgttacactttctaataaagaaattgactactgattccttaaccagctcccttggttagcgtttgccaaacaaaaaagttaatccaaacacaatttttaactgataagctagaaactacactactaaattgatgctgactatcttattcaacataacgatatcctaacacatcaggcacttcactcaagagtattatccctgttataaaaaatatgtcaagaaaaaacctttcaaggcatcctaacctactctcttagaaatcaaaactacaaaatttgagtagatcaaactattaatatcagatagagcaggagaacctagaatagacagtcattctataaatttatgtatccctttaaattgccaaaaattaacatatgacaaactgtgtgtgctatggacgagtgcattgagtgatacaagagaataatagaagattcttatagaaaattttcatctcaatcatcattggcaatatcttctgtttgaaatttcatccaacaagcatcatacctatgccaagggagtactcggaggcatggagctcagaaatagaagctgcaagacaatcactggaagaattaggaacagaatgttcctgaaagtcatcaatggggctctttgacaccagcgatggatcaacatccaccacacaagtatccttctgacaacagttttccacttctatttctgattcttcaattgtagaagtgttgatagttaccaaagcatccagtccatcaacattagaattctccatatcatgtttcttgtcaaaggatgactctggatccttaactgatgtttccatatttaagacactgcttacattatttgggtggtcttcagtactatcatttgaaatagaactcccatgatttggaaatgatgacactgaattgtcgccatgctgaacaccagtagcttggcttactaactctgagctccaagcatcagttgttctaactaccccaatcatgatattcaagattatcttccctgacaacaattgaacccatattggaagaatcaatcacatctgtcactgcattttctgaagcttgcatttctagtagatcttgaggtattttcttcaggatgctgcattctgtattgccagaactttcttgtgtagcaaaacctaatccatggtaagaatggtttgacattcgagaaaaagataaaccagggcttggaggcctgatcctaacatcatatccatagtctacatacaatttcctgccacttgactgcctttggacatgaaaatcagattgtcttgctgagctaaaatcggcagatgatgaggtagaataactgctacgcccagttgagcttctaatactgttaatgcttcttcttgcaaaagacagatcatcgtaagatagcgtcgtggcagtaaaagtccggctctgaattacatgtcctttgctactgcttgaccttttcaatagttcagaaatgccagtgccttccaagaggtccactttcaaatttgagcgatcgttggaaagatacaactgctgatcaccagaatcattatcaggcttcttgtaatcaacccctgactggtccacctcaagctgattggcaggcatctgcccacttctctccaccagtgaactggagagagaattttgttgtgagtggtcctgaataaattcactgggaaaaatttgactttccacagcatctggttcagcaaggggaaaccttgtgttacccacatcagtctcttgacgcagtttagacacaagagttagttggtctgtttcggctgatggtttttcttctgcagggatgttagtggaattcactgaattgtcactggaaacttccaaatttgcctccgggatgacatgtctcaacaatgtggttttcctgctacattctggacacagtctaagattcttctcagtttgatctgtggcctcaagagggaaaccacaatgggaacaaattgtattctcgaaaccaccagtttcagaaatgtcacctatgacattgaaagttgctaaactttcattgaattctttgtcaataccatgattagaagaagcttcagattcagtaggacctaaagcaatcacagggcctctagttttggtgtgcaggatgtcagctgattcatcattgatctcatgcccaatgtttgtatttaatccatcaattttatcaaaggaacatacttcttcacaaatatcagtgtataatatcttctcagtcgcacgtgccacatcttcttgattgtggtcactcccttcagtatctggcgcaaaacttgtaccatgatcagagctcacattgctgcttgttgtgacagaggagttcctagataccagggaacgttgtgcagaatttgcttttccaacatagaaggttgtacttggcacactagataaaagaggcctgaacatgttctgaggactttttctatcctgcatagcattgtgagtaagaactaagaagtttgattccaaccaactatttgaagacataagagaaaaagatcagggcaaaaggtgaggggaatagggatgactgaacaagtttttacaagaaaaactcatgactaagaacagaaaatgtgttaaccttgttatgataaattgataatcatgtaagtgtgtgcatgtgattttatatgtagcacaataagcaaactcattcatgactttattgaagccatttatttgaataattgtcttctcatgtgtagtttaaaaataaacttactgaggaaagaaaacatgcacacaagaggaaccaaataaagcattgtacttaaaaaagattataaagagagaaataaaccaaatatcatatcagagttttgatcattggtagcctagaataatctaggatggttggttcacaccactttccattgtagactgctttgatttcaacagaaaaacaatgttctaatttattagcatatatcaaaaggaaagtgcataaaggaagaaaattgtgtgcacggcatgcatgtgcagggccagctccacatatttttaggcttaaaacaaattttgatatagccaacttaggaacatcttatgggctaaatttggtgagaattgatatattaagaaactatctatttaattgaaattaatgaataattaatttttaagtgagacagtaacaaaaaattaaggacctaaaaaaaagtaatttttcttccaacagggttcgaacccattcaccaaggacaaaagtgcaccttaattaccactaaactagaccaactagcaataaaaattataaatactaatactaaacaactttttttctgaagggcctaaaaaaggacttggcccgccttatgcttgggccgtatctgctcatgtgtgtgtggaaaatgagtgaaaaagagtccttggaagaggaagggcaactaccaaataggaatattcaagatttatatggtatgatcacttgccagcacattagcagcaaactatggaatgattatgaaaggaagttaagagattatgcaacaaaataccatttgctggatagcagaatcaaaagatcttttaggagcagaacttggggacaccatcctggtcgacttcttggaaattgaaggagatttgctgtttgaaaatgaaccatcccttcttgaaccaaatcggtctagactacccactgggatggactgaagagagtccagatcatcatcactagaagatacaactgaacctttgctgtgtgaactaaattggtctcgatcatgactacgaatataactggtgctcctggaaggagttggagacattgattgcctaccaaatttagaagtagaatccctactatttttggatgctggagatgaacctctcacatatgatgctggttgatcagccaaagaggtacggagattgagaggagcttcagaagagaaaccaggaatattagtttgccatgctcttatatttggtgaagcagagtttccacggcttgtcttaacaggggaagttaccctaatccccaatgagaatgcaggactactggagccagtgctgattcgctgaggagtaggagtggaaggcctaggagcaggtgtcataggcttagttggaggtggagatggtcttcttgttggagtagcatatcgtaaaacttgagttggactaaaatttggtgttgatgaagaccttcccctagattgcgatatattattcccagaacgaggggatgaacttaaacgacttggacttgcactacccctactgcttttgtaacttctctctgtctgaaagaggacatccaacaaaagatagataatgagtcaaacaaaaactaaatttttcataaagaggagaaaaagacaaggaatttttatttaagaggcatttgtgcataaaatggatttgaaagcacaccgtagatgatcttgatatggaaataggtttactccttggccttcctctgcttacaacatttatttctggtggttcatcatctaaagaaggaaacagtggtgtgtccggtggtgtcaataacctttcaatgattaaaacagaaatgctgcatcagcaaagtaatatgcacatctaattctcaacctttgcgaaaaagaaaaatgaattattgaccagacaaaatggtgcactattaatgtgaaagaaacataattgcaaacagttggacttgaaatcattaaatttgatcatacaacacaaacgcaatttaacaaggaaaaattcaaaagacagaaaaggctacacaccaatcatagtcattcttgtcaccatctgtattaagcaattcactggtttctcctcgaccgggaatggatatcccaagcttgatatcaggaaaatctctcaacttcgatgctgtaaattaatatccaaaacaaaggggagaaatgcatgagtatcacccaaataaagcaaaaaaaaaaaattacattctcttctcaagatgagagtaaaaaaattacaaattgagtcttctaagtcatccgatggctgaagcaaaaaactctcttcttctctggactgcatttcactgaacaaagcaagatcatcatctttctctctcaagggcaatccgctttcaagactgcgcccgcgcttgtgactgtctgatcttggctctctgccgggagagcttctaaatgatagggaaggtggcatctccactacccaatgcagtgtccaataacaagtgtcacctcaagttctccatacaatccaaaggcaaaaaccttcaacaccctaaccaacaaccaatgattattaacacataccacaagctcacgacaaaattcaatctccaaacaacaatatcagcaaaacccactttccttcgccataaactctctcctccggtttcattactccttgtctaaacacttataccatacccaatgtgactgagtcaaccaacccacataccccaaaataaacaaaacaaaatttggcatattaaaacagtaacaaaaacaactgtaccattcaaaacgcaatggctaacactcctgagcactcatgcaataagcatccaaaaccaatattgaagatacccctcaacctgaaacccaagaacatttgccagtagcaaatcccaattacgccgttgccattaccggccaaaagggtagcccattcaaacggcaaaatttaggcttgagcacccacttagccaagttcaaggcacacagctaaacttggttcaccaaattctcacccaagttcgaagattaaaaaacaaaaaataaaaataaaaacaaaaacaaaaaaatagagcttaaatgccaattacaatgcgacgaatgttgtctcagacacccggttatacagcagcattcatggcttccagagcaaccaaaagtacagatcagaaccagtgtgatccaacggttccaacaaactctaaaaaaattccattattctctctcctcacaaaatcttttttttttttcagttctgaaaaaataagaatattgcactgcaatttgagaataacaatattaatactcaagtactcaacgaaaacctttgttgttgtccttcgataatttcatttgttgttttttcctaaacagcaagcattctttccctttattttttttttctctcttaaccttttcttttcagcttccttttcatttttttcctgcggttaccggtgccctcgtaaattccctatgatttccattttttttaaatcttgttttctagttttcataattttgtgtttgcgtataagaattaaaatgctaattagtcgattttgatgttttggattttacttctacttgttattatagcttatgaactgttttctacctttttgattgccaacataaatgggattgaaatttcaatgagatattaatcaatattcataattgtgctggtcgaaggttatgttatgtgctgtgtgaatactccgttaatgcttacggtgttactactaatattactagtacattgaagccaagtttggacttttggacccttcatctcgtgaacgccacaagtaatattaatggcgttggaatttattggggtcaatttttgggactaagctattaaatttcttatcacactcagtaaatgtacgtcacatagatccgtagagcaaccaatatgttttgacttgttgaataccctaaaaggagtactatactagtagtaaaattcttctaaatttcaacttctaaccaatggacaaaataatggggttttataaagattcgtctatttagcattagcataatttataacaatcttaagacgctgcaaaagacacccaatatgtgtataataaagtccatctcacgaggactgaaccatcacgatcaggggtatcattttggtgaggttggcattttaaacaagttgatatgtcctaattagtttttttgtggcctaaggtttctatcttattttataaaatagtgcgtgaattggtgacaaacgaaaaggccaagaaagaaaaaacttgagaggaaaggaatgaagacagaaaagagttgtgtggggcaacgtaggatgaagtcaacttaactgagttatcattaaccatagctagctgagtacactaatgcgaagattgtcgaatcatgtcactttaattggtaggtgatgaagattaccaaacactaatgatttgttttatgcctctatctcgtgtttggtcctaaacacactttcccaagcctcgtttaactctgccaacggtcgtggacatttgtttttccatcaaatacaatacaatagggcagagaaaacaagaggcgaatgcacaatattcaccttttcaaaggggagcttatctatgctataaactactgtactagtgagaaattgagataaatgcataaaaaattatattcgattctcattttcgttatggtataaattattttttttttcccttttgttgaggtgtgagtaaatttttccaagtctgagaaagagaaagcctatgtcatattattgaatgtcattcgatttgtaatcataacaaaaggtctataatgataacaaattttagtaagagttatggaataaaagatcgtttttgattgatgggtcgatcaatggtattttgtggctaaatcgagagcaattacttatatgttaatttagtgatgatttgagtgcaatgatccatatattgatattagaatcaagtgcagatattgtttggagaagtttgaaggacattcgaatgcatgttgaaatgaagacttgattgtcaatttgaaagaagtttgttagaggttaaatattcgtttcgaatggatgattgaaacattgaaattgaataggagatttggaggatgaaatacttagaaaatttcgaagtattgatgtttgaaggtaaattcatttgtgaggaatattctttaaagatgtagaagattcaaagaccaatgaactcatactaaagacatgtgactctcaaacatacatataaaaacaactattagcaatttgtggataaaagtaacgtagaagacaaaaacaacatcttaaataatctattcaaataaattattcacatgtttatctaatataactgttatatcaataaacttataaataaacataataatagtcattttttcttaattaattacaaagattatacaagttttgcatacaccatcatgcaaggaaattactatcaattataggaataatgtgtaagtttgaacaacatttcttctctaaacttacttttttatttcattttcactttacttttcgttcactttacatttcgtttacttttcattgcatttaaactttatatttccttttgttttcgtatttgcattcttgttttacacttgattatatcttttttaagaacatttgtcacataattttctgattgcattattattcaaagatattatgttttgaattcgtagttgacaatatctttatttttggagatattttgattttacatgacgttatgattatattaattgattattcgagcaaattctgtttcaaattgatatttaaaactgcatttatatacttttttagtcgaatgcaatttttttttctaaataaccatttcgaatcacttaatgaaacaaaattttattcaaattaaagtaagatatttctaaattaaatatcatatttatttgaattggaagttgttgcattaaaaaaagttcataatttaacttctaagcggtgttttaaaaatcgatgactgatccgattaagatggatcattgggttggtcgttgaataggtgaatcattggttgatttagtcaaatcagttgatctgcataacaataccttaaaatatttataaaaaatcacaaattaaaaaataaaagagtgactctctcctataattatgaaatataagtaattcattacctaatatgtaaatatcatctcatcttttaaaaaagatacatcggtaaacttctataaattaattaataaaaaaacttatttttacatacaacaaaactcatattattctttttctcttattttctttctcgctttttcttactctttctctttagttagttaaatgcaatactaattcgtttttgcgttttactacttcctttactagatttgactatctgcctcacaacttgccataattattgcctctcactcacactcccattggactgctccccaacggcccccacaacatcagcggccggacaccaatgtgaggatgtaaattggactataatcacagtctagcaaacaagaaatggagttccgttgcctcttgcgaggtgtcgaacccgggtcttacccctggtatcactccctgtttgccagctgagctacgcccaccggcatctcacccatcatttaatgtccacatgtcttcgccccacgtttcatttcatacaaatatataaaggctgtaacggagattaggagattggttaagaaattgttaaataataaaactatttattaggtaaattaattaatgattaacatttgctataaataaatattaactattgtctttggatatttattaaaaaattaagataattttttattaggatacataaaattatgatgtttataaattattattaatactcatatatcgtctcaataatacttattttagttttttaatcgatatcattaattagcaaagactcataaataaattaccataatcaaatttttgtgtctctagtatattttaccttaaagattttaaaaagattatgacagtagtgtgttcgtgttgtactagcagtataaacattaaaagtaaggcagcttttttcctctcctacacatgagtaataattgctacctacagctatagacttactccatacacggtttcctactttcttctttcaccattcattttcctcttctttttggtacagctactactgcttcaacttcttttcatctcaatctcaatatcttctctcactctctttcagttctacaaggttgtattaacatgggaatcgaagaaaaagcgggagaaagagatgcccagatgctcaaaatgaaagcttccgaaagaatctgatgccaaacatagtggcaagcaatgatcacttttcttcgttaacgaaaaaatggaagcgccgatagaggtcgcgacgaagcctcaagctgttgtgtttggtgagatggaggtcgcgtagaagctcaagctgcactgctgtgtttgttgagctcaagtggagaaaaatgaagcttatgcacaacccggcccgggttgacgggttggcgggtcgacattaacccagccgggtcgtccgggtgggagcggcccactgtcattggccgatctaattacgcaccgacccgatccaatcttcgatttccggttggaccggcggggtcggtctgagtctgcaaactatgcttctaagtcttgctaaataaaataagtttgtgattgattaaaataaaaattagaaacttgaaaaaattagagtcgaatatccaaacaaatttctaccataagcaccctttaagatcaccttaaggaataaggatgaaaatcttcacattttttttaaaaaaaggtaaaattaggacatttctggataaaaaagctaaagattgagctcttgaaatattaagaattatttaaaggattaattttcttatagacacgtgcttcccatcaaaaccctaaccatatatttagagggtataattatttgtcaaagtcatcaaatttacaatagatgatggatttatgatcggataatagtgcaaaatctttactattaattcttacttcttagccttttttttattcattcattttcaaaataatattttgttttttatttatttgtttacttaaattttttaagtaataattataatctttgtagttatatattaattactaattaaattttaagtatcttatttatttatcataaataagaaaaacaaaagtagtaagatttaaaaccacattgaactaacacaccgttagcctgcatgaaactaaattcaatctctttaattaattaaggttttaagtagtaatcttgtgaatgaagaaaaatatatggtcaatcaaattctctagtggattagtcataagtaaaattagtgaatacttcacaccaatctcatgacgacaataaaaaaatgaagcattgaaaatatttaagaagaataaggagatcttaattaattattttattttaaaaatgagaggaacaaggagtaggtcttcaaaatgctattttgtggttttttattagtagaaattgaattcaaatacaaaaaattcataacaactcgcaatactatttaattaactgaattatacctcttgaatactattgtatgaatttatttgagtttagtggatatttattgttagtattaaaaaatttccactctcaattaattataaatgtaatatcttgaattttaagcatgtaactaagcttagattaagccggattaagcataacattaagaattataaacatgctttagaatcctttgaaagatgctttaatatgcaagttataggctgttctggcctgcggcgcgacccacgtgaagtgcggcgcgacccgcgccatatgtgtaaaatcagggcagagggttctgccatgccacgtgtaacaccccggacgtgctaacattaatgataccaaaccacgctaaaagcgttatgcatgcgatgtgcggaagcgacaagatcgtttttcttgattacattatgtatgaaatataaaacacaactaaagcataaaacagacagaactgatccagataaaacatacacaacataggcagatacatactatacaaatatactcaggagggaacataacatacacaatctcacaactgtacatatacatgctcaaaaacatgaccacaggcggtcatttataaaatatgtacagactcgggtgtacacacaccctgctctaagccaaagctaagaccagctccccctctggaagctccgcaccggtcttcaactgcagcctctccagcctgtcacctccactagggcctcctgccctgaggtcgcttctctgcccctgcagaagcacctgaaaaccacaaaccccacacagggtgagacatacgtctcagcaagctcagggtcctgggaaaacctccctcaccctggtttaccatcaagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacttggtcctatccaggactcgctatacatcacagtctgtgtaggatttatcagatttaaactaatctgatcttctcagggcctttactctgtggcacacaaccacatcataccaactggaatacctgggaactacctcttccctgatcgaagcccatcctacacctgtgactgaaatagcttcagacacatcggattaccttcgtccactgaccaggttctgtgtctggaccaaaatcctatccactgactctgagcctttctctaccacacttgatccccttcggatctgctcacgagtccatcgaaccattttaggttcgcgaagctgtttctaacactttcttctgccaaaacactggagtcctgcaccattggcttccacagagcctctacaggcgctatattcctcgatcatgcaaaatatcgccaccaaggacctccatcaaggcagacatctaaccccgcgtgtaccctactctaaggtacgttcacatatctaagttcctcaggatctagatgcctcactgcatctgatcatctatctgaggataataggctaaccgaagcctctgcggggttcccaattctctgaagtacgcctcacctctcaaggtcacttcagatccttgtcactaactaagtgacctgttagacactagccatatacatagctatgtctcctctcatccttgaccacctgaaatcctctcaggatataacatatcacagtggccctcggatgactatcgaccagtcctcataaaccacataaggacggcatccaccagctagctaaaggcaccataactaggtttagcttatcataagccaggtgcttccccaaacacgcctagctggttaacaactctcgcagctcaatccggggatcgattccacagatcttccgctgcgcactctgatcctcatcaccactgatcactcccactggagatcagaggatcctctgtcctagacagatgcacatctctgacctgttcatactacccaccgtcagagattatcatcaggcatggaacatctccatgctatcatgcttgaggtatcaacacctgtcccagcctctgctagacatctcaagcatactggccacttggcctggacctcccggtcccatcacatgatgagcagtcttcttgctcccaacaacggcgtatccacatcacgccatggcgtatcatcattaacgcccagatgcatcatcatcagcatctaacatcagtgtgagactggcgactcacacctgtgccatcccaccggacgctacccttaacggggatgcacatatatggtacctccgagaatagcaggaaaccatctggactattcccttggcctaggggagcatcatcacctcgggatcatcatcacccatgagccagccatactaggaggaaaccatctcctagggaggtccatatctcataaccatcgcttcctcgaagcgtaaactctccattcacagatggagatcacacacacaagcagataaacataaaacaggtatataaccataccttaacactggtcagcaacctctgaccgctcatctggtacctctggagactctctctnnnnnnnnnnctcactgctcttatcatctgggtcagaacctctgggtctatccacttgctgacccgtcaggaaaataggctgcttgcctcgacatctgctgagtacagcctcaacttggcgacactgtctcaccaagctgtccatgtctcgagatccactgccggccactagcatctcaatatcacctctaagtcccctcaggaacttagcagctaggacctcatcatctggcatggatctcctgaaatgagcatatttggccagctcattaaacctagccaaatactcatccacagtcatgtctccctggactagactgtcgaactctgcctgcttctgctccctagcatccctgggaaaatacttatccaggaaacaggcttcaaacatctgccaggaaagaacctctccccggcctctcagcaacgctgctgtggtcctccaccactcatgtgcgtcgccctacaacatgtaggctgcatacagcaacctctggtgatcggaacactccatcacctcaaagatcttctccatagcctgcagccaccttgctgcggcaattggatcatatccaccatagaaggctggagggtcatgcttacgaaacatgataagcattttccctcgggctgcagcatccatctccgtctccatagggaacatccggtcccctctcaggtgactcgcaccagactgatgacgacttccctcgccctcatacacaggaggtgtaggggatactctgtcacccctctttaggactctgacctcctctatcaggtcctgatgagccttcatcaaggcctcatatctctcaacatcagcagctctctgccgctgtatctcctcctgtgcctgtctagctgcagctacctcttgctgcatcatctcctgagtctgcctatttgcagctatctcttgctgcaaggctgccatcgcagcagctactggatcagtttgacctggggttgccccactgctgcctctggatctcggcatgacactgcacatgtacacaaaacagtgagttgatcaggcccacatatagtgtacccatatgcaatgctcatgtcagatcaaaccacagcatcaagcaaccaacaatttcatacataatgtcttaatcaagaaaccgctctgataccattaaatgtaacaccccggacgtgctaacattaatgataccaaaccacgctaaaagcgttatgcatgcggtgtgcggaagcgacaagatcgtttttcttgattacattatgtatgaaatataaaacacaactaaagcataaaacagacagaactgatccagataaaacatacacaacataggcagatacatactatacaaatatactcaggagggaacataacatacacaatctcacaactgtacatatacatgctcaaaaacatgaccacaggcggtcatttataaaatatgtacagactcgggtgtacacacaccctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctctgaaggtttctcagaacttggggttttagggaatagggaggaaggattctcgctctcaagggtttctctcaagatcaaaggccataggaaggtgtttaggccgtgatatagggtcctagaaagcttggggaggcctctaatggcagctggggtcgtggggaaggaggaagaggttttctcctctgcaaaacgcgtttcccgttcttataaaagctccaccgaccttcccacgcgactcgcgcccgaaaccacgcacgtcgcgccataacaaaccacgcgactcgcaccgtttaccacgcgactcgcgccatacctacggcccttccacgcgatgtacgtggacatccacgcgactcgcgtgacctctcagagactccgcgcgactcgcgccatatccccacgcgacccacgtgggataccagagaagaatctggttttctaagcctcatcctacgcgatccacgtcgcctgtggcgcgacccgcgccacaccctctgcagggttttccaacgaaggtccccgcgctacccgcgcgggacctggcgccaccagcgccacagagagggtccttacaccacgcgagtaacgtgggaacggcgcgagtcgcgtgggctggccgagagtatggcacgagtaacgtgaagatccacgcgtgtaacgtgggaagtgtcctagaaaatcaagttttcctctggagctccacgcgagtgatgtgaatgttcacgcgagtcgcgtggattggcagtgatgtggcgcgacatgcgtggtaactggcgcgagccgcgcgggatcgacggatttgcttttatatgaaaccttttgggctgagagagagagagagaaagaaaaaggagaggagagaatagagagaaacctccattgatgagcgtttgagctttgtatcttcttcatcgttcatctaaacacctccgacccaactgagaaaatgatcagcacctcgagataagtgagataccccgattgatttctgagattagctgagagaatgtgagattggatttccctgagagaacccttgagagctcggagtttgaaggcgaaagaggccgtgattgagcgagctaccttagggaaagttattccctggtgcttctgagcatcacagaggtaagaaactcgagctctaaccgttggttctgtggattggattttgtgtttttggggttatcttaaggggtgttttttgaggtgttagagccgttattaggctcggactctgtagagtcttatgctcagaggactgttctgaggaagtcagagccttgaatcatcattactgatgaagtttgattttggctctgagtcagtctgaacagagataaaaggttgactagttcactagtctggaccctagagcagttgacaaagttgctcatgagactatataggtgagtttgatcggttgaaactgaccattatgagaggttggatttaggccattgtaagcagagatatgcttggccatagttgatcagagcttgtgttgagactctgtagccttgtgtaggctgagatggatcctgttgagggtctgaggatcacttgtacagtgacttagtttatgtttatagaaaggatgagagtttcctttcgtttgatcggtctagaaccatatctgatactatatatgcttgttcttgtgtaggacgtgagcgtgagagctctggtggtattgaccacgagaccgggagagccagtgatctgtctagagcaggtaagctcttggttcttggttgtgaatcctctgctgtgttccaccatatatccactgggattatggttaggatatgtgtatatgctagtagaggaacatgtaatatgctatgaataactgatagatgtggtctgaaccctatgaaagagtaattgatgtttgacatttgatctgaacccagagatgggtaattatcatataggaccatgagttattgattaatgattgttgtgtttgatccctgaggaagggaattgaagtgcttgattcctgataagggaaactgatgtgtacttgaccctgagaaaagggaaaccaatgaacatagttatgattcattgatagcatgccttattgttatgagacttgaatatgtctgtatgtagatgcggtgtgctgatgttctgatccctatgagagggaaattgacatgtattgatatgctatgcttgaaatgtgaattgaaccctgtgataggggattgatatgcatggctatgatgtgattgaattgtgacatgtctggttgaatgtgaaacctgcctatgcatgctgtacttgaatagtatcctattgtagtaggatagatgacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctatgtacacagaggtagcctcaccaaaaggagatgtaccagatatatagttgatgcctcgggatcagagatgtacctatatatctagaggaagcctccgctagggattcatgcaagagatgtgccgagtatatagatgcagcctccctgtgaggagatgatcctatatacttagatgtagcctctgcatgatggttattgatgtgataaatgactttatgtcatgattatgccttggttttggctgatgacgtgtataacctgattgtggtcaggtgtattgtgcattgacgtgcttgatgattgatttaatgtttcactgatgatgaatgtgtattagctgagtccttaatatgggacgatgctttgagatgatagtacattgattgcatgtacattgattgagtgattcgttgatatggatactcatgctatgattgtgtggtgatgtattatgagtgtgtagtgcatgaatacaagccatgagcttgttctggttttcattgatagatgtatatatatatatatatatattgattgcataggtattgattatttgtgactgatattaatgatgtgaataattatgtaatatgtacgtgttgtcagtgaaccaggggaaggaaatacctttaggggccttgagtttactgagattttatatctcaccccttgtgtggggctatgttgcaggtgaatcttccagagtagcagagaaatcccaaggcaagaggcctatgcaggattagatgctgcgggacaccttaggatagaggatatgagcatgtggctcagatgttttgtattttgctttgttttgttttgatgtaccttgaggggatattcgtacagttttgtattgtacagaggaaccttatatgtatattcaccatattatagtgtacagtgttatacagatgacatttgatgatgtcactattagtagttgcttccaaactgcttaaactctgattgattatctgtttgattgtggtgtatgtttggtaatgaccctgattaaaaaattggggcgttacaataaattatgtcttttaattgttattaaagttaacaaattttttatattagataatttataattagataataggatataattctttattttcggtgcatatttttttatattaatatatatcctattttcttatttaatatacctttattgtagtcatgacttcattgatgatttagacttggtaccatttatcatagcagtctctttaaataaccccacagggttagctcaactgttatagcaagacgatgcatcaagaccatgggatttgcataaaaatttaaaggaagatattatgacatgttcttaaaatatttataaaactataaaattaaaatatagtggttactgagacatggttttaccatccagtattcttttcctatcatttcttttcaacgattatgtaaactatttattatattacttttcaaattatatataagtcaatattttttattaaagatattcatttaatatatatatttattaattcaagttatattattatattttaattattcaaaatatataatgtgtttatttatataaatctataattttatctaacttaatttcttatataatatcattaatttaactataattgaaacagtaaacgaatttatatgttcgttaatctaatgatcgatttgattttaaaaataacattgaattttagatatggaaaaatcaacaatatttccgaacacggaagaaaactcgtttcaacaagttttttcctctagcaaattatctaaaccagaccgtgttaagaaaaagagcaacttcaattccaaatatgaaatagagtgaggagctggattagtaccaatggacatttacattaacaaatgcatgttaccgaatttgatgtggttgagaaaagagaattctattaaaaatattaaaggtggtcaactaaattttttcattataaattagttataaacaaaagttggtgaatatttggtaccaatatcatacgaataagatggtatcaaaaattcaattcaattgcctctagatgtgttctaaatcgtaacctcaccaacatgcatgtatcattaattaaagtggcaaacacaaaaaagtctcataattatctcagaagtcatatttgtgtttgcaagctgcaatatctcagaagccagaagttaagtaaagtgaaaaatatatgtgatgggttctctggctcgaccaagctgactctttttccgagccagaggacccggacctacccaaaaagtagccagtgacgttttggcttttgaacgttccacttcgaatggttcatttccctcagtgcagcttaaacttgaagcaagcgagaagaacatggaagcacctgttgttgtagtcactggagcctccagaggcattggccgtgcaattgcactttccttaggtaaagcctcatgcaaggtcagttctgctccttactacgtccatgcatgcatcatgctcacatggtcatgtaatgtaataatattactctcatagtcatactctcatgccatcatgtcattctattacaggtcttggtcaactatgccaggtcatccaggcaagctgaggaggtttccaacttggtacctagctacaatctctaaactaacttcttctctctctttatgtttgtggttctttttattctcatgcttaatttgcgaccaagtgtggccacacacaaaattgcaagatatatacaaaatgattgtggacgagaagatattattgtaacatcaaggaaaatatgatagaaaattgattaaaggtgaaccttaacataacgaggatacatacaacctctttgcatatgcaaagtaaggatacatacaatatctttctcccatagaccaagtgtggccacacacaaaattgcaagatatatacaaaatgattgtggacgagaagatattattgtaacatcaaggaaaatatgatagaaaattgattaaaggtgaaccttaacataacgaggatacatacaacctctttgcatatgcaaagtaaggatacatacaatatctttctcccatatattcacataaagaggagcctccggacaatgaggtatgctagttttttatgttaaaaaatctgttaagataatttagacaggtgtagagaagactactgaaaacacggtggtgtgtgcaattccaatggtgaaagagagtagattgcatgaatttagtctttaaccgagttttagtggtgtgtgttccatataactgaccttgtctagagaggtcattgttatacttttgtgtcatattgatagatccacgtgcttgatcggatttgtagattattatatacttattgatcatatgagctctcaatatttttctggtgttattaggagcaagagttcaagctagctcagttatgctcattgactaaactgcaattatttatttgattattactttcagattgaggcgtttggtggacaagctcttaccttcgcgagagatgtttcaaatgaggctgatgtggagtctatgattaaaactctgagcaaatatttttgatttattaagtggataaaattattttaccttggtcttagatttattcgtacgtgcaactctacatgtgcaggcagttgatgcttggtattggtaaacaatgcaggtagcttggataaattaagaaattaagcacttgtgcaattacttatttatttattttaattttagatttcatactcaaaaaaaaaaaaatatcatgagttcaggaattattcgagatggtttgttaatgagaatgaagaaatcacagtggcaggacgttattgatctgaatctcactggtgtttttctttgcatgcaggtgaatgtgttcagaattttgagttcataatgttaaattaagtatagatgtttttttttttctttcaaatttaagatataggagctgatggtttgcttttcacaggcagcagcaaagattatgacgatgaaaaagaaggtgacacaccacactttaaataaaacctcatggaactctttggccattaattggacttctttctgtcatttcatcattttgtcttctttttttcttatgctaacaacaatgtctatgtaatttactagatgttagtatgtcactgacttactgatattttttattgattagctactgagttatatttctgaaaaagttttgcattcagctagcccattatggatttgcaaaatgacatccagttgttgctgaattaagctctttaatttcgtatcagagtttacttggtacttttgcagggaaggataatcaatattacatcagttattggtcaggatggcaatgttggataatcaaaattatccaacacattccacctgcaaggttacatccttgattccagcattatgtaacagatgcaaaacctgagacttggcggatgtcttgtctgtatctgttgacacgtgaagatgcattgtacctactacatctgtgtttgtgaagttccaggaatgaaacttttgaatgccataaacaccccttatcttcgaaacattagttaaggcatccttcagctcatgctcatgcacccttggcactctttggagcaaaacttctgctgaattttttagtaaaggtatcacggaagatacaattaaaatagaaataaaaattgagcaggcaggatcagcaataagccatcccttgtacttgatcaacagggtagatataacaacaccgacactccccatggtgtcagcaagaacatgcaaaaatatcccttccatattgtgatcgatatggcgatggacgtgctctttatgaacaagtggagcatcttcatgacaagagtgttcagtttgatcatgatgttcccatggtcatggcagtgggcggcagcgtcatgatgcttaaagctctgaatgcagtgtttgtcttcatgatcatgacactcaccatgatgcttcctctcatgactacagtggttatgattatgatgatggccatgatcaccagagcatgaatctacttggcaatcacttgaaactgaaatatattcttgattgcttccatgttttgttgtttcgtgaccatggcaatgcagatgatcatgatcatgatcatgatggtggtgggcgtggtgactaagcgactccgagtgtgagcacgaatgggagcatgatgatccagacaatccatggccatgggcatgatgatgctcctcgtgaaagaatatcaagccaatgacattcaccacaagaactcctatggagacaaccaacaagctattacttgatatctattgaggatccaatatcctctcaaaggactccaccactatgagtgctccaacaagaaccagaaacacagcattagcataccctgataaaaccttaaaccttcctctcccatagttatagtgattattagccggcaaacgagatatatacagcgcatacaacccaatggccaacgcagcacaatcaaagtcaccgtacgcctacgatcctatctgactattgaggactttgatcttcttttgttcaattgtgcgtgctttgcttaacacatgcaattccattaagctcgcaccatagtactcaacagttacacctacttgttcgacactatatttcgattctgcccttttaacaacatgtgacaagcatccgatatcaggccaagactattgctcataaacccagcagcaaactccacaaccatatacccagcattgatgagaagaaaaagcacgatcttccgcgacttcctctcactcaaaacatgtctgataggcttcataatcatgtcactagagaactcctcttgattggaagagtgaaaaggatccaaatctctaacaccaacatatagcaacaaaccacaaagcaacaaaccccagagggaaagctgagggaaataaaaaagctccaacaccagagtgcaaacaaaagtaaccaaaaactccctctgagagtccctcgaactcgccaaactatcaacgtcatcattatcatcaccactataactctcacacaaaaacacaccgaaaacaacagcgttcgccagcggccacgccaaattcccaaaggcgacaccatcctcttcggtctcaaacaaggagaaactaacaacagcgggaacaaacagaaaaacagtggtgaaaaagagagtaattaaccgaacccgtttgcgaccgagctgtttgagagtagtcccggagtccacgagccggtagcgggcgagaaagccggaggcaaagggaaggaccaagggccaaatccggccggtaacgcaggcgggggagaacgggaagcattcgattcggtcccaaccgaaggagagcaggaggaggcagagggagagggagaggaagccgcggaggttgggccggagggggcttctgggccgggccgagatggaatccataaattcggcgaggctcatggaggcggtgccgcagtagcggagggcctggaagcggaggaggattgatttggtgactaagattctctgctgggagggtgtgagtgatgatgagagaagagggtgtttgggtttgtggtggaggaagggatctttggaagaggaggaagagggtgagaagagggagaagaagagggtgagggagaaggagaggagggagacgaggaaggagaaggggaagagggagaaggaaggggaggagggagtaaagggagcggagggagaagaggaggaggaggaggaggaagagggacgatccagattgcgatttcgattacgggagcgagaatgagcgccggcttttggagggggttgggcttggggttgaggatgaggagtatcggaaggcgggcagagctcccggagtgccaccgaatgcggtggtgcgtggcggcaccgagaggcggtgaggacggtgctggtggtggtgagggtgggacttatcgtgatcggccatgctagggtggaccgtgggtctacggttcccgagtcatggaacttctttagtgatgttcctcctgtgaccatatatatacacaatgcacgtgccaacctgaacaagtagctgttgaggaaccacaatgtagagacagagtctactcaaccaaaacatgttcatgttgcctatcatgcgtgagtaatttgagtagttggatagtttgttttttttttttttaattttattttacttttttttctctttcttttttttgctgccatttacaaaaaagtcttcatctttctcagcacctcaaatgttgtgtcgtcgccgcacagcaccgcccactccaccgtcgcaccgcacctcccaccccaccgttgaaggagataaccattgggttggagaagagtgagcaaaggttcttgtgggtggtgaggtccgagttggatgatgctgactcgatggaggaactgagtctggacgagttgctgccacaagcttttcaacagaggaccaaagagaaggggctggtaatgagggagtgggtgccacaggttcagatactgagtcatgactcggtgggtgggttcgtgactcactgcgggtggaactcggtgttggaagcggtgtgtgaaggggtgccgatggtggcgtggcccctctacacgtggcagaagatgaataggatgattatggtgaaggaaatgaaggtggctttgacggtgaacgagaacaaaaatgggttcgtgagttgggaaagagaaggaatgacagagagaatggactaatggagaaagagaaaaaaaaaaagaagaaacaaattggaatcatagatttaaaattaaaaaaatctaacgagtcaaaattactcacgtatgaaacgcaacatgttttggtgttgcgtatgctagactcctcggtcatgtagagacccaacttctcaccaaaggcatgctgccccaactcatgatacctatcgaatctcacacctgacacaccaagtatcatttcgtgcatctcaaccatttgtcatagggtaaacaacctgatcacccatgataacagtggtataactgtccccgaataataggcaatttaataagtttggattattattattatatatatatatatccaacttctctttcatcttgtccccatctcaattttttaacctcattattttttactcttttattgttatattatttagtatatcgatcaatgtctcttttttcttgtgtttattttcttttaaaacctggagatggatcttctccaaataaatgttactagatgagatcttagtgaaatcttaacatttcaaaatctcaatttttcttccatgtgagaaaatcttttcccctttctctttactccactcctgcatccaaaacataagatttgtgttgagcttctttttttcccatttcttctctccttccattcctctctcttgctagccagagcttgcggtgccttttaccaattctggtctactaccttgctttgtgctattngttgcgtatgctagactcctcggtcatgtagagacccaacttctcaccaaaggcatgctgccccaactcaagatacctatcgaatctcacaccaggtatcatttcgtgcatctcaaccatttgtcatagggtaaacaacgtgatcacccatgatcacagtagtataactgtccccgaataataggcaatttaataagtctggattattattattgttatatatatatatatatatatatatggtttgttattttgattagtttatgatttttttaattaatttataagattatttttaagttttaacatacacacacttcataatttgttgttttgtctttaatatttaataattttttattttcttaatataaatattgctagtattattatttgaattgaaacattatttatactatttattttaatgttcaataaatttttaatatttaaagtaaaagggtataaatttaaaattgatttagaagttcaaactatacttatcaaaatatattttatctataaaacaaaattaaaacttatataaaaatcttataatatatttttgactaaaatatgttttaggttcctaataaataatcaatttttattttaggttcttgataaatgatcaatttttatttttggttaaaagttttgataaatcatggatcctttgcattgaaatttttttattagactcaacaaaactaatcatctactagggacctaaaatatatttaagcttagatattttaagtttaattataattattaattaaattaacaattataattttattacacacttctaatttgataaaaaaaattgctaaggaaatgggccaaatgcacaaaatcacaagcactatcctatagtcttagataaccagtagctgccatgtcagtttgaagatacacagtaagtaacgctatggagaactcaaaagattctcatatccaccccatgtcaagattgatgctattttacactaaagcatgtcagcagctgagttgcattctctcaaaacatgataagttagtgctataaggatgagagattaagaatgaccgaaatttgccacatccttgctcacacaattatactcaataaattgtcaaaactaaaaattggaggaaagaaaaatctaaaacacaacttaaacattctcaatctagtatacaatggaatttcagtttgtgtgtgggacatctcaatgatcaagatgttgtatgatcaatggttatcattatatgcttaaagtgcatttcctcattataagtcgaacaactgaacttttgatttaaatggagtatcatatccaattcttccaagtctattgattctatataacgaatactatattttcaagaagaaacaacagtgaaaattctgccttaaaagaggtttacgtttgaatcacctcagcagttaaaacacgttacaactatgtcgctgttgacaatagacagcttattttggtagtaattttgtgcagatactcacattattgggcgatcacttttgctgttgctctcatgttgctatggagcaatgataggctcttttctcaaaagatttcatctgctacggatattgcagcaagcatttttaatatggcttacggagtggtccaaagtctcaaccatgattttatgacgagagagagaggagtatgtataatttgaaactatgcttgaaaataacaggtggtagggtagacacatataagttagttgagtttattttaaagcaataattttttttattttttacaactttttgatagaaatcaggttattagaaaaaagcacttgccaactacatgctaagtggtaaattctgacaagaaaagcttaagaagcattggcaaacattgctagtcgaatttggtcttggcggttgactttcaaagtatagttgaacacagaacatatattatcagtattattaatattaattattattgttgcatattccacatgaacttttcaaacgtgatcagcacaaactttttcaaagctcctatttaacatttatgcaactaaagaactaaaatgcttggaactgccatttgacatcgtgcagctatttgcatcttccaaagcctggccatgtgctccaaaagaaaaatatcggttcatcaatttcttattgaaagagcccagcttatagctcaattgtagggagccatcaccatccattggtcgattggagcaagagggtcccattatatcaacacgttcttgcttattattcgaagaacgagaagagatagatagttcttgaaaaagattagatgttaaatgaacaggtagaggcacttgtggctttaccttaatcacaccttgcactagacctgcatgaaaatgttttttggctgaaggacttggaagataagtccttatagatagtgttcttttgttgtttggaagagaacacatttttgagtatctttgcctcaatgggattggaaagtcttccaagttgttccttgaactgaaagaattcatagaaacatcatcttctaaatctgaggcagcttcttttgtgtctcttcttctagaactttggagcagaaactttaagtgccttgcaccataattgacagaactagacttgctgttacatggggaattggctgagtcatagttgtttatttcacttgaccatgaatttgattctacacttgcctgatcataattggaatcacatgaattctcaatgcctgtgtataacaatatctcagaatctggtattctaaatgatgttccaggactgcctcctataccatgagtcctaagatgcttcacaagggcatttcttgtcacatagtcctgataattagagatccctccagctgaaattaactgcttgattaagatttcagaagatgctgatcgtgatttttgtctaagatgatccaagggggtcatcccatcagcatcacgaatattcaaatcaattgatggaaaagacatcagtaattccactacatcacattggatattatgaatcacagcaacatgaagagctgttcttccatcattgttcctgacattgatgatgtccttcatgttcacaatcttttcacttgtcagttgcttcatgagctcagtgtgcttgtccagtctacagaaaccagggcttctgaaaccagccactaccatgtgaagaaaagtatctccatagtgattggttaacgttgctaacaagggagatgctccaaccagaatctctaccacgggtaagtaacctctgtaagaggccacatgtaatgctgtattgccttgagcattagttgagttgatgatatcataggattcaattagatttctcaccacctacatcatcattaaaataatgaaaataagtaacaataatttattaaccacgaagaagatgcaaaaaaaaatggacatacaaaacttttgtagcatcaactgcccccagaaatatttaacatttaacgctaattttagtctattatacaagactcgacggtttgcaccccgagtcaggtgccaaaaggagccaattggaataaagcattgagaatcactgaaagaggaattcacacaattgtgtgtagtactatctgagcagttcactaaatattttatatttcacattcatctttgaggagcctgatctattgtgaagctagataactcaacgaactagatgttctgtagtatctataaacattttgtatactccacttacgtagttattaagcctccctggccaattgaagaaaaaagggcatttcagtgatccataaaataaaccaggcttttccataatttattaaggatctaatatctatgtccttaggacttctaagtataacaataccattaaacaagtagggcttctgaattttctacagcacattcaaagtgtgtttggttttcctttgagaatctccaaaccatgatttaggcaaaagttactttcacccaaaccataaatgtgggactttttcaccaaaaccaaaacatgcaccaactactaaggctgtgtttgaacttccatttactcatgttgaacaccaatgatccatgagagtggaattggcgttcaaacgtgccttggaaagtggaattgagataaaacaaacacactctactctgaagtaatgtgcctcacctcaacctggcctcttgcagctgctgcatgcaagacagtacatcccagggcatctctataagacaaaacctgagaaacagaaatacttcctagaatctgcttcagtatttcccaattccctcctctggcagcagcatgaatggccctattcatcacatccctcttgaaaaccttagaaccttcatccaacttctcttccaattctgcttcactgccaccaaggcactcctttcttgaaagagcagaatgaagaaggagcttaaagacctcacagttcttgcccctggctgccgcataaaacatgtcagtgacaccatactctccctcaccaaacaccaaaagagggtctctccccaacaactcaagaacaaagtccacattcccggctgaagcagcaatgtagagaagccatccaccatagcctgcaaggataagagagttgtgccctcttcctgtctcacactcaatcataagattccttgcaaccttggaccggcacttggcaacatcctcaaacttggactcatcgtcccacacggcttcaaggcggcgaattcggcgaagggaagtgagcttaataaggaggttggtgtcaaggtggagaagctcagtgaccagatcatagaggccatttgcagcagcataatcaattggagatgcataccaccatcggtctcctgtgctctcccaacgaagagggaagtttgaaggaggcatagtagtagtccaaattagagatgacccttttacaacaaaggacactcactaccactttcttcaattctagtagttgcaagcagcagtgtaaagatgcctttaagacccctcattaaagcaaaaagtgaaagcacacaccactaacagaatatacgcttattctcttggactagaagttgttgaaaaatgaaaatgaaaatgagaaattctaggaagtgagattaattaaccttgtaaacagtgaagtacaaggaaacaaaagttggaatccgtagttggccaccatggcatgaatttaaacagtgttctggctgaagttgaagttggtggcaaaagcaaaacgctcaagggaagaaaaaagggatagcaccaactataaactgttgtggcaatgtgttagtgacaagaggaaaattgccactagataggatttgtgagggaggccacgcacttaggaaaagttaaaaagaaggcttagaaagattgagattctctggtccgtgagttcacagccaaagatgatatttttattaaaattattgaaattccgtagaccccaccttgttggaggttgttttcattcacttaggaaatttcaaggatcgtgtcatcatttgtagtgggacatggagcacacatttagctgggcacattaaaatgagagatttagaagggacacatttttttttgttcttttaatttaaggagcaactttgccttccataattgattttcaagactgggacatcgaaacttatcggcatgatctgaaatttggtagccataaagttttgtggtgttagcaatttggagcgtgagttttgcacaccagaaatagagatgccgctagggacaacaacgtgagttttacgccttttggcttatttggaaaagaggggagggaacaaagaaaggcactttaaccattttgtctgtgtatatgctaaatggaatgcatgcatgtcgtattaaaaagataataataatgtttaataattatgcacatcttacagtttctttaatgaatatggttgtcctttcttggtacccatcttagactcaaatggcatgacctatacatgccaaagagatagcacttattgcctcctgtaaaatatacttacctttttaaatgaaaaaattgactatacgtccaatacacttgcaggttagaaaaatgtataaatattagagaagtaaatcaaatttgattagctaaagttgttaaattacatatgaatttaacggaagaaattaaatctttatgcaatcttgtggagtacaaaataaaagagaaaatctttatgcgatcttgtacaaattaaaagaaatttattacaaaagtgataaagttctttcgtctctgtatatatctctttttttttttgttctcttcacataattcgtatcctgaaccttacttgaagacttcttatgatggtgaatttttaaatacgattacttttttttgtcaaaactattgatataatttaaagagataaagttctctgtatcttagtaaattactcttttggtttgttctttagtgcgtctaaacaaattactgtagtgtggcctgcattatcccttgggattgaatgacacaaaacaacctactctttgtactgtagaggaaaggataaagaagacggtcattctgattctctcaaactcgatgaaaacggaaacgcacgagacccgtagaatgtcgcttgccactactaaaggtttttttactactattcatgttaagactaaggactggtttacactttttcattgttctaactaatgagtaattttaaatttttctaaaatattttcttactaacctttttacttcttttataagtattaactattaactatattttatattttcaagacattaaatacaatattttttttgttagatagcaagagaatttgtgagaagatataacacctcattactaataatccaattagccctaaaatgtattttagggtatgttagatgatttttttttcgtaatcacttatagaaaaaaaataggaagaaaaaatgaaagaaattttttcaaaagataaattattaaattacatataaattgatgcataaaagctctttcatattaatatctcttaaaatttatttttagtttatgcgtaaattaattttaatttatgtacgtacttattttattttattttctattttcttctcttataaatgtttatagaatattttatccaaccatatccctagtcctcttaaacattagtttggcctcaaaacaacatatcccatttttatttctctcttttgaagaactttttaaaaaaattattcacgttatcattttaaaatagcattgattattatatttttaagacttaaatatattttttgtttttccaagtattgtagttgtacaattttgatcacacaaattttaatcgagtaaattgaatcctctcaactattgcaattaatttggtttgggatttttaacctaattgagttcaacttgaaccaaattaattaaatctaatagtgattggtttggtatcgaatttgtgagttcacaagatgatgaacccaaaccaaactaacctgttttttatttttcgggttcggtttgccttgaagagcttgctcttcactggtcaccattgataataatgtacagtataagatatttaggtactgggcattggttgaagtagtgtactaaaaaggttgaattgaagtacgggttgtcacttgtaagtaagatcatgcaccaaattttttacataaaaataaaaaattatttacttcaaagatgtagtatgaaaattattgatgggacacaaatgattttatttttttatattggttatatctttaaatgtaaaaagtaacattttacattagttataattaagacggatgtatatatgttaagtaagcaattttcaaactatactttttatgtaaataaatttttatttttacctattttgatgatcagaaagtctcatacaccactcaatgcgcagtaatatgttggagcccatatgttttagcggttgaattggaatctttatcaaacaaaggataagactaacatgttctgattcaattaaaagatgtttaagttaattcattaaccatatacttatacgcgcagttttaaaactagttcattaaaaaataacgttataaaaacattctgcctagaatattcttagaaaattattttgaaaaaccattcctcccttacctagctatgacctaatgccatattaaaattagcggcaaaacaactaaaagaaaaaggaaacatgtggaagagagagcaagttagagcaataaacagatgaatatggataagaaaaataatttggaaggctagcacgcatgacattgtaactcgatgatttcaatgcaaacaacgagatacactaatagtaagcgataatggggaaaaatgaaaagtataaaatctgctattacattatacaaaaatatttttcattataggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatatatatatatatatatatatatatatatatatatatataacacaatataacagttatataagtgatttattgacatatacaaggactaccatgcattgtataccattctagtgtatataatatggttgtatacagaactgtacctacaccattctagtgcaaacaatgaaaagttgtaactcaatgatttcaataatgagatacactatgaggaaaatgaaaagttggctacattatacgaagaattaacccttcaaaaataaaaggtggccaaagttagaggagttaattaataacgagacagtattaaaatatgctgatatattatacagaaatattttcatagaaaacagtccattaaaatctgctgatatattacaaaaatatttttaagaaatgttacatgtacaacaatttgtataataacaatttttgtctatctctcacataatttattacatgtacaactatgtcacatttcaatagtttttcattataagacaaagcaagtgtggcaatgtagcattcttgatatgagtttggactctgtgtccgtggctctaacactgtgcctgtgacttttttatattcaaagaggaccagagtgaggaaaagcaaaagatttccgcttgttctggttttatggtaggtatttgcttgtgtcataggtgcacgaatcttactgtctttataactgctaaaaaatctaatcaatgaacttgtgtttttctcttatcagagtataacatagttgattatggaaatttgaattattatttgttaaaatatttggttgatatatattggtaggagagaaaaatgatatgttactccagttcagaaagaggtgtaatcttacatggaaggagaagatgaagaggccttcataacacatgtacacaacaatgtggagaaaacagaaacagaaggggatttccttgaccaaagccattgcctattctatatggaaatgcttggccttccacgctcttttagctggtatcttttatatttttttaagtatcacatcactgctgcactgctacacttccttgagcataaattttgtgaatttttttttttgggcaataatggtgattcaagcatcaaatagaaagaccaaattgaagaggaaattgatttggacagacaaccattccatggtgccaaaattgtgaaaggctacccgagcaattgattctgagaagtgatgggagattggtgtctttcgaatcccaaccatcgtggccaattcccttgctgttgtgatgaagcctacaaaaagtaaataacttcatcactagaatcctagattgagtcatacaagagttagcacatgtaaagatttatgaccaaaaattgtatgattttgtagttgagattttgccttatttgaaatttgatttttgaaaaaagtttagatagaagttttgttttgttgcaaattttatcttttatcttttgtttcaattagtaatgtaacttcaaataaatgtgatggcagattatatcttttaggaatttcaaattgaatgtaagcctatacatattaattctcattttatgaatttcaatggtaattattagatttaattttaacatctctatcttctctgagcttacttcttatgggctgaaacaaattttgattgagagctaaacacaatgaggttgagtgcaaacgctgctgagtgatccaatttccaggcagttgtggtgcaaatatgtccacttcagacaattcttcatctgtcattctaataatgtttaattgggaaaactatcacatatgagtagtgcaggtaactaaagttttttttcccttaagatctcaaagtttatggaacgttgtaatgtctaaagttgatacaccgctattggaagaaaatcctactattgcttgtatgaaagcttatgacaaagagaaactaaagaaggataaaactatatgaaagctttgactaagagaagctaaagaaggataaaactatcgcttgcattcacgacttgcagatcacattttcaccaaaatcatagacttggaaacacctaaataggtgtggaacaagatccaaaatggacttgacaacaacaataaggttaaatctgttaggcttctcatattaaagagagaatttgaatcaattgaaagatgaaggaacatttcaaggaacaaatcgtaaaaacagattttggaccaagaattaaaacatttaaactcaatattttaatgtaattaaatggataaaattaattcttattcttgttttttcacacttgggatggatgcattaagtgacagacttttttctcccttttttttcaacgagattaagtgaaataaatatgaatcattaactattattaaggttggtaaaatggatccggcctacacttaggatcaagttggacttaaaaaaaaagcctatttgacccagtccatattgcctgtcagaccaaatggacttaggttacgatccgacacaattaataatatataataaatattaaaaatatattaacatattaatataatttatagttttatatcacaatttatatttttttttaaaaagtaaaacatacaatataacaaatacaacaaaaaatgcatgataaataattttttatttttgggatttttttaaaatttgtttgcatataattaatttttaaatttttatttattttaaattattcaaataggcccattgacccaacatagggtttaagaaatttcaggcctgaattgaattatttttattatttgattcgatggactggagcaagaaggcttatccattttgttagccctaaatattacatctaatcttacattaataattaagattaaaatatagtagttacgttattttttatgtaccaacttttaacattttgaggataatggtatctttggagcctgttgaagccttatcataaatcaatatagaacaacaaaagaactgctatgcatcctctagggctcttaaattccaattttagagctcttaaatccaattttagagctctaaaattggaactgatcaaaattccaatatttcaacacttttgcaagtaactgtaaacaataatcaattgcaaaacgtatatattttggaaaaggaaattttggttagagaatcagtcaagttcttgacagtagaagagcaactttttatcagtaaatattagtttgctataatgctaattttgtttggagaggggattgacccgcgacctttcttttcttttcttctttctcaatcatccaacccaccttatatctctcatagaacagcaactaagaatatactattatgatcagaagccccaaatctacgttaaccttaatccttaagttgctaatgtaatcagtcagtgtttcttgagctgcggtccaacgcctaacttttctctatgtacagtatgttggtctgtaactgctatattatcctcctgaaaatatcttatgcctgtcctcgttgtctatcttttttggaagttactttgggatgatctcctaaaaaattctgtgactaactttgagaatgaagaagaattgttcagcagcaattgagccggttcatcatactctacaattgtccctgtacaagtcaaaatagtagtgcttgtcagcaacttacacaaaggggtgcaataatatgctaccataatttgaaatcaagttaaattcaacctaacattacactcattttcagtcccccacctccccattaaattcttttggatgataaccttcactatgagataatgttttcataatcattaatggtatgatcacatacattgaagtacataccttcatcaaggaccaaaacgcgatcattatcaataactgtaggaattctatgtgctactgtaatgactgtacatccacttgtttcttccctaattgtcttctgaattaaattgtcagtggcagtgtcaatggatgcagttgcctcatctaggatcaaaattctccttttcttcagtagtaacctagcaaggcaaacaagctgcctttgtccaacactccaattctctccattctcggccactacatcagtgaaagaatatttcatatcaataacaacattggggtggaaaagcaccggaactgtgaagttggacgtacagttattaaagttatacacctgaatggtggaattttttaacatatttatacctggtgcatcaagaagtctttgatcccgccttactatttcagcaagatggcacttgctgagaacctgaaaatagtagttctttcagtaataagataaacattggcattttcaagaaagtgtgttaactgctaatgctaacctcccaaagttcttgatctgcgtgttgttctagtggatccaagttagtccttacagtgcctagaaacaaggttggatcctgaggaattatgccaagcttagatcttaaatcttgcagaccaatcttggaaatatctacaccatcaataagtatagatccttccaaaggctccaccactcgaaagagggcttgcaccagagtagattttccactcccggtcctgcctactacaccaattttcttttgtgctggaaagacacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaagcctgaaaatcataagaagcaacttagcaatcctatatacttgtgagtggatctagtcgtaaatcttaattatttcatttgctcgttaacaagtataattgagaaggaattggtgagagaggaaagagaagcatatttcaatcaccgagtactgcaacatgcatcaatcataaagtaccactagtatgtgagcacatcatagctacatccagaaggatctaatacaaacaagttattttctgcaaaattagttttcttttgggttttaaagttctaacccgagggtaatcaataacgtgtagtgtccctctttagagcttcttaaaataatgtagtagaaaagtggttctcacatgcatgcatgtaactgctatcactgctgataagatgaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaattattcatgattttcttctagttgcacaatttttaattttcttttatatattgttatgtatatgtcgatatattaaaataaaatataatacatattgataaaataaaataatttattgaagcaagtagaaaatttttatttaattcacaggataaataatttacctgaagttacattaatgtctacatcattattatgattgaattatatttttattataataattaaaattcgaatgtatattttatgacagtatttttcttatttaaataattaatttaatattttattttatgaccatagaaagtataaaaaaatataacaaatgaagatggatattttttcacgaaaatataaaaataaatttagatttaacttatcttataaaatataactcacggtgttgaatattttttaatataaaaacaagtaggaaaattacactaaattcacaaggataagctttttttgctaaatattttttttctaatcaaagctataatatttattttacaaaaataatatatatttaattacataaaaatcaaatatcaacctaatcactatttctaaagcaaaataaatgtctaagaaatactatctctaacacattattatattaatacaaaattaattaaaaatattaaattgttaatccctcacacggatcaaaattcctagtttgagtaatagataggtctgcagttacaattatgttaaagattgtggaatgtatcgaaagaaatatatattttatttatatttttgtactttcatggtcatatgtggaatgattatgatttgtgccaatcgatctctcaagtgtcgaccaaccttgttagggcagcaatgatcaacataggtcaacactttggccttatcgcaaagccatgttatgtgttattggtgtaattacattgattaattaggtctctcaaatctttttattttacacaaggtctcccaaatcctagaaaaacttatactgaaactagtttaagaataatcttattaattttattgttaaattcatgaacattaatttttgaacatttttattactgttttagtcttttttcctgaatattttagtctctctttttttatatataaatatagtaatctattaaatctttaaaatattatacaaaatcaaaaagctttcacagcaattatactcaaaacaaatttagaaatttgtaattcgtaaatgtccctatcaccagaatctctgtacagtccaccaacctttgctgaaagatttttgtgtacgtatatgtgtattacgcatggctggagcaaataagtcaactaacaatatatagaattttaaaatataaatatatttatgtcaaatttacatgtgtcaaaacagtcaatcaaaccgtacggtttataaaaataacaaaatcaaattaataatcacccatttttttttttgtcaatttttttatttgacgtttagtttaattcaattttaaacacccgatcaactgttttgttacctttacacgttatttatttactattacatcgctgtactagtgtagtctactttcgttttttaccacttctatacatacctttctatttttgttagtgaaagcgactggtcatgatgtcgtttgtttaaactgatttcgcgtctgaaagcattcagaattaatttctcctgttttcacgcatatttttaaatgaaatttgtgagtgaaataaacataaatatattttaattattttgaataattttaaactaaatataccttcatttataacaacgtttttcgcttttccttttgtgtaactataatcgctggtaatttaatcacaaaatatcctcgcatttttttaaaaattctaaaaatttaaactctttctttgtaattatgttttttaaaaaaacatatactatatcacattttaaaaattatttaaattgattttaaaatatttctctcccactcaaatcaattctgatctacatctaaattaagcatgttcttaattttttaaataatagtttggataagaagaaggaaaatagaggggaaaaagagaaaaatatattattttattttgttgaaaaggtaaaaaaattaaaataaaactcaatttctatttccctctattttatttccaatttaaatttaattttttttttctcctcttactcttttcttacattccaccaaacattttttttattgaacactccaccaaacatggataagtatagaaaagtcatgaaaaaatgtcgtcatccatatttacatttaatgacgagtagatctaattatggatgaagtgaaggcgaagggaagaatttatagcaaaggccaaccagagaaagttgcctcaacccgaattttttgtctacttcgtcgtcctttgggagtttgtgggaaactaagaatccaagaggtaaaattaaatttgaactttatttgaaaattgattcaaagtataaacaaacaatcacaacttctcaatatgtagtagtcagtattgctgtgcaatgtatccacactgattactttttttccaaattaagtcaagcacaccctctacttatgctatcatatatgcaccctccactttatatgtattatttaatatttattaaaataaatatattaaatataattatattttctatatttatttatttattaaataattaaattaataaatattaaatgaaatgatataaaaaatatacaaaatattaaatcaaattaaaaaattaaaattacttccatttttaaataattaaattaaactaatttttagatttttaaaaattcttacaagaaatttaaaaaaattgaagaaattttaaaacataaaattataaaaaaaatgaaattaaaagaagatcatacgacttaattagaagtcatagacaaaaaaaaggcatacgactttaaagtcataacccatatattaaaaaaaagacaaatacgacctagaaatcgataatatatttacgacttttgtatagataggaaaaacaacttgaattatgatttcaaagttgcacatgaaaaaaaaagttgaagtcataatttttttgacgattttcaataaaaaaaattaaaatcatatgtctgaattagaagtcataccacttgctacgattaatcaccatttgataatttttttaaaaattatcccccaatgataattaattttaaaatccacccatatttggtcaaaaagtctatgtatagtgagtggagggcaaagtggacaatcaaaactttagcatgacgaaagagacaagctttctttatgcaataatttaaatcactgatcacactagccacatggtttgttatgagtccatgccttacggtcccaggatactgatgcttttaggggttatcttttgtttatttattgaaggttttattaaacacacgtttgatgaatgtcttatatatagcatccatattccatgactatatatatattgagcgatttagtattggacgaaggtaggtttatgtgttaggtgttcaatttgatcggataataaagtgtccactttgcaataaataaataaatatatatatatggccgtaattgagacagtgagattagccatagtttattcaatcctgctgcatatgttcacctgtttgtttagaaacattctgctgcagttgcattattattttataaacaattcaaggagaattcgtattatgtaccccaaaaaaagaagtgaattcgtattatttcacatggcatgtcacatgagtgccatatccatatgtagtgtaagcaccaatccagctcatacatcaccgctggttagaaatagctaaacattataaactgccccctacaaatatcactgtcatcctcttaccaaaagacacacacttctacatctgtgacttcatttggcttcttcagttcttcgtgtattgtttggtttaaaagaagaaagagaagaattttaatgatgatgaaagaaaagagttagattttaatgagttaaagaaatatcttatttagtttatgggggcagggcaaaaaaaagaagaaaaataaataaatttagtgttaatagttagataaatttgtttaattcagaataatttagtccaattaatataaaaaattctctcatttttagatctcttaaccgtaaggtgtcaaaatggagtgagacaaaattttagctttctctatctcctcctgccaatttttttttaagttttaaccaaatgttaaaagcttaacaaaatacatgatctctatttccgcatccaaacaatgtcagaatggattgagaaagagtaagcagcgctatatattatacttaattttgaagaccaaagtcacgtagctatcaaatagctagatatatatggaattttgctttcgcaaataaaatgattttttactattaagttattatattttattctaaaaaatgtacgtccgtataggctaaaaatgtcatgcatagtatcaaaattcaaatccattctcaaaaccggggacaaatatccttagcagatattgtcccacggtcctagcaactagcaaatcaactgttcaaaatgagcaaacactaaaaagaattcaaaagaagaaaagatgaaaatgaagaagaaaaataaaggatattctttactctttactgtatataatgctagagatatttttaagagtttttttatagaattttatttttatttttaataaaaattctaaaaaataattataactgcatcaaacgttccatgtcacgaggtatgtacgacagatgatttggcagtgtggatttcacactgtcgttagttgtgaacttatcttcataacgagccagcatgtgtttgttggacgttgacgtgtctagcgcaccacagctacctacgctgttgtgttgtgtgtgtctcgtggggccaaacccataccaaaccaacactgccacactaacacgtgattttattttcgattaaaggaataataaaactgctgagtcatcagttagttcacgaatcagatcagaatctttcaagtcattataatgcaattccaatccccgtgtggctgtggaatctcatttcaaagttcaattaaagcggccatgatgccagccatcgcttgcacaacttgccaaaaatctttaatccgtcatttcttgtcaaagttcaaccaagagaatagcaaaataaatgacattgtgagtgtagacttccaattctgagtatataattgttttaaatatttaaaaagataattttattatctataataataataatatttaatttaaattagaattatctttctggtaaaaaatacgtgttctaaaaaaatgacattgatcataaataattaagtttatgaaagtcttctttatttataatctcacatacttaaaaaaaaaaaaaacgtaggaaaaatgacattgggcaaaagtctcaggatatatcatccaaacgcgataagtacgtaatcatatcataattaaattgaaagtaatatgaataatatagaatcaaaaaagaaaattcgatgcatgcatttggaatattggctatccatgtacatccccatctgtggaagaaagcaccttggagaacaggatgccatcctaatcctattgtcatttgttattggggagaagtgcaattgacccactagagttgttgcaaccatggttggaacttggaaacttggaatcattgtgtcaactgaagaactagtatatgactaataggatggaataatataaaatgaggacttaagtaggcatggcaacgagacccgagcccgtgggtacccgtcaaaatccgctccgattttaacggggaaaaatcgaatttgttattgatgatacctgcctcgcccccgccccgcgacaaaaattcggggacgggaacgggtttggtattgatgatacccgccccgtctcgccattaggcatgacaacgagacccgagcccgtgggtacccgtcaaaacccgcctcgattttaacggggaaaaactgaatttgttattgatgatacctgccccgcccccgccccgcgacaaaaattcggggacggggacggatttggtattgatgatacccgccccgcccccgcccccgccataattaaattacaaatttacccttatatataataataaaatcccaaaaccctaaccctccccctcatttctcattctcgatgacgctgaaccttggccaacgactttctgaattaattccattttggaagctttgttgctgcaatggacctctactctttgttgtgttttattttaattttggaacaatatatatttaaatgatattatattttgggagaaattaaatatgtagatccataatgattttaattaaattgattgattttgtttaataaattttaaattatgatctcatattttgaatgtgagtttgttattaatttttttgttacctagtcaactttttttccgtttttttcaaaagaaaaaccatattattttttatttttatttttttaattaatagtaggggtggggcgggggcggggcggggaaaacccgaccccgacggagacgggatgggtctggattttataacccgatggagaatggggacggaggcggggacgggttttaaaggcgggggcggggacggggaatacaataccctcacccgccccgccccgttgccatgtctagacttaagactcgaaatactaccaaaacagtgttttatatatatatatatatatatatatatatatattaattcaagttattgtcagtttataagtattttcctctcttaaatcactaaactaggagtttttttgtcgttgaactaaaccttttaagagataaataaaagataaaacagataatgtttcaaatatgttgaatataataatgtaacatttaaataaaatattagttaaagacataaagaccaatctcacacatgagattattaattaataagccctttagctctttaacctggattgagcggtcattattccatatcactaaaatgtcttaggtttaatgaaaattgaagccaaagacaatttataaacaacctcctcttaactcatggaggagtcttttaaaagacaaaatcatgaagacttataagaaaagtaaaaaatatcaaataatcctaacaatatgctattaaacgtttgtgttaaaatggcctaagccacgcgtgagactttataaacaaagatgtgaagtttaaaagttaaagtgaataatatctccaataaaacgaacctaacaatataacatatttgagcaatttgagtggaacattagtccttgaaagaaggcctaagtcacatgtgtagttgtgaaaccttctagtgtcatgaaaaatctataacctacacactcttttccctcatcctattgagatgccttttaaaggataattttaaaggtctatgagagtcaaagtgaacaataccttaaatatcatgggtccacaatataataaatttgttaagccaacattaaaggaatgcgtaggctacacatggaattgctatgccctttagtccttaactttgaccgaagactattaggtttttatagtgttcaagtcaaatcaattgattgacttttggtttaataacatgtttgtattttgaactcgtgaacatgatgattcgataaaaattaattatttcgttatgatgtataaaaaaaaaatttttaatttatatttttatagtgaaaacatattagtcttgtttaatctataggacgtctttagattttaatttttacctttctaatattttttacccatatgactcatgtggccattacgtaaaattaaagtaggccctctttaatttatttgttttttctgtgtgtgtatgtgtcagtgtgtgtgttttaggtggtcttgttaagttgagtaaatattaaacctacactttttaattatcaatgagctaccttgcatgttgatcaaagttttagttagaaattacttcaaatgattgtcgttataactttgtcttcatacttttgccttgagaattgtgactggtcaaatctaatgtgaagtcccattttttggctttatcggtgaacccctaattttataggtaataacaagtttgtaattgaaaaaaatataaattaaataaaaaataaattaaacgttaatttatttttattttctgtttttttatctccttctcgtgacagtcttctcttccattttgacttcgccggcaactccctccaccaccacccctaacctcctttctccgtcattaacccaccacacccacaacccagcattggaagagtgccatatcccaaatctgtagccacgacctccccgcattctccgacgctctccctgcttgttgcacttcatcctctctgaccactcttctccggtcaaggccgtcagcctcattgcaccatcgctgtcgctaacaaggcacctccgtagcagagcaagcccatatcgtgtgactctccttccgtcgacttggaattcatactactagtagcagagcaccgccgtcatccgcctcctagctggcgacaactcctaccaccaccagtccaccaccacaccacaatggcggcgcaacagtgaggagcaccatgaaagaaatccaaagcaccaagaaagaacatgaaaaacaggggaaaaaaaaaaagaacatttaattgacctcaccgcagtgtcaccatatctctggctcctcctcacggcagatggacacttagtgtttgggattttgttggtgaagaaaggaaaaagagggaacggtggttgtggcgggggagagagaagaggggaggttgtgtgcgtgaaagttgctggaaaaagactgttccgacactggagatgctcggcaggtgaacaattgacggtggcgtggttgtggattccggcactgttcacctaacttttgcttttaattttttttttttaacttaatcatcaggtaaccgataaacaatctagaccgttcattttgatattaatatattcaacgatattgagcattgcttcatcaatgaatcctatttttggacttcaggttagacttaatcattgggacttcagttgtactatgtgtcaaaaaatcaaaatgagagaggtttgcactttgcatgtgttaatattaaggcgagtaaaatacatagttaattttgacgttaccgttttttttaaaatgaaaattttgactttaccgggtacccattcgttggatgctcttggaatatttggggaaacagacgacaagttttatttataattctgttcttattaataagtgccatcttgccccctttgaaaattaaaaaattgttttgcattgtttacaaattattataaccaattttcaattcattgtgttcttgggcgtggttaattagttaaaggaaaaaaaaaggaatgaaacaatcatttaagccactgaatcatttaaggtgtctccaaaatgttttgaatatactcttaaaatatttttttgttaatttaaattattaattaacaaactttattcttttataatatattgtttactcttaactttattagtaagattatataatttaaagacaatcatcaaaaatataatttaaatataaatatataaatgtttttttttttgttttgcatcgatgacatcttcaaccaatagtcagatattaaatgcatattgaatgagtattaacaaaattaattttgaataaaattggttttgtgaaattgattttagttaaaatttattttaaaatgatgtaatttatatctggatgttttaattgtaaaatcaaataagaagtgaaactcaacataatattttttattcaacataaaatttattcaaagttacttgaagtttgtgatttgcaatttgggaaaaaagggactggagtttgtgaaagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattaaaatccattacattatgaaattaatcatattatttattgatagtgaaatgttaaaactatttaattataaaaatttcactaataactttgaagctaaaaaaagttaaaaataaaataaaataagaattgataaattataataaattatggttgagactttgttttattttgtttaaaactgttaaactttacacaatctaaactgttaaaatatgtaaagttcctgcaatataatgtaccttgtaaacatggattttctatctcatacttacattagcgtatgaattaaagagacaattttttaatataataaatataaataaattcttattattgggttttctttattaataaatttatttattttttatcatggaatagaaatatttttaacctcttaacttataaagttaatacatatataggataaaaaaattgtagcaaaaagttattgtgttgatgaaagcgttattacatatttaaatcccgaccaaaacatttactactagtccaagaggagtattactaaatgagaagtagaatattgtcattaattgaagtattgtcatgtcatgatttggagccatgtgggatgaaagaggaatccaaatcataattactctttgtcctatttggttttccggtttgcagactataaagtaatgtgacaaagtgacaaagagagaaggaatggaatgaggtaacaatgtcgacagaatgacaggattggagtagggttcacgaagtatatcgagattatacggatatttaaaatatttgtaagtgaaatggataattgttcataatattaaaattggatatgggatttggatattagagtacccaatccgttccattccacccgtacatatcatatttatatatatttacaaaataatatatatatatatatattatttatatataatttttaaaaaataattatatttttttatcactaatattagaagtgtctaatttctcataatatcactattaaagagtaataaatcttaaattattgtgttggatcattatcacataatggaaaattttaaatatttaatttgaatttttgctgaactatgaaaatattgactttaacaataattatgttaaatgattatttttgtaattttatttatttataatttgaattttaatggatcaatattatattttcttgtttttaatattacttgtgttacttttaatgttatgtttgagttatttaagaataaatttttactataattgtagtaatttttattgatttattattattaattttatatattagtaaagtacatgtcgcatatatagatatgaatatataaatatgagaataatgattaaaattactacatgcacatgtatataacctgatacaaattatttttaaacacaacatatatggaaagagtactattagacattactcatacctatgtattgttatccctagattggaaaagtaatatcaaatattaccttaatctaaatttacaaaaattgattgactaaaaggctccgagatttttatatcataatttaaaaagttttcaagttatagtcagttttaagtttttagaaattagttttttttagtttaaaaataaactcatttaaaaattctttattttgttaaaaattgtttaaggatatgtttctcatattacaatgatgatgtcaatatgaatgttagcaatgatggaagtgatctcacttgcatagggctagtgatgatggtcagttgttattaatggtgatgatgttagttaattttggtggtggtaacttgaaagagtcattattcaagtagtgagagtgcattattataaaaactaaaaatcaaattcataatttcttctctttttttagttttaaaaatgaatgtaaaaatattttaaaattgaattaaaaatcactttatctttattttagccaaacatgttttgtttgaaaattacatctgaaaattaaaaaacaaaataaataatcaactttgacttgtaaatttgatgtatattttgtaaggtttaatttaatttctttcaaaccttatgttagtttaatttaggagacaaaataaaaaggaaggagaggagtgggagtgtgataaaatgagatggttttannnnnnnnnntttaaaaataaactcatttaaaaaatctttattttgttaaaaattgtttaaggatatgtttctcgtattacaaggatgatgtcaatatcaatgttaagaatgatggaagtgatctcacttgcatagggccagtgatgatggtcacttgttattaatggtgatgatgttagttaatgttggtggtggtatcttgaaagagtcattatttaagtagtgagagtgtattattttaaaaactaaaaatcaaattcgtaatttcttctttttcttaattttaaaaatgaatgtaaaaatattttaaaattcaattaaaaattattttatctttattttttagccaaacatgttctgtttgaaaattacatctattagaaaacaaaataaataatcaactttgacttataaatttgatgtatattttgtaaggtttaatttaatttctttcaaaccttatgttagtttgatttaggagacaaaataaaaaggaaggagaggagtgggagtgtgataaaatgagatggttttataagttgtttagaaaggaaaaaagtgaaagaaaaaaacttcctcttatttggttgtacaaaaagtgagagaaatacatagaaccttttggacaaatttttagtttctcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctcttacaaaaactaaatctccacatgaagattcaacatcctacttcaacaatggatcttaacaagatcagatcttaaggttaagatctcttagaaagatctcttattggagattaaacttgaaatagaacttcaaggcaacatttgtcatcaagcaacgctatcaaatttaattgtgtatcactatccaataattttttttctatcttttatatataaaacagataactaattcatcaaaaccaataaaaatagttaaatcagttagttttagttaataatatcataaattataattttattttaaaaatatttaaattaattggtttaagtaatgattatattttctttttggtaaataagtagtggttacatttaataaggttacatctccacaaattaatataacttatatcattaatagactaataaatgcatgagaaatgaatgaatgtctcgttaataaatttcacaaaataaattcccctgtgcaagacttatctatgttcttaacagttttgtttgaaatgtaagatgttaagttacttacttcaaagttttctgtattaagtttgaaaaacacctcaaggtcaaaaggataaaatttagtttgcctggtattttctacctatgaaaaattagctcagattatttctaccttgatctttctcaatacttaaaaaagtattttgcagggagagctactttagatatgaaccaaagtactaaaaagaaaacccaaacctgagagatgttccatagtctttaatctgggtaaaatcatattgtttatatgagatcttagcctctctctctctctctgtgtttttgggtccatgatttatatatctattcaaatttcgaaggctttacaacaaagggaaacctttcaaataaattttcaaaacatagaagacttttaagaaattacttatataaaaaaatagataatgcccaattaagataaagtgttctaagttttagccagagcagtgtcaccaacccatggttcaaaaatgaaacaatggatattattatttgcttaagagtattactaaatacactatataaatttcgtatacactatatgtgaacagtgaacggacaaaaatgcccttcgcgatttgaaacttacggatttcgttaccttcatacagattacggattgtcgaatccgtaagaatctcacgattttttttaagtaatacggattgtccaatccgtatggcccatacggattgtccaatccgtaggttttttcttttttaagttaaaatatattttttttaaaacaatttaaaataatggcacatgtagatttcaaacctgtgaccttcatgttttttaatgcgacgttccaaccaactgagctaataagtcaattatgttaaaaaataattaatgttgatacatataatactaaattttttaatgtatatttaatacacatatcttaatctttaattatttagtttatctaatttctttatcttttcttatttcagattcttattttattaattagagatattatgttcattttatcaattaggataattgttaggtatgatcctatcaaataagattctcttttattttaattttatcaattaatgagttatatataattaattttatttgaatattgaattattttgaatttatatataattaattttaattttaatgagaaataattcaatattcaaataaaattaattatatataactcattaattgatagaattaaaataaaagagaatcctatatgataagatcataactaaccattatcctaattgataaaatgaacataatatccctaattaataaaataagaatctaaaataagaaaagataaaaaaattagataaattaaacaattaaagatttagatatgtgtattaaatatacattaaaaaatttagtattatatgtatcaacattaattgttttttaacataattgacttattagctcagttggttggagcgtcgtattaaaaatatgaaggtcacaggttcgagacctacatgtgccattattttaaattgtttaaaaaaaatatattttaactaaaaaaaaaaacctgcgtacggattgggcaattcgtatgggtcatacggattggacaatccgtattacttaaaaaaaaaaacttacggattgccgaattcgtaagattcttacggattcacatataacgaaatccatatgaaggtaacgaaatccgtaaatttcaaatcgcaaagggcattttcatctatgcactgttcacatatagtgtataagaaatttatatagtgtatttagtaatactctttgcttaaccggtaaagaaaaaaatgtcaagactaaatggcccagaccaatggaaaaaaggtttacggtggcccaaacaaaggaagagaacatggattgggttgggcattttctttctatatcatttcattttctaataaacccaaacaatatcgagattatcctttattaaaaatttaagaaacttataacttgtcaaatctataatagatataccaaccaactaaattaataaattaattatggtaaaaaataattaatatcattatatataatactaaattttttaatatatatttaacacatgtataaatttacataattttttttaaataattaattttgatctaataattaataattaacgtatttttttacatataaaaattataatttaaataaaaaccataaatttaataaaaatgataggtttaaataaaaacggcattgggttgatatttgaactgtatcatttaattctttgctccgaacttcattcattttatcgctggcagctgaaaagtcaactctactctactctgcaactcattcctaggatttctacaccttgacaaatcctaggtactcttgtagtcttgttcgtttcatttggtttacgttagcatccacgaaactctggttgattttttttttttttttgtgtgtgttcacaaatgagaaacatattttcattattgttgttatcgttctttccgtctctgattttttaatgtttctaattatctgatttttcaatgtttctaactatctgatttttccttagttgtgaagttgaattgtgtccattatcattgttctgctttccatggttgaggattttaagcgaattaggagatttgggtgggtcagtttaggtaggtctggggagaacctgaattgatgaattataaatacttctgttttgtactgattaaaacaaaagtgcttttagttgagcagaagtacatgcacattttatgtggcaaaatttggcatattttgtgttgtgtgaatgtgagtgtcagtatgagaagtgtaccaaatgttccgtagtttatgcagtgctgtgttgttgttcctcatttaatttaggccttgtttggatttgtaaacacttacataagagaagagaagaaaataagaagataaaacaaattaaacttgaacttctcccataagtttgaaatcaaattatgtacttcaatttttatacaagttatctcatccaacttctccaaaaattgagatacataaagttgattttaacttaaaaagaagttatactcgtcttactttttatttcctccataaatgtttatggagaaacaggaccctagagaaatgtcttttggcatactttacttacctgttggctattgtcatccaatttctgttacgtacttcagaaatttggattgaatggagatgacaatgtgtcaatgtcaacaacaacttgttccaacatgattagattcagaggcattatcgggacagcatttgtatcaccatctcccaagaggaagcatgcaacaggaatcttgagaaattttaccatatgtgcctcaccatttatatctttacttgaccctataattgttcagtccccttcacttcaagtattggcttccaatctttcgctggccgatgtcccccaacggtcagaggagtggtttgcccttcgcaaggacaagcttactaccagcacatttggcactgcgttgggcttcgggaaagggagtcgtcgccctgagctctggcaagagaaagtgtttgcatcggagacacaaattatggaagcaaacaattccatggcatggggaacactcaaagaagcagtagctgtagacaatataaaaagatcacaggtgatgagatgagctcaatgaggtttgcagttcattcaaagcagtcttgtgactggctcggtgcctcccctgatggtgttattgggttcccctcacaacttgggatactggaagtcaagtgtccatataacaagggaaaacctgaggctggcttgccttggtcgagaatgcctttctactacatgcctcaaatccagggccagatggaaataatggattgtgaatgggttgatttgtattgttggacgccaaaggaagtactatatttcatgtgcttagggaacgtgactattggaacttgatacatgatatgctacgcgagttttggtgggaaaacgtgcttccggcgagagaagctctactgttgggtcgtgaagaagaggtgaaatcatataagcctgcatctactcaccaaaagacaggattagcaattgctaaaagcataaaattagctcatgaaacaaagttattttgcagagaacttgcaggccatgttgaattttatagctgattagagtttagaagtaataggttaagcattcattttgtatccaaaacattttcattttccaatgtgttagttgctttctgagacggaattggtgcttaagctactgcctttggcgcactattgtcttcagagctaacagcatttgtatagtgttgctcttcaaagctaacggcattttaccctcgtaagacgtttctgggtgaagcttttgtgatataggtgtttgtttttattttattttttgaggaaaaaattctaaagtggttttattattttgaaaattttctttctttttaaaaacagtgtaattattactacttttttaaaataaaaaaatactctcaagataaaccggtgaaaagattaatttgactgttatcgaaaaaaaagattattttgacttgcatgtctactaggaaaaggaaaaacatacaccatccacaaggacatgactaaaaataaggagaaatctatttaaagcagcatcaatttatattatgtaaatccaatgtgcgaactgagatgtagataattaagttatagtagtcttcattctttcttaccaccatagcattttggtcgttctgtcaatttggatcgattccctactttttcttatccacctaaacatttttttattctctagttttccaaacaaataaaaacttataagatacattctatagattagatattcaaactaaagagtccctctatattcatattcatttgcagtgacacatttttacctcttagcaacaactttttaaaatcttgcaataatcgtgccttagtttttgaatgactttaccacaccttttcatttatgctatgccatagtttgtttctccgtttcccctagcagcagaaagcaactaactttttaagaatctaatatcgtactctccaagttttcatatgcttgaacaattgtagcatctttctaaattaaccgagcagggaagaataactttcttaaatggccaacataggttgctaccaagacgtacatctgtgtttcggtgtaacataaactaacgtggcaatgtgtaggaaacaattctttattttattaactgcatttaattaatattaataaagttnaatgtgtaggaaacaattctttattttattaactgcatttaattaatattaataaagttcacttcaagccaagaaaaaaggacagtggggatgagggttttttttttttttccaggggtaggacaagcgtacttttctataacgccagatgccagatggtgaatattttacacaccgttaaaatgtcattatccttttagagccctcataatcaaggaagaataaatcaggataaatctcaatttcaaggtgcacggctgtaattataagagaaattctagacagtatgcaaattagataaaaataatcacaggatacatgtaaacacaggaatcattctgaacgatatacttttattatcacgattcattctgaacgatacatgtaattttgatactagaagagagttcttctagaagtcttattcattccatggaggcaaagcaaataaatagtacaagtaaaacaactaatcctgaggatctcttattcattagtccttgcacttcatctccacattcctttgtctttaccatttgaactttggcgagaaatactgcaaacataagaagaaagaaatgagtactgaaaatagcttgcagtcaaaggatagttattttattaaacaatatctaaattaagatatatgcatctgaaaagttttattgcccaccttctgaatgagcgacatatagtatggcttaactttttcaacatcaattcgcacattgctcttactgtagagatcatatttgttgtgttttgtattgcataatttataagaaacataatcgattccgttatatgttcgtcatgttaaggtgaagacaagatataaattgatatgctaaaacctaaagaaaaataattagcttactgaaatatttctagacacttcaagttcttaacatcttcactatacaggtgtttgtacgctcctgtctggtacaaagttgcaagattatatatatatatatatatatatatatatatatattgtaaattgcatgttatattgttatatatttgagaagggttatattagttcatagtagaacttagtaaaattaaatacgtatgatgaaaagagtgatatcggataaggaacaaatgccttaaaaaggtaaagtggtggtgtttcccttagcaacctgcttatagatctcaatgcgttattatgtgcataaattagataaagagtaatatataacatttctgtttcatttttttatattacatcaaaatctgtatgggatgtcggattaatatttgcatgtttatatcgactcaccaaatgtatgtactcatcatgttccaacgacatcatcacattgtccagtccgcagccttcggcatatatcccacttttcgtattataagctgaatttttgccatctgggttgtcctcgaagtactacaatgaattcaaagaaatatttttgagctgaatatataatcacaaatatttgtcatttataaggtttcttttattgagaaaattagtaagtacatacctttaagtatttgttcatgaaaagcacaaccaagatcgaggaaacaaatcttctacaacatataaaatggtaaattgattatttttcgtttggtttgtcagtagatacatacgatacatacgtgtgtatatatatatgattttcagaattttttatttgtacgaattccatttacatagtcaagaaaataagttgaaaggtcaatcatgaatagtattaattagtgaacaactctcatcaacaacagcccattgaagaagtccatcaaagcttggaaggagaagaacctttccgagatgtgcaaaccaacgaaaaccatcaagtcatgatcaataatgctttcaagataaaattcttctcattctttatgttgaaattttgcttctttttgaaataatgtaaataggtgaaagcaatataattaattaagaattagtatttaaataaagtttatatatgtgtgacgggtacaaatgggagcagtcaaatgtaaccaatcttcataatattagggtagtcctttctagtagcttcagctgtctctgcaagacatcttgaatttgagattcttctcaattaggatccctggcatccacaattttatcaacagcatctcacaacattcccatatacccattttccactctattcaatttcccatactcctccctcatcttcttaggctttgtttgggagttaggaggagaagggaaggaaagagattcaaggggaaggaaagggaggaaaatgaaagaagttctttcctccttatttaggagttaaaaatatattaagagaaggaaataaagaattaataagatacttttacaattttgcacttgaattgtgatttaatgctttgtattttggtgttttattaacacttgctggggtacgatagtaattttattaacactgactagagtaggatagtaattttattacttttccttctaaaaacccccaaataggggagaccacaatttttaggatttgaaggatttcagggaagttttaaaaatcctcaaattctttccctcaaaaattaaatctcccaaacaaggagatgtcaccaactaaacgtttctcttccctcccttcctctctaaaattcctctcccaaacaaaaccttaggcgcgcctgcaataatttagttacatataagatatattacctaagagtcattgtaaatattaatttgtgtatactattaagtttaaagttttgatatttgataataccatactgaaatacaaaataaattaatacacaattatttgacattgttgaaatcaaacttgcttacaaattcataattaagtttatgttgttgatagaattcttccacatatttttgcctttcgctttcaccataagaatttctattttttggagagaaaaaaacattgtcttacttagccgtcactttgcattggattatatgaaaagaactaatctataaaaatgtaacattacaattgaatgcaagcatgaaagaacgatttcaggaactataaattcatcatgtgaaggtgatttgaacaatgggaagtcaccatgcatccaacaccaactcattggtgatttcctgaggatgttcattgttctcctcaacttgagcccttgttggttgtggttgctcaaaaagcatttttcttaatatgagaagtaacagaagacaaaatgttagggaataagaaaatctcaatgaaattatgctatgactaaactggttgtggaagggagtatatataacctgcgtgattatattacagtcaatcatcatcacgtggaaaatctctaagaagggaaacaaatgctgtgctttatatacagtgttgacatattcggatgcatggaattaattgatacaaatgctctagctgctcaacttacgtgtgactgtcaataagggagtataaagggtcagtggcagatctagctaggatcctgggtcagtgacaacaattgagaatagtgtattcaaatatataaaattaaagagtataaaatatgaaaatattaaaacataaaagtagtggattcaaatatataaaattaggagagataaaatataaaaatattaaataattatatgtaattttttaaagtgaagaggtatatgtgcacaccctcactatgttgtatcagacaacttttcattgattagtaagtactacttttgtattcaatttttggatataaataattaaatattatctaactgtagctgttgatctttgtggcagttgtgcctaagagcatctttagtggtagattctaaattgggatcttagacaattttttgatagatcccatagtaccacataagattgaagatctctcaagacctttccattttgttctttaatggtagatctcattttgagatcttagtgagagagaaagaggaaaaaatttattcttttttgaacaatatgcagatcttaaagattcttttacaagaacttattctccatgttggagatctctctatctcttttattgggagatctaataaagaccagatcttgaactcaagatccttgctcaagttcttgcactaaagttactcttaataaatctatttgattgatggtaaactatcactggtaccctcatttatgttttgctgagataaaaaagatcatcatatgacaaatattatatttactcaataatcaaattgatatgtgcatatcaatcatcagcagctaaattgatatgttcctaacaattagcaaacaaatactgatttgcctttcaatccctaaaatacatcaaagattacattacagataatcacatggctattaatagcaataatatacacatcagccagtaatatttattgttatgtaaaataagaattatataaattacattaaaaatgtagtgaataatgaagtgtttaatagattactataattaactaagaaagactttatttagtaattgcatcttaagatgcattgtgaataaagtagcaactaaaccatgagatatacatattcaattgtaaacatcgaataaagaaaagtactaattccaaggccttctttccctcagattcagcatgtgaatcgtgaaccacttggcttatgcagctcctcaaaattcggtgcctcatttgttgaaatttgcagctcaagctgcaaatcctgcatcctctttatagagttttcgagttcaaggttcatatcatcgagtgctcccttcacatgaagaagcctttttaagctttcacttcttgaatctgctgtgcctcttcaagagtgcttagctgctcactacatttattcccagattaacaatctgctcttgaaaaaaaaaaacatcattatgatgggaaaacaataatgtcaactttcaattatgtatagcagcaaattctaatgagaggtttaaaaacaaataactgttaaaacaccaagagagtaactgatatcatcaatcatcagaataattactcctgtgattggtgaaacaacagcacttgcagcaaaattaacaatgattcaaacctagtgtatcaggacttgatttatctccaagacaatgtagccaaaaactcaatgtcgcagcatctgaacgctattaatgtagcttcacatctcacctgctacaacatggattgaaagttggcctctcccacaagtaccccatcaaaacaaacctcaattggttggagtcaaatgagcacaaacaatatcagctggtaaggtttactgaatttaaagaaataaggcaaaaacttggtgacaatgttctatctttttaacttttgagcatttgttttaagcataataaaacattattttaattgtgctttttagtttctccacttgatttggaatagagtgttgttcaaaacctctttattggggtctgtcatggttgtttcaagggtgttatcttttgcatttgcttgcattagccacccaaatacaggaagccacgatcccttctaggacaggttatcagtaaaacctgtcaaattgcattcaaaattgctcaaaaaattaaaaacatactactcagaaaggtacatcggacacgacactgatacttcgatacgagtaatgtttaaaatataggatatgggaacacaaacaaatctaatgaaatgaaatataagtaacatataacaaatatctaaattgatagtatattcatctttttaaatcaattttttatgatttttcaatgtataaattgtgtaaagataaagacttaagtattcaagccaataaatatatatttttaaataaatctaataagaagtgtcaaacatgggttcaacacggacacttcaaacaaaagatgtccgtgcttcttagaaaacatatacaagtaacttttccttttgctaaaaaattgtaatagaaactaggaaagcatacaaacagaaaaagtagaagcaggtcctttgtcctcaacgtaacctttgtcgtttgtctcctgtgtgtctcttgtgtttggtttagatggtagaaataaataaataaataatattaatttaaagcacactgtaaaagatgtaaatctcacgtaaaaacatgaaaagtataaaatttgtctcctatttctctatcctaaatcaaacatagcccatttttatgctcctcctagctagtgtttcatttttcattattcgtagacaaacgcatcctctatacaatagacgaatattttatcattaaaagtcatatttacttctctgatatatatttttattcaaatttcttgtttttttatacgtttatgcattaaattattcattgaattcatgatatgtgtagaatggagagtgcaagaataagccagcagatgaaccttctactatgtacactatcatgtttaatagcttaggaacatacgtatagatgttcaataacttagcagcatttttaaaatgttaacaaaaataattttataaatgttgcaataacttggcaacctttttaaaatgttacaagaacatatttataaatgttacaataacttgacaacatgttttaaatgttacaaaatgttagattgataacatttttaaaatattacaattaatatgcaaaaatgtcactaaaagtctttagtggcatagaatttatcttatatctgataaaatgtcgcaaaatataataaaatcatttattcataattttatgatatttttaaatatttccaaaagcatcttttgttgcagtgatactaaactataggggtacttttgttaataaacacaccatttgtcaatacaaaaataacaaaatgttccttggcctaaggaatcaaaactcagtttgcgaccaaaacttgaggtcatttgaacgcaaatgaggtttaaggtgatttgaacgtgaaagcaagcacattcatagtaatcctcccaaaagcttacacccaaaacacaaggcaacaaaaacgtaatttatggtttttgaatgacttttaccacaccttttcatttatgctgtgccttagtttatttctccatttcccctaacagcagaaagcaacaagtatttgttttaatgcactcatcttgggcaaaaggaagagagctaattgttgttaaagtgtcattatccttatgaatccctccatagtcaaggaagaataaatcaggaaaaatctcaattttaaggtgcacggctgtaattaaaagagaaattctagatagtatgcaaattagataaaaataatcaaaggatacatgtaaacacaggaatcatgccatttttgaagacgtccaacacaattacccaacaggttagacttctataatcaaaacatcaaatcattctttatttaagagacaatcgaggccaacataacaagaaactctttcaatacggatcggggaaaataggaacagaaacaaatttcccagaatatactcaagtagaaaataaatagtattcatttttaggtctcaagtctccaccataaatgaatttcacttgacataaacatggatatttaaagacatcataataccactttccttattttcccctccaaggatggcaaaaataaaaaataaacagggtacatacaccactgcctggcaagagtgaatttatcaatacagctaatgaaaaagtaaccataagtctaaaagatcagagtgttcagactggttatgcatgcattagagccaatcgcaaatgttatttgaatgtgatgttgcaaagcccaatgccccgactgcagccctcataacttcataatcacaacgtgccacgtaactgaaaaaccatagtatgcagtaggtgatcaataataatcatggtaatcatctggttcctgcaggttacactctagtagctgcaggaaaaaaaaaaaaaatgatgtcccactttctctacaagagaacaatccatgaatgaatcccacttccaagagaccaaatacagaatgccacacaactccaacagcacccaacatttcatatgacttccatcggagactttctcctcacaaagacttcttcaacaagatactatgacaaaccctagctttggtcatgaataacagctgatttatctgatccaatcttcctatcttctctttctgaacatttgactagctgcttagagcaagaagaacaaagcaattccagacaaaatgtttcctcatattcactatcattgatgcagcaaccacactggctacatctgggtatgcatagagtgcatgccctgcaaatctgagtagtgtgttccaccccttgacaactcaccgccggacaatcatacacaagcctcaaattctggcatagtggacaaacttcaatgtctatgactcgatcatcatcacaggaaagatacaagttgcccctgcaataatagtgtggtttgtgagagtgctggagcagtggactatcagcccccaacaagaaactcagctcttcaaaatgcttttgtgtaacaccataaagaccacctatgtgtaaatgcttcaacccttgggtacccatagagttataagcttttaaaatacccacaataccctcaatactgagtcttgtacatcctggaacacgcaactgcataattttgtggaaaaaaattacttagtagtaaaataggtacagaaaaaaaaaatctaaacctgagctgagctcctcaagtattcaatgctcagataatttattgcaataaaaagttgacacaggccagggattaaaaagcagaccaacagggcaacaataaatcacatgatacatgaaactataacgaacatcgtcaaaattactttaacaatacaagatctgtaaaattcataagaattatttaacctgaatggcatctaagcagtaaaagaagcttgaatgaatcaaagttgacagttgaagaactaattttttttatacaagttgaagaattaatttcccccaactagaatattagaattaacaatgcattaattgatacaaatagcaaaacaatagaatattagaacagtaaggttggcaaattaccaacacattcatacagttggagtcaagcatatactgcttaattattttttgccaaaaatcaagcatttcatatacctacatacctctaaaataaccccaaattgatttcctgtaatggaagacagaaaaagaaatccagaaacaaatacttatgaatgaagatggtgtaaaggtcaaatgttctgcacaaaatttacagacatgccaaactataaaaatgggtgcaaacaagtgccctaagggtgaaaatcaataaatagaaaattattatcaggaaccaaaattgtaaattattattacagtgccctagtgtattgaaaatcacagtgaaggtacattaatgatactaataaaatcttctcacgtttgattccttaaacaatgtcctaaagacacttataagcatcctgctataaaaaaatagaacaaaattcaacatttaatcaaaataaaacaacagcaccagctaacatgatccaattattcataaaacaacatttgcatactttagatgaatctaagtttcaatttgaaattaaccaacagacacagattgctagtgcatgttcaccttggttaacttgggattgccttgaagaacccgcttcaaaccatcatctgttatcctggtacactcgaccagactcaagcactgaagatgaccttgagccctgttggtcaattgaaaaagaacatcatcggtaattctctcattcaaaggcggatccacatgaatactcctccataaaagcggatccccacaaaccgtgaaatgcaaagatttacacaccctttcaacaacaagcagatcagacaaacccagataaccaagagaaaaactcaaggccgggtgaggagcaacatcacccccatctcctcccccatcccgtctcagaacatcaccagagacatcatcagacccgctcgtagcaggcaaacccgacacttcatcataattattaacagatccaaacccaaaattgctcgatgcagcagcagccccatcatttctcacagaaaaactctcgccaagccctctcttctcctcaacacacgacgcatgtaacctcatagcattgttccaaatgaaattcaacccagcaaaaagctggtaattgccatcactcgcgccaagctcgtcccttcggtacccaccataatcaacaatctccaaatcctcgagccacccggtgatggcggtgacggtggtgctgatgtccatgccgaagggatccgaaggcaaaagatcgacaatgtcatcgtggctcgcaccaccaccacctctatctctcccataatcaaaacaattatcaacaacactcttctctggaattcccatcctcatcggcgaaaccaaattatcctcagaaaaaatcggtcgatgagagaaattcaacgccatcgcatgtatctatcgacctatctatgtacacaaccctaaatcaataaacaaaccctaaatttttttcgagacgcttttttttttttttcttttccttctcagaataacagaacaatacaagatgaaaaggaaaaaaagtatggcactagcagagatctaacaagaaaaccctcgatttcggatggcaaactaaaacgacgcaccaaaaacttcacagagtttcttgcgaataacccaattgacaataatttccctaaaaaacagctagaatataatcagaggacggaaaatagaatcgaatatatccacagaacaaaaaatataaaattacaaatcgaaatccctactctctcttctttttttttgttttttgtctcgtcaacaaccgataggcctgaagattaaaaggggaagggaaaaagaagacaggataaggagggaaaaggagaagaacgaaagaatttacgtgagaaacgaaaacgaaaaggaagaagaagaaaaaagagagaaaccctaaattgaaaatgagaaagaaagcttatagggatggaattggaatcctgaagaatgagttgagaagggaaaagggaatcgcgtttcccctcgggtgggtgccgatgccgatcgagttcgcggtagcgagcgagagagaaagagagagaaaaaaatgatgaatatagtatatatatacatacaaaaaaaaatattatgaggaataagaaagaaagaaatttggggcccaaaataaaaatgagagagaaagagagagggtaacggtgaaatctcgagtgaaatacggggagatttcgaagagtgtgggggagggaacacgtggcggcaaaacaaaagtccttagaaactttcttaggcacttctcaatagggtgcatttttttaaaaaaattacaagtaaattttaaattaatatcaatttagaagaaattgtgacgccttttaaattcaaaatcataatatctgttataattttttaaaagtattaaaatctaaaattttacaaggtttcattttttttataaatatgactttaaagtcataacaattattattttgttttttacaattttaaattttgtaacaataattttttatgtaaagtattttttataaatcataaataattttttattttaattatttaaagaataaatatatgttttatttttttattttatttaatattttctatattattttgatatgatttttaatatttaaatattttattttatttaatatatttaatttttttatattttatatggatttttaaatatttttatattattttatttaatatatttttatattttatatttttattattgttatgaattattatttatttttaaattaaaataaaacttaaatataaataaaaatattaaaatccaatacaagaagataaaaaattttgactcatacccataagaacatgtgtgagacattatttaattattaatatttttattaaacgaatatgcaatacatcttactatttttatttaaatttaaacttttataatattttttttaatttacaaaataaataataactcttaaaaataataaaaatatattaaataaaataatataaaaatataaaaaaattaaatatcttaaataataaataataaataaaaccatataaaaatattaaaaaatatacattaattctttaaataattaaaataaaaaattatttaggatttgataagaaaataattattttacaattttaaatttataaaaaaataaattattacgactttaaagtcgtaaaaaaattaattattacgagtttaaaatgatatttaaaaaataattaaaatagtgtaaaattttactacttcaatatttttaaataaaaaaaatataataannnnnnnnnnnnnnnnnnnnnnnnnnnnnnnnnnnnnnnnnnnnnnnnnnnnnnnnnnnnnnnnnnnnnnnnnnnnnnnnttaattcagaagacataattgcaacttattcttgaataaatattaatttaaaatatacgcttaaataataatttttaaaaaaaaattacaccctattaatacttttgcccactttcttcgcaactcttatgtatgtggcgggagaaggaataactctttcgcatgtattgttaaagccaatcatccataattatcgacaagtggttagttcaaattcaaatagaattgaatttgaatttcttaaataatatctcaaatttaaatttatgaataaaaatatatggttaaaagatttattaaagataattagccaaaaaaaggttcatagttcattgaaatgtgaaaatttgtaaaaatcaaatattgtgagatgatattttattttgtagttatttgtgaaatgatatttaatatttctaaaaattggtaacttgatttttgtaaggtaaatggattcctctactgtgtgttgcatatttgttaaatctactttgttatatgaataaaaaaatgttttaatattttatgcatactactgtcattggtttaggtttttttaagagataataagtaaaatgtataaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctaaagagattcaattaaaagaatcttacttactttatatgttttgaggttttaaaaagttataaataaaaaagatactgtgtcatacgtaaatgattaatgtggttattgacatattttcttgacttataagacacacacaaaaaaatagaaatattattcataaattagtatatacaattagccaattacaataacttcctaggttttgtgtaattatacaagtatcacatatatttttaattattatatttatctctcttataagaggtatttgtgtaatattttcaaacatataagatgttattagtataatattttcaaacttaaataaggcaagattagtgtacagaaaattaaaaaggtgaaattgcatgtgattttattaaagcttaggatatattacttgtaatgtagtccttgattttgcaaaattattattattattattcagtctccaaaatttaaaatcatcacaaattgacactttttagtggtttcaagttgttattatctaattttaaggatccaaatataaaattttataagctcaaggacccgattgtaattttcttttaatttagaaacttaattaaaaatttgcaaacaatttaaagacctagggatcaatataattttttaaaaataaaacaattgagttaatgatattaacatagtgattaaaagtgtcattctgtacttcataaaaaaaaaagtgtcattctgtaaaactattgtttaatagagtggaagaaaatggttctctccatagaataaaaattgcaccttaatttcctgtgatctcacgtgtgttgttttatggaagattgtatttttattttccggggctaccaaggaagaggcaatctacataggcttgatccagaagacttttgaaagagcaaatggacaaattaagtaagaataaaataaactgcgtaattccatattaaatgagcagaagatggttttgggagtaaatgcaggtgaaaatttggggggaaaaaatacttaggatttcccaccactggaaaatcaaaaaccaagtgtttgattttgtgttggacaaagtcaagaagaaactaaagggtggaaggagaaagacgttatttagaataggaagaagttataataaaatgcattatattattgcccaagcatttcccatcttttatgcaatgagttttgctttgcacttccaaaatcactttgtgaccacattgaatgcttaattaacaaattgtattagagaggaaacttcattggcttagctgataaagacttgcaaacttcattggtgattgaaatagagaaatgattttcagtattttttcttcatccgaggcacaatgtatataaataccctttagaagaagtatgaaggaatcatggcagcatgttactcgtattttaagagtaacttttggggtgaatgataatatatctaatgattttactttaaaccaaaacttgacacatttaaacttccttatgctcttagtgaaacgataatcaaatgcgtgcacgaatacatttaaattgtttattttaagattataacgtgattgatggaagaaaaagacattggtgttattgtttaagcatggctggtaatttaagtttataatattttattataaatttaataaagaaaataacattttggttatgatatgtattccacattttgggttgcttgcagaaggaaggtagcaacacgttggaagttgggacacgaaaactctatgtaagaaactatgaaacacccccaatgaaagatggccatatgctaatgctattttttcagacagtgatgttaactggtcaattttcaacccaataatataaccgactatatatccagagcatacggtaaattatctaaaatcatattaaaatatggttaaggtaattttagataaattttcacatatttatttttatgttaaaaaactgatttagatccaaaatcaattcagagtttaaacaactttgggtagcttttatattcgataaaaataaaattatactgaatttaactataaacttacttttataataaaaaatttcacataaatcatatcaacataaaattaattttaaccaaaatcaattttataaaattaattactttttaaaagcatttttttctcacgctcatccaaacatacttaattggtccaaaaccaaataaatctttaaatatggggtacaaagtcgactcataagtctatttaattctagaaaaatacacaaccctttagtattagacgtagaggaaaatgatattaaagtagaccgagttctttcttaaactatattagtttattatgatgaggagaatacactttctatttgcttgttcgagattctagaccttttaaaaaaccaacttatttacattttaaatatacattgctctatatttagtgatatgagtatagattctgatacaaataatgacctcgatcgtctccattgactaactactaaggatttcttttactttgtgttagcagagaatgatgaaggagggactagcatatttacaacacattgacactttttttttctggtatgaaaattgaaattcatttaaaggtagaacaaattaagctagacaataggcaatagcataatttatgccatgttctagcacaaaagtgtgatacaaaagtctccctaaagctatacagcccaattatagctacataaccaaaattgaggttatattacctaattcagtaataacaataaaattgcagtaacaataataaaaacaagaggcctgattatgctaccaattcagtatggagttttgaagatctagtatcaagatgattcattgaaagttgttatgtctcgacaactatgcccccatacacttactaaacaaggacacaagaaatgagtcaatgagaaggtgataatacctgagattcgtagtacctcctctatagagggggtaacaatacacaagtagttgatcagcagtggtaatttttctttatggcgcatacaaaaagagattatccttttgggtttctaaggttgtcgcttttatggatctcagccgtatggataaggcttatactaattcagtaatttatgattacccctactcagtgcattaaaattacactcttaaaataattagtaaaaaaatgttgcaaaagaatacaacattcatttgacaaaccatcaatgctacatcctatatgtattaatatacaatcttaaagtattcaaactttgatactttgttgcaatatataattagagaataatgtaagtttacgcccacaatatactacaggtcttgagcgttggaaaagagcacatccaaatcaaagaaaataatgcgttcagcaacagaaaggtgacatttcaatgattcccataaactcaaacaaattacgcacgacaagcttgcaaattgatgcttgcatctaacagatatactcattccttgaagcaaaactgacggttttgaattagaacccagtgtatgtatggaccctcatcttagtcattgaaaacagcattaacaaattgtcaaataaaaaagttcatcaaaaaccatgatcctatttaattcctcgatttctttcttgacttggatgaaggcttggtttgctcggaaactgcattctgcacagctcctttggagtttccctggtttgattttagatttgaactgttagatgaggcaccagtatcatgcttatctctaactacagcaccttgagaccctctcacttgagcagctcttttgtccttcctcttgggcctatatgttgatctctccctcttgggaagccacctttctggatctgggggaggacctggatttgcagggtcaaaccctttaggataccttggctttctctttctctttttcttagattttgtcttattctttccttcctcatatgtttcagggacaccaatacgaggagcatcaacttgtttcactccagaagtacgctccaagctgtccacatcaattccctttaaaccaggtagagccttcagttgcttttcataaagctctgccttagcaacatccatgcgggcaacggttgttaccagcccaactagtgcttctatgctttcctggcttttgacgagctgctcatagagttgagcagcatcctcttccttcccatgcctcagcttgaacaaagcagcttcttgcattatagtattgagcttattgtcctcagtcatagcattggaccaccatttagttgcagtgtcaagcacagcagctgcaccatcaatgtcaccagctcgttcttttaaagacacaagggtggcaacagtagcaggcatgtgttggatatccgatatcttagtgagagaatcggctgcaatatgtgggtggccagcagcagcagctacctgagcccgggctaagtgaacaactttggacttatcagggaacttactagcaaactgtgctaatatttcctcagcccttccagctttgttctctctaacaaagagggcagcttgcagcaataccggtatcacactttctggaaacatgtctggtaatgcagaaacaagttctcgtgcctacaaatagtaatgatcaacagtatgctcccttgcccagtttcaaaagaaagaatggatatacacaattgatgattcaagaaggacaagacagagaaagaagaaagacctgctcaatcttattggcatgaagaagtaaaagaatcctatttgcatatattgcttccttttcttttgctgaaagtttcaagtctagtccaggagctagtcgaaagctttgattctccttgtcttttaatcgatcaagtttccttaggctatcagaaacatcttttggacctttcagtgaaacaagattgttcacggccaccgcaattgatgattcatcagccatatctcgtttaatcacatctgtataagcttcaatagcatcttccttacgcccaagaagctgttcatccatgataaattaatatttccagctcttggaaaaaataatacttgtttgaaggagaaataaacttgagatctaaacatttacctgctgaacataggctaactgtacagctataggagacaattcaatttctatctcatcatcagccaagttatcttccatcaggacctcttgaccaattctgatccaaaatatatgaataaacataagtatatggcttaagttaataggttatcaattaatgagtaaggaagtaaagcaaacagtgacaacaaagcaaatttaaatgtaaattaaaacaatcaacaatgaaattcagattgtgcctcatttctagtatccccatctttttcacctttgaatccagaaccacagctcccagatcagagctctggtacaaatttgttcggatggatgtcccccaaattacagtcaaaagtttctcactcgcacacttgtcaaacaagaaaattaagatagaaacactatagaacttcaagggttcctccctgccctaaggctccagttccttatcctcactcacccaactgaattctccttctcactcatttccaactgcctcatagacagactattatcctgcaggtcattagcttgagtatttcccatccttccctttttgtacccttggcccaaatcactgcatgtgtttctagccatcatcacgtacatctcattcccatgagtctaccacaattaatacagcaaacttaaattgactgggcaaatggaagagacatagtcacatacatcaaacaataacatgccaaaaaaaaaaacaaatcatcaaggattcaaagattctctcaaatactttagatttcctaaatcgccaacaatacttaataaggataacctggccatacataaaactaatcctaatctcaacaaatctctactttgatgaatgtcttggaaatttataatagatccagcttgaagaaccaagctcctcaaaatcaaatggagaaggaatttttatctgccaaaaatcacaaacaataaataaatacttatggtctctctactcactattagatacacataaccttatctgtcaccattaatgcttctaagatgtccttcacactacccctcaagtagaagcctttcctctggtattcaacttttactgagcatcaaatccacttttaacaagagctacatcttaatcaacatgttactacacaacaagccacatgacttttaacaccattcatcaactacagtttatccaatcttttttccaagtcaaaccatcagatctaataccacttattaggatcaagggcatccagattcaagaaacgaatccagtgggcttgccaagatcacagcaatgggccagataccatatctcaacccaaaaccatgaggcattatgttcatggatcttttcactttatatggacctcaatttgtccatgcttttccaacgtgggagtactttactcacaccccacattccaatcatatttgatttcccaacttaaaggacctaattactattggtaaagataaaaaaatgtaagtttgtaccataaatttcaagtgcattaaatttctaaagaaagctctagaattcgcaggtacaagctccaaaagtgccgtagatatggtatctagcaactgataagtcagacataccacactcatattacagtgacaaagagcagggggggggggagattgttatactatagtatattagtattatatattaaccatgaaaatgcaggcaaatttgttcaatatcatgatttctataatcaaaatagcatatcaccttcggcctgacaataagagttgttctgcatctgtgtacttattccttgcaattaaagaacaagcagtgttgtatgccaattcaaagctgcttgttgccttaacccgaagtgaatccagcattccttgaacttcagatgacttgccagccataactagagcagcaacagaatttatttccatgttatcaatcttggaattttggagcttgtggtagatatctaagcaagcattcattttcccaagacgatacaatatctgacattccaaaagcatagtttcatcattgctctcttgtcttttcaaagactccaaagcttcatccaacttgttttgtctgtataagcagtatgcctatttagaaacaacaaagtgaaaaacagcaatcaatggtaagcattcatcttttctattagatcatgcatgaagcaatggtatgatgaactcaaacaaggttttctttcaaaacaattgaatctgtatggttcttttaaaaggagtggagcctgcatatggacttgaatttgtaaaaagataacaaattatacagacacagtgaaatacagaaacaattaatataaccaatttaagtaaaccaaataaatggaaaacaaatacatcaaacaagaacatgcaaaaaataacaaatcacctaaaattcgaactatttttcttgactatcaagttcactcatttataatttcctcgtctaagtatccaaataataaacatcagttggaaaaagctgctaagagtcccacatacagcagcagaatggttcaatttcataaaaaaaactcaaaactaaaaggttagacttcagagtcagacatttgataatgatttaataacaatttgcatctttgagtttgattggaggtatgctgcctaaatctttttccttccttcttcctcaatttctcttgcagtcacaagttcacacttactatcacactagaggataatctgcactattataccatcctaactgtaaaacccttccttgtccactaacctaaaatcctcagttcttattaacatgcattttaccatttccatccagtatcccgcaattccatgcttcttgcacttcaaccagctttttatttatttttatatctaattcaatccttaacctctaaacacacacgtaaacattcgaaatctacaaaactcatatagcaataagcacatcctcagatccgtttccaaattcgacaattgaccgacgaaaaagcagaaaaaaagcggaaaatttacgtgccttgaggaaatgaaaatcatcaagctgcttcttagaggactgaatggcggagagtgcgtcctcgacgcgatcattttttatcagcgcgacgaccttgcatcggagcgcgtcctcgtcgccgggagcaatggcgagaactgcgatgagaaaacaaatgaaggcttaggatatgattaaaacgaaaggcgtttgagaagagaagtgagattaattgacggactctgatcagtgagcttgacggcattgtcgtatgcggaagcctggatgtggcggttaagcgtggtaaagagatcttcgagggcaggaggaggagcagactgcgacggcgccggtttgggcttcggagccattaggtttcaggcagcaaaccaaatctctgaatcgtgccaacgccaattgacttgcgttttatgttgtgttgtgtggttcagtcgggaaagaaaacgggtcgggtgtggctgcgggggttttcttctttgtgttgcctatttttttttttttttaatattcaatttaatctataaattctaacatttgagtgttaaaagataaaaaaataaaattttatttctgaattttcaaaaaaatacaacaaaatcgtcttcttgtcaactctcttccttatcccaaatagatttgcctctggatcatgaaacttatttatctataacgtcatgtgtataaacacataatcacttcggttgatgatgaatataatgaactaatttgtcatcaaattttcaacaaactaattggtgagattgtgcacaatcgataccctccgactcacctccacttgtttagaaaaaatcaaagctctaaattgacaaaatgctagccaaagattcctaaataataagtttaggaacagagtttaatgtttattcattcataatataaaataagtttatattattatctaattataaaatatcgtttgaaaataatttaaaatagttattttaaaatttaataaattatcaaatttattatatataataaattatgatgaaaagattatttaaaaaaatttacaatcgtataaccatttttctcttatttaaattacacatatgatcaattttctatctaaccgatgattttgaacatctgatctgatttttaagatattaataaattatacttacactttttaataacttgttcaaacattacttaatatatctccctatttgtctatgcatttactgtaaaattttcatttttcctcttttactgtgacccacagggcaaaaattattgatatagttttgaatttttttactgcatatagttttaatttaattacaattaaaagttaacaaatttattatatatactactctgtatttttttatgatattaatttgtgaataaataatgatgtgaagttattttatattgttttgtgtataacttttttttttcaattgattcactttctcttgaaaaagatatagcatataatgctagtcttttccatctttttcctacataattgagattattttttataattaagtgagatcctatataaaactgacggtcatgtgaggttttaataattttttaagtaaataatttaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttaattaaaaaaacattattatatgataaattgtgtgtagagagagatggagcgtttcaaatgtaaaactcctatgaaaaaagtaaatgaaaactttcaatgatagtgcttgtattacaattaaaataaatcgagtgagattaaaactcaattacgaacaccttttatggaattgagagacactactaaatttatgtttagaaaagatttataacgtatgtgtataatactctcaccatgtctaacgcagaaacaacactcaagaacttttatgtttttttttaaactaatgtgaaaattagcaagacccggaactgaataaatgatgctcacacactcaaatatataataaaatattttgtattgtttttaaatttaattacaataaaaactagatgaaaattttcaataatagtccttgtattacaattaaaaaaattgagtgagattaaaactcaattaggaataccttttatgaaattgagaggtacaacactaaatgatgtctaatgtatagaactcgagtaaatgacatcaatttgaggtgtcttatgaaatggcgccaccaaacagtcaaacacacagtttaacatactgacaacttcatgagttagttgcacatagtgaaaattagttaaccaaatgatttttctcatgacaaactatcaacaagaatctctatttagattaacgtctcctccaatctatatgtgacaaaaaaaactctccacaatttatttgttttttacactttttatgttattttttttattacacttgtgtaatcaatacagccgtatacctctcttcctacctagcttggcacattcaaataaggtgcatcaacttggtacaccactcttgctagtgtaagaagtatgtttattaggaaaatttaattcaaaaaaaatatattgagattatcttaatatcgttttaaatttttattactgcccataaaaaaattattactactagtaatagtaaaaagaaaaaagaaaaacaggccggctcgttttaaaattataagatagcgttgattatgacatgaaatactattatattccatatatttttatgattttaatttttctaatgaaatattatattttatttgtagtattcttattttttcagttttaactttttattattgtgttttttaaaaaatgactaactcactcttagagtagacatgttttcaatgttttaattatatttatttatttatcttaatatttttaaattgaataaaaataatatatttatcatcttaaaattatataaatatttaatatctataatataataaaaattaataaaaatattgttgggggatttaaaattattctagaaaattaacacccctcatcatgcatgttccattgggtccacttgcggatgaatagaccagttgatacgattaattattattgaaataatttatttaatgataatcattggtaattaataagtgtgcaagtgaatataatcagtgtcaatttgaagttctctttgtacattaataccattggtacataatttacaatgttcctttttaaattaaattgagtattttatttaactaccgagatgagtattttaggactgtagttattaattttcaaatttaattaaagagaatattagtaatacctataatgttatatctaattaagtgaagagtctaactcagatcataaagtattcaaaaaaaattatatttatcttcgattcatataaattaaaaaaataatattaaatataaaatttgttctaaatttcataagaaagttatactataaattgtatgaatcaatacaaaaaatgacaagaaaatccatcccatcttttctacattcatcttcatctctcgatctctttgtatttcttcatctcattctccactctattgtatcaatttttttcttctttttatttctcccctttcttaacaatcatatgcactgcataggagtgtttaaactttaaacaactaaacataattatcctagtatttagtttcacaacacttcttctgtttcaagccttggaaaatgtaaattcgacttacataagggtcttcgagaaacgaacaaaaacaaaggtccaaaccagacattatttatttatttttaattaaaaaattaatattaagatgcagctacccttgcttcattataatattaagatgattgagataattctaattatagtagtatatatatatatatatatagcagtagttatccttgttgcaggcaaaagcatccattgatataccatagtccttttagtcatacaaagcatgaaaatggagttgatatcaagagaaacaatcaaaccctccacgcccaccccttctcacctcagaattcatcccctctccttcgtagataacatcgtttttcgcaactacatccccttacttttcttttacaactcctccacaaaccatgaccaaacatccaaaatatcaaaactcaagaaatccttatcccaagtcttatcccgatactacccttttgcaggcaaactcagagatcaagtttccattgactgcaacgaccaaggagtgtcctttctagtcacaaggctgagatgcaacctatcatcaattctccataaccccacggaagcatcgttgaatcctttgttccccgatgaactacagtggaagcctatgaagaacaaaacttcaactatagtagccatacaaataaactgttttgcatgcgcaggaatagcaataagcgtgtgcatgtgtgacaaagttggcgacgccgccactctttcaaacttcatcaatgactgcggcacactcaaccgcgaaaaggaacaagaaacaaacattgagtgagtttgtttaaatttatctttttaaaagataaactgtttttctattgtgagtttgttcaaatcatttttttctgatttatttatcttaattaaactactttaatttaaaataagtaattttttttattttttttttggagacgaatcttatctttctatttttttttataaaaaaaaacatacatttttaaattatttctatttaaacaagctaagtcattattacccttcgcagttcccgggggttcactcttcccgcaagaaaacttacctgttttctcagaagctttgttcgtggaaaacgacgccgtttgcagaaggtttgttttcgaggcctccaagatcgactccctcaaagccatagtgtcctcccacaacgttccaaaccccacgcgcgtggaagttgtcagcgcgttgatctacaagcgcgcggtttccgctctagggttgagtttcaagacgacgtcgttccgcaccgccgtgaacctccacaagagaacggttccgccgctcccggagaagagcgtggggaacttggtttggttcctgttcgtgcttagcccttcggaaacggagctgcatgagttggtgctcaaaatgaaacaagggttgggtgagttttgtggcacgtacgtgaagaagtatggagggaaggataagggcatgtcgttcatctcggagtgtctgaagcaggctgcttcggttccagaggctggtggttcggatgatgaggagagtcaaatagtaaccatgttttgttgtgcgagttggtgcaggtttccgatgtacgaagcggattttgggtgggggaaaccggtgtggttcaccactagtgagtgtcccgtgaagaatagcattgttttgatggatacgagagatgggggtaggattgaagcgcttgtgaacatggaggagcaagacatgattaggtttgagagtgacgtggtgcttcttcaatatgcttctcataatcctgcggttggacatggtaattaagcttacgaatttactgcatgtttgacgcactttcaatgcagatccaaccactaaaaataaaatgaaaaaaaaaagtatttttatctcaaaagtaaaattttcattcaattttcaaacatgcactcaatatatgtttgacacttagtgtatgtttgaaaaaccagtgctaagacactgatcgtactttggatcgaaaagtacgtccttctttacttttgaaaacgtaagttggactgtgcttaccggcaacccaaacacctctttaattagccatggtaaagtcattataggaaagagttcggagatctctgcaatgcaatgtaatgtgtgtacacgaataattaaagaagaatttggtctataaacgttggagaaatattgtttatatgctattgttaatttgttattacttgttaagagagtttgacctgactcacctctatgcatgtggcactaaaaaatttaaaggatgagattgagcaattcatttttctaaaaaaaattgaaaaaccttttcctttacctgcaactacgcttttctctctttacagtgaattaattaagatagaaaaaactgcgatcaattaactgcacgcataagtgggttttatgagtgatggttttgtttttggtacgttgaagcccaaatttacataattgatgttaatttgaacagatgtcagacgcgttaatcaaggggtcaatttggatctattaaaaaaaatgagatcacagcttgcaactatctcatctagcaattttgccatggataactctatctattcatttgtcgtgtaagagtagattttttaagaatcaagtcatttttttttttgccaaacaacctcggtatattggattaattttgacattgttgaagtaaaaaagtatatctaagtttaaagacatttgtctgaactatttaggatgggattatttaatctcgtttttatttcaagagtttagatacgaatttagtattcctctatagtatttttttttagtgacacgatatgatatagaaaaatatagattttatcaaataccaatttgtttggttttacaactaatcatattgtgtctttacttgataagaaaatgtgcctatctcttcatgaccatattatactagtattattatttaacaacatgaaagagtccaaatatgttaaaaaatccgttttggtcctgtttcagctgagatcaagatcgattattccaattcgttgaaacttgtatcaatgattttattttttttatttctccatttttttcaaacagtcatattccctcctctccagaaaaaaaaatgaaaacagaagaaaaaataaatgaatgaaagagaaattaggagaaagtagagagagatagaggggctggagagatctggaaagaatatgagccgaagaagttcaggtatgtaaaatctagtcatctaatcattattcattagatatgatattcgttaaatgttataataattatctttaaaatcataataatgatggtaatcatcagtgatattacatattaaactcataaagtagctaagaaaaagtttacaaatccttgcattgcaatgtgcacaaataatgaattaagaatttggtctatcaagttatggtcatgttagagaaaaaaacataatttttactgtcacatgtaatttagtgggtcttagaagtaatcattagtttttcttgataaagaatcgtctctttttattcatgaccatatttttttatttaacaagatgaaagaatccaaatttgtgaaacagttcatttggtactagatccctatctatgctaaggaaaccccaacttatggtgtgtttgtaagctttggtcatgttaaagtaatgctaataaaaaataaattaaatcaaaccatgtttagtaaaattaagttaatgaaggataaagtcagagaataagtgcataaccatctgcaattataatttcagggattcttattctggaagtggtaaaaggatctttcaattatggtgatcataggacaaccatttgattaggatcagcagagctttctatggcaggaactgactgcttattaagaatcatgaaaatatgcattgaactatatgaactacaacagaagcgaacaaccatcagttaagctagttgatcaaagagattaagacagtgttaagaagttggaagcatttttatctttcaaaatgaatctaaaaaatagtatgtctactcaaggaattaacgagcttcaggtaatatcacgtttactaacacacttgttctagtatgtctactcaggtactcagactctcagcaaaatgcaaattcaaatgaaaattttgtggacctattttcttctaaaatacaaattacatctaggcttcaataagttttgtcataggaaaggagtatttccaaatttgaacaaattcggcaactgaactaggtttcatctgattatgtaaaggatataggaacatatatataacgatctttagttgcattactttgcattttcatggacaaaattaccttcaactcttgctgagaaccactgtgggcttacaaacacaagaaatgcttctccaaatattcagttattattaaaggaagcaagcttattgataagcttaatgtttgtcatcacacatcatccacttttatctgtgcttaaatatcaaaatcctttctaattggaaaaaagaataccccagccccttaaagttgatattcttggaaaggaagaaaagaaaagttcaaatagtaacagtaaatcatcctttcgtgcatttagttggatttttgttgaagatgcagaaaagggcagggcaagaccgatcatgctatgaatagactttgatctaccgatgaataatctgctgaatcataaaagtggctagggacttcagcaataagccttggatcataatactctgacatatctatattctgcaggccaaaattcatgttgtagcattcagtttgtagcaaaaagaaattcaggtcctcctccaaaggtgcagaagctgcctcaccacccaataataggtttctttggtaaaaatccagatcagaaatgcaatctagattaaatccctgagccttcaagctcaagtttgaggtgaaagtgggctctgaagattgatcattcaccataaggcttttgatttgactaggaaaggcttcaactgcagatcctattgaactcacaggactcacataatcactcttgaaaccagcatacaacggtttggtctctaatttggcagcaacctcttcttctgttatagaggcaatggaattaattgcggcaattgattgtgactgatcaacctgaatgtgatgctgtgtaacattaccatgcaatggcaactggctgaggctatcctctaactgaacaagtgtcttctgttcttctttgagtggcccttttggaaactcactccaagagtactgtgttggtatggtgcaatcaaagactgcatggtttgcttctgatgactctacagatgtaaaaggttgattgaggctcttctgtgaacttttttgtatcttggggtcaggaatgtcactagtggaacctcttcttttttctgttgtaggctctgacacaactcccttgagattaccttcatgacttgtggcatccatctgaagtagtaaagttccatctgaataactgaagctatcaatggcaacatcattttgttgcttgtttgcagtgccaagaatactaaaacttcctggatcttttgaaggtgaatccgaatgctttattctacctgaggaagatttctgatcattctccttttgcaacctactcaagtagagcctgtatttctgcaggacaatttttttcttatcaaggaaccccatgaatttcaaagttaaaagaccactaaacagtttttcctcccctatttctctttcttcacatttaattttatgagagggtcagcatctatgttgtaatatttctgaatctaacaaacatatactattttactcagaggaagggagaagaagaaaataaattcttccaaactttatagtggcagcaaaagttggagaggggagtttccttcccctcccctccaaacttctaaaccaaacaaggaaattttatcaaaatctctcccttaccttcccttttatttctcttccaaccacacagtatcttagaatgaacctacgtaatgattcaaggtctaacagaaacagcaaatcagaaatgatcactcacaatatggagtaataagatgcccagatgtttattgaaataaaggttatgactgaagtgtcctatttggcagtctttcaatcataatagttgaggactgttaatatagtatcacttaagcaatgcatatgagttagtgatatacctgcaagtgactagcaacattttctctagtcaaccacggaacattcatcagatctagaattttcttgggaccaacttctgccaaaaagaaattatgttatattcttgtacgtagaagataagagggttaacattaacaaaaagagtatgatcacaattcacaattatactttgtagggaaggttgataggaaacttactatcaaatccaatttgattcactgctttgacaaacttctgatgaagatccacagaccaaactactctggctttcttcatgggagaatgatctccaaattctttgtcatcatgtttgttatctgcatcttttcttttcttaattgaggtaatttcttctacagaaaacaggttaccatcatcagagtgatctgatccatttctcattaagtgaatgccctcgaagtcaaaaccctcgtgactttcaaaatctcttgcctcatgcatcctttttctaaagacatgttgccatatgtttcgcagttctttcatccttataggcttaaggagataatcacatgctccatgttgaacacctttcatcaccctgcttgtttctccatcaacagacatcactggacaacattgccaagtgtgactggtcagcatggactttttaagtcattttgataaaaaaataaattatagtgatatcatttaaagaaaaagttgaatatattattaaaagagaactgactgataacaggaagatccatctcgagtccaacttgctccagaagtttgaaaccatccatgtcaggcatgttcacatcgctgatcactatgtcatatgcatctttcctttcacgaagttttttcagggcctctgttgctaaacaacatgtagtcactgaagcatataatagaaatgagtcagaaggaaacaattgttgtcataacaagagcatacgtaagagacacaagatgtgcttgcttccaaaatttgccaatttcatgaaaatttgctaacatgaacatagtaacaacaacagaaggaggatttcaatttggaagttactaaagacgtccactgaataaaaagcatgaagcacctccatcttattattgaattacatgtagcctcagtttcttgagctcaggcttttggatagtccaatccaatccaacttcatgaacagcttgagtgcttgactgacataacacttaagcaatggtttctaaatcattcactctctagaggtcacatcactgattggataatgtttcaagcggcatggggtttttatatgtcatatatagtatgtgcttgtaaatcagtttctactgcttaattgtggctagtcaagttaaaacattcgcttcacattggtaacttgggttcattaatatatcatcttacaagatacacataaaggtagcaattgagaagaaaccttatccttgatttccattctctaattaaggaggctaagtattgaatctcagctcaacttatccgtgcaagtaattgaacccaaagtgcaaagatgcataatgaaaaaaagtcaacacaaggcttaatttccccacctaccatttaaagacaggagatttcaaactcaactacagaggacagatgcttggtctttccacaattgtattgcacacacaagttttgcttgttcagattaattcagttacttgctagtattttataagaactaatctcaaatgccactacttgtgcacaactatcctctcactgacactaatgctgacacatggtaacacttaattaccaatggtaactatgtgagtaggaggtctaaattctaaaaccacaggaatcaaattcgacaagggcagttcatttttcccctctatggcttttcgtagtggcaatttgttgcttaaaacttcactgggaaccatatgttgccgaagcctcatggcaacagaaaaccccccaagttttgatacttttattataagtatataacacccttcaaccttaataagttttatcatccaaaattcccagcttttttctctttattgaaaactgaaaagaaaagcttcctactttgagaaacactaagtttaaaatcacaaagaaacaacttaaactgaccaaaacaaataagccaaaacgcatgcagccatcataatacaactcaacacgagcacatctcatcacacactcaaaattccgaacaaataaatcaaaaaccagaaaccaattatagaagatatatagaataaagcaacagtcatagtttagatttcaaagtcctttttttgggcaacaaaacaataccacaacagaagtaaaacaaaccaaccttcatataagcacttcttgagcatcttttcaaggatccgcaaccatgttggatcatcatcaacaacaagaactcgcaaaccagctggaaaagcatcgtggcgtggagaagagaagcaaccattgtccatgttagttagagagaagagtcctatggatcactgcttgtgagttcaagagaaaaatggggttggcttgattgggttttaattaaaatttaaggtgaagggaatatatgtatatttatatatgtatatattttcatgcactgtgacaaaaagcactaacgaatattaacggtcccagtggcgcatgttatggtcttccaatctttgtgctgaaaagaatagtactatacttggaacaaggaagttgttttgagtaacaaggagtaaagacataaaaaaaaaagcatggtgaggatgagattaaattttatgaaaagatggcaaatttaatgtacaaagatgatgagaattagaagaaaatattggggtggtttttgctttgccatactaatattaaaaataaacaaaaaagttagatgacaagattgttcaattgaaaataaagtatgttttattagcggatatggtttttctgcaaactgtatatataataaggtctattctaattttcaagaagtaagtttataatatttataatagctaacgggttggtttctgtttctttacatatttgttaatgaggttgaagtgggtgatatacggtttaaattgcaagagcaagaacaaaacaagtatcaagccgtattctttatgaaaaaagatgtttggagataggaatttatcagaaaaggggacaagaaatatacataaagagaacatcacctctatgttgtctgcttagtagtatctttgtgaaaaggaaaaataagaagatgaaccgttgtggaaaggcacgtggaatgcattctagagacaagagaatatggttagacaagccaatacattaattggaacccaaactaacatgatcagtttatatttaagtttctttaatataatttatttttatgaacacttgcaaaagtaatttataatttaggaaaggtaatcagaataattttcaaaaaatgtaggagttattttagggttcccccctcataaactaaaatttgaagttgatgaaaataagtcatcatcgaaaaaaataataatagtgtaattgtgcgtttaaatttttttgatctacttttaactgtggtcagttttcaaaattcacagcttaaggtgtaaaagaacaaagtgtaatttgtttcggtaaatatttaatgggattttgaggtctaaaaaaaatatgagtaaaggaagaaccaattttaaacaaagagaagtatttagaattttataaactacaatgaaataaaacttatgaaacataccatgagattataattcagaaggtgattgagcataaataaaaagataagtaatgtttaaataaataaacggctaaatattttcttaagatattataattcataattaacataattatgataaatttaaattcaaatagtatgttattttaagcaaatgcaatcacagaaatgagcaaatgaagcatccgccaaccccatttaattggacaaatattaatgcccttcttagccaatttgcttaccacatgcattcaaattctccatacttgagattcccccccaatatatgttcttctaatagaataatcaattaaaagttacccatttcttttaattaatagtatccaagcaacgaaattaataggagatggaacgagaataaaataattgagtcccctaatatcagtaactcaatgatttcggtccaaaaaccttaaaatatattaagtgggtgcatgaaaaccttttttttagtgtctgatgcccagtaagcccttataattcaaagcaactttatgtacttggaactttattttattgttaaatggtgcaattttatacgacatatatgtcttagcataagcatccaacattttcaggtttagaaacccatggtgttgtcaacgcgtaaatgatgatgagcttcaaaaagaaggcattctgattctaaccaagacaaaacacatcaaaacgcagagggacaaaacatcaatgtcagggcaagacacactaataagtaataacccaagtgaattgtttgtctccgcaccattggtgcgtgttttctccgttttgttgattattagtaacattttcaatctaaccacgtaaatatgacgaaatgaagattatagcacgcagcaaaaggggaaaaattaattaatagtcttaaatcatcacatataagtagttggttcgtccctaaaaaaaaaaaaaatggttcaagtaatatttgatctggtctctttaaattttgaaaagtcttatacataaaaaaaatgtggttaaaatgagaaatcttactaaaaagataattaattctcccatggagtcgagagaaaaaaagaacttcctataattgatagagattatttattaacaaaattagtggatattttgtgtcaatatcatgaatactaaaaaaatttatcactaatttataatcttaactcatttatatgtaatatgtcaatttttttaatttatacaaaataattaatagtngtaaagaataattagaactaaggttgctttttttttttttttaccaaagaactaaggttgctgtaaaaaaaatagaactatgatattctagactctctaacttttttttaactcctatgttgattccaaaccaaccgaagagccaaaccttatacttgatcatttgtaaaattaaaagtaaatgttatggtggaaacttaatcaccacaatgaaaaaaaaaggtgatgaccactaaccaggcaacaactactccttaaatgcaaataataaacatagtttggtaaaaataaaagggttgaagttgaaagtcaccatagagaattactaaatattaatggaggttgcactaaaacaaaccaaaataaaaatcaataggtatctaattatcccattgcattataatcaatagacccattacgtgctccataatgacataagatgatccaatcaacgtaaattaatagacccacaatatatattatatttacatatatattcctactaaaaaattgaaaagggaaaggggaaaaaacgaaagaaatagtgttacaacttacaactgttgcgtaccaacgtagggatggatagatagctctaatcacgttcattgatagaggccacgatccccctatcaatataacatttgaagggctgcgatagctccatttgcaacgcatatgaggcctaaaaggtggcatcttctttaaacctcttttaaacaatggtttatttgaatcaaatgccacttaagttccgtgatcaacagaagcaagagcaaagtgggcacttggtttttttttcctatccctttcttttcccatttattctctttcattttcttagtacaatataaaaagttttaagagaaggggacttgtcacattttaagaccatggcatactatatgccttaaagtttagagtaaataatgtatgtaatgatagtataaaacttcatctaatcataaatgaacataaatttatttacttttataataattattatcttaaaaatcatacaataattttctattgaataataatataaaaaatttacatttcatagaaataaaagtctaaagtttacaaaaataaaaagtccaataaaagctactaaattattttgatcttatgatataagctatctcttactcattcttttctttttgtccggggaaaagtttgttttggaggtttcactttcaggtttggggttaaaggttatacttttgttgagtgggatggagtacggaggggggtttagtgaaaaaggaaaaaggaaaagaagtgtagtaagcaaaaattgaatgaccctaaaaaggaaattcccactaagaaattctttatgataaggagagaattattttatataaagatagggtggtgaggcggcgaatgattggcaactcacaaaacacaaagtggatcaactccatgcaacttcagctaagtggaatagcttttcattagtttaattaatgcaaagttaagaaaatggttttgccttatattccccctctatacataatgcttcttcagttgctctttacctgtatattcttttcttatttgttttggaatttatttacttttcattgtgattttttttcactgttcttacttttaactgggagaatatgctgaataatgcaatgagcgacttcaattgggagaatatgcttgctcccaatcatttgagccacttgctttcacatattttctggtcctattgttatgccatagcagattttgatagttaaatacggagggtggggttgtgtcatgtgtatttaaatgtacttgaatgtattcaacaagaaagaaatgtgtgttttttttttaagggaaaaataagtgtacttgaatgtatgtacttttttttcctctcaaaaaatacatacttgaataatgtagtattggaacactgtgatccaagcacttatcatttgccgctttttctttttctttttcctgtggcaaagtggtgtagcaattcaatggatgccaaagcccaacaacatgcacatggctattattgggccttttgtgacaagagaaggcctgataaaaagaattttcttttgggttcggctctatagtctacttcactattttatttagaagaattttagctcgtaaagacagaaagaggttgttgctttctgcacaaaaaaattgcttccttcacttggaattagttacacttttgacaatcctgattgaccaatccaaaggcaagaaaaaaaaaacattaaaaaagatgcagaaaacaatttttgggtgcaagaagcaacagccaagaaataaaaacagcccaacaatctatccataaactcaatttgtgtaatgctcttatgctcataatacttgagtacttgaaatgtacatagtttgtgcaactaaattttacaactatcaaggtggtaagtacgtaaaccttatctttttgggatagctgtgagttcaaaatttagggggaaaattgttgggagatctcataatttgtacttttgtggagtctcataaatagtttaaaataaacaaaaactttaagaatacctattgtttcacaaacccgaaaaaaaagttaatgcacttgttagtactcttggctttgatggtaacttaataaggctgcagaattttaagaaaaatttttaaatttaataatttttaataattaaataaaaatactacattttttatattcttttaaaataataaaagttgatgtgtttatttaatattttttattaattattgagatgttattaaagcaatatcttataaaaatataataaatgttttatgtctttctgattgttaaaagtttaataactactattttttttttacaataaacatttgggagtccatcatgcattgttggataagatcgatcgagacatgaaagcagattaggtttggtttatcgtttggtaataaggtcgtggttagacatggtgattgtgtagtatataggcttaagcagtgaatttagggattgagaatgaagattgaacaacttatatttgagatataaactatttaattttcatttaaggattcccattcataaatgcgtgaatattaaatataaagaatacatttccttaatttagatagtgcttttgataacgatggatgattttttttttctctcttactcaggatgaaaaaagaagagagaaatttttctttgtcttaatcctctcattcatctaaaacttaattaaaccaaaattcaatcgaaatataagtaaaatttgattataaattattttcgttaaagatcaaatccaaatattatccaacaatacaatattaactagtgataaaaaaatttgaaacatcaaacaaatttttatacgtacttgattaagtttcaaactagtgacaaattgtacatgcattggaggatgtgaactttgtttagctgctaaatatgtgcagttattactacgttcatcaatactttttaaaagttatattattataacaataaaagctccactataccagcttcgctcccagacttgtttctgttatgtatgaaaaaaatattattattttttaaatcttgttatttttgttaaacttttatgaattattattgatgtttcattctttgttactagtgcaagtacaatatgccgccacatatgtaattagatggttcaagagttctcgatcagactgtgctaggagggacactaatggtacaacccattgtttcatctttcagagaaagagcaacaaaaagtgcaacaagagttgaaggcgaaggtggttgttgctcctgagcttgttgagtcccaagtatatctatttttgagtcatggcctgttggggccccttatcaaagagatgtagagaacgtgtttgtgttgagtcccatgggaatcatattacctcgtgttttttttttataaaaaaaagtttaataatcaaattcatcaaaatatgaaaatataagaactttaatcacgcttgaccaaaatataaaaactcaaaatccttttttttcttatttataagtacattatgcactttagcaatacaatgaactgtacacgttaatatgtaacttctcgaaacaataactttttttctttactgaataatactcatgtcattttatttataattaaagtcttaatacaaggaatagcatgatggaaattatactgactagacataaatagagtcatcctaattagtttatggacaacatcattaacttgtctagctcatttcaaaaccaataataacgattgcagaaacaaaaactcttaaaaattataaagaaacatatataaaaaaatactataaacttcaaaatacactgacatatgaataagttttttttattattcaatttttcaacattgttttgatactcacctcgtagatatcatctcttaagttctaactttgtatttttgttttgtctcgtattgcatgccaaaacttgcaatcctaggagtcagacggatgctgccatacgggaaataataaagaacaaactgaagtctgaagggctttcaattccttttctgatgtcaagttgcaattgaaaaacttggaacatgtcaatgtgaaatctgttacttggacaactggactgatgcagcgattcgagatggaccacactcttctagacttggtctgtcttgatgccaaaaggccatgttgggtagttttgaagaggataaatgagggtagtttaaacacacacacacacgctcagaatttgagtgcataaggtgaaaactgtaaatgaatatccaaaatggtaaaagatgaatgctccactacaaattcctaaattgaaagtatgaaaattgagaattttgagtattattgagttgttgggttctcccacctaaccaaatcttcagagttaatatgggttgagttgaacttttttttaccatttacttgtaaccccttgttttattcattcaatggtccaaacataaaaaagcacaagacaacatggcccaaagttacacagttaacacagattttgcggtctgaaaaagcacaaattgaagtaattacgtaatacctcctttttgcatcatttggctttggcctttcttttagcgtagtttaagcccttttcgactcataatatatttgtacctcgttaacattttcttgtatatatcatcaacttataatggtagtttcaaaattcaaattctgtgcaaaatattgttagaaattaataccattaatgtggcgcatggtggcatcaaagatacaacctattaccaacacgacatcgtatgtcttcttgttgtcccgaagccccaagacaaattgttaattgtttttaggagcttcttacaataaaaacaagtgcatgggtcgctttgtagcttgtgcttgttcctttcgtgtaacttctttttagaaaaataatagagaaaaagaaaaggtgaacctaaaatcttcttttgtaggaaaaagaggattccaacatcagaacagataaagacactaacgtgaatgaataatcaaacattcaacaaagtcatcgatccaaaaagttaaagttaattagtgggagaaagctggttatagttgagatgctctcaactcaaaacaaacagttaaattaatcaatcacttaaaattcttgtagcaaaattattattttctcttccttacatccatggatttatcttctttttttcttgttttaatccctctgttgacatcatttgctgtttgccaacttgaaggtgagtttcatatacttttcaattcaatttcagttggaggaaccataaaccatgattgctaaaactttctcttattctttttgaaccatcatgtcatgtaatgatacaaaacacaaactctaaacttcttcacttgcagaatttgttagcattgattgtggagggacaagtaattacactgataccagcacggggttggcatggatctcagattctgggatcatgcaacatggcatttcagtggaagtagaaagtccaaatggaagcatggtgcagtatcaaaagcgaagagactttcccatagacagcaagaagtactgttacacactaagcacagaagagagaagaagatatttggtgagagcaacgtttcagtatggaagcttggacagtggagacacttaccctcagtttcagctctacttggatgcaacaaaatgggctacagtgtcaatatatgatgcctcaaggatatatgttaaggaaatgatcatcagggcaccctcaaattctattgatgtttgcatgtgctgtgctactactggttctccttttatatctacccttgagttgcggcccttgaatctttcaatgtatgccacggattttgaggacaatttcttcttggaagttgctgcaagaataaactttggtgctccaactgaggatgctgtcaggtgtgaaagctcactttttttaatttttaaatttgatgttgcttttggcacataaatgaatgaagagaagactttccaaaattttccttcagagaataagcatcagtagaagtataaaaccttattgccttttcaaggaaaattgcagcatggttagcttgattgagaagaaccactaactaatgtgatgagtgatgacatgaatttggtttaacatttttaagcaaatgtgtttcttaggtacccgtatgacccgtatgatagaatttgggattctgatcttattaaaaggcaaaattatcttgttggagtggcaccaggcacagaaagaattagcacaacaaggaacatagatatagagacaagagaatacccgcctgttaaagttatgcaaactgcagttgttggcacaaaaggagtactcagctacagattgaacctggaagacttccctgccaatgctcgagcttatgcatatttcgcagagattgaagatttgggtcagaacgagagtcgaaaattcaaattaaagcaaccttatatagctgactatagcaatgcagtagttaacattgctgagaatgccaatgggagctacactttatatgaaccaagttacatgaatgtgactctggaatttgttttatcattctcctttgttatgaccccggattctactcgaggacctcttctaaatgcactggaaataagtaaatatgtacagattgcttcaaaaacagacaagcaagacagtaagttctgttagctttttttttttttgtgaaaatagacattttgtttcataatgcataagcattgatgctgagcaagatgaactgatttctaaccatactttcattttgcagcaactgttgtaaatgcatttcgattattgtctgctcaaagttcccagacaaacgaaggcgatccttgtgttccaactccctgggaatgggtgaattgtagtaccaccacgcctccaagaattactaaaatgtaacatcttcaatcacttttgttgacaattttgtttcatagcgagtgaattgtcattctttgaatcactaatctctgacacttttgaatacttaagaatattgaattccaaaatgcatcaaaagagtttgaataatagaatggcaaatgctgtctgttgggaataaaataggctgtggcatgatgaaagtcatgatcaaacatttcaaaaagttcactgaacattttgctatgctaaacatttattggaagttaaagttgaatatttttttactaattgctattgtttgtattagaattctttcgagaaggaatgtgaagggtgaaatcccacctgagcttagcaatatggaagcattgacagagctgtaagtacattgatcttcataatagaagtactcacagtttttctttaatgagatttctcttgtaatttgttctttgttacttaggtggttagatggcaacttgctaactggacagttacctgacatgagcaaacttataaatctaaagattgtgtaagttcttgagtttgacgcatgcccctccttgggttggagcgcaatcaaaacttcagctcatatttcaaatttattagtttttaaccccaaaaattcttctttctatgttttcctttttcttattttcatttcttaattgatgacatgcaggcatttagagaacaacaagttgacaggtcgactaccatcttacatgggtagtttgccaagcttacaggcattgtatgtagcacttaaatgtttctcatctctaatttcagcacttgaagtacttccctagttaacctgacttttcctaattgatattgttatcctcatatgtttattaatcacgcaacatctgtgaatttgtgacaggttcatacagaacaactcatttagcggggaaataccagctggattaatatctaaaaaaatcatttttaagtaagtatgctcagcaacagaacaattttcttacatattgttcatgtatatgcaattgctttaaacgctcactgatttggcttgacaatggaatcagttttaacataatagaacaaggatcttttcaactagtcttgtaccaagattgaagtaacagccatatttaatttctgttccagctttgatggtaatcctgaactatacagaggaaacaagaagcattttaagatggttgtgggaatttcaattggagtactggtgattctattaatattattcttagtaagtttggtactattgcttaatacacggagaaaggcgtctaaaaggaaacgtgaggaaaaaggttagccatccagtttaaatctaatgcttttgtttcaacttgattacaatcaaacttcttcaaccaagcagttttgtccccatcaggcatttctggacgcactaacagtaaacctggatactcatttcttcggggtggaaatttaatggatgaaaatactacttgctatattacactctcggatttgaaagaagctactgacaatttttcaaagaaaattggcaaaggaagctttggatctgtctactatgggaaaatgagagatggaaaagaaatagcagttaaaagtatgaatgaatcatcttgtcacgggaatcagcaatttgttaacgaggtagagttcaattttgtcccttcagcattttcaaatttgaattctgataggcaacaagttctgttgtgaataaattttatcttaggaagtgtatatcaaccaaaaagaaacgattccatgaatttcattagtataacattctccaaaataaaaatgcaaatacctcactgtcacaaccttcttgattccagctcatgcctaactgcagctgcattaaaacatggatttcttagattgctaaacgtaacaacagtaatacatgaaaaatcttaattttcagttatttgattatagagtcaaacatgcaggtggccctcctatccagaattcatcacagaaatttggttcccttgattggatattgtgaagaagaatgtcagcatattctggtttacgagtatatgcacaatggcactttacgggatcacattcatggtctaatggctaacctccaaccccgtatgcatttatttaattaatagaaaagtttatgtcctgacatatatttccaatgttatgacagagagtttcaagaagcagaagttggactggttagctcgtcttcgtattgcagaagatgcagccaaaggttgatcaatgactaccttcacggtccataagtagaattagtatggtctaatgtttgttagttcctataaatatgacaagttttcgttttagtccttcaaaaaaaatgttggtttattttattataaactttaaaagatttgaaaatgacttttatgtcacatatatttcagagtgattgctgatacaacatatctaatctaaatgtatgtcacgttatgacaaaataataataataggccatttatttgatgaagaatagtattaaaactaaaatttgacatatttgaaagaattaaaaacacttaaattgtaaagtgttttacctccaagttaaaacagatgaagaacaaattccaatttctacaggtctggaatacctacacacaggatgcaatcctagtatcattcaccgtgacataaagacaggaaatattctcctagacatcaatatgagagcaaaagtatcagactttggactctccagattagctgaagaagatttaacccatatatctagcattgcacgaggaactgtaggctacttggatcctgagtaagtcatgggtctcatgtgtgtcttttcccttgaatgtgtgaaattcagtttatatttgttctttacaaattacaggtactatgcaagtcagcaattgacagaaaagagtgatgtgtacagttttggagttgttctgctagaactgatttctggaaaaaagcccgtgtcatctgaagattacggtgacgaaatgaacattgttcactgggtatgtttccttttcactaaccacaagatgaaacattggcatcattaaaggatgttaaacaagaactaaacacgaacatgtacaatatcgtacatcaaatgcaattaattctgccaggagcccaggagtatattgcaaaattttaacacacttaagttcaactaaccatatcttaaaaattctgttgtagacttaatggtaaatcagcattaaaatcttactagtttaaaaagcattgttttgcaggcaagatccttaactcgtaaaggagatgcaatgagcatcattgacccttctctagaagggaatgccaaaaccgagtccatttggagaatggttgaaattgccatgcaatgtgtagaacaacatggtgcctccaggccaaggatgcaagaaattattttggctattcaagatgctatcaagattgaaaaaggaacagaaaataagctaaagtcatcatcatcattttcaggtagtagtagctcaaagccacattcttcccggaaaactttactcacaagctttctagaaattgagagccctgacgtgtcaaatggttgtcttccatcagcaagataaataaattggacatgcctttcattccatgtgttgattttgtttctatatttacttctttttaaccattattattctaccaatatgtacttttcaccagtaacagtgtgaccctgactagtgacaacattccaaattttggaaccaattgttatcttcttccagatttttcttttgtttaacatgctaattgtaaattggaatggaaaactaacactactagaaaaacaacattcaacatcgatttttaaccagtattaagaccggcgatgttgaaattttggaagttaacatcggttttcaaaaatcgatgttaacaacaagtatacaacatcgatttttagtaataatcgatgttgctatataagaaataaaaggtaaaaaatgtaaaatctgaaacttcaacatcgatttttgttaaaaatcgatgttaacttatttgacaatattgattttctaaagaaaatcgatgttgatgtgatgtaacaacatcggttttcagagaaaaaccaatgttgttacatgaccacaacatcagttttgtccctatatatgtaacaacatcgattttcattagaatactaatgttgttacatacataaggacatcggttttcaatgaaaatcgatgtcgtagtgtaagttaatatcaattttgactgaaaatcgatgttatagtgtaagttaacatcgattttgacgaaaatcgatgttatttttttaattttttttaatattttgttttttatattacccaaattcatcctacaaatgaaataccagacatccagtcacaatttcagaatacaatacaattaaataaaatttgaataacaaataaaattcaatagtatcaatgtacataaaatgattttctaactaagtgtttatacaattgtttaaaaatcccttaaccacctaacctaatatttcatctctaactttaagataaaatgtagtccactgaaccctaataaccttcaatctctcggcttccagtggtctttcatcaataaaatactgcatgacataataaaacataatttaataagtataaatataaaaagtagaaaaaataaaattagttttgaattagataattatcatatcccagttatccctaaagtttccttggactatcgtcaacatccaatgcatgacataatagtcacactcagtgcttcctttttgcttattacactaaattaaataacatatggtcaaagttaaacaaaaattagagtaaatagtaataaaaattattttgaatacataaaccattatttattaaaagacttactttaagcgcaattcagttagtagtagcttttgatttatttcctcgagagtcatagactcccttcaaagcatgcttaagagaaacatacatgcatattgtacaattaacacattcatgtgttagaaataataacagaaatgtcttacaaattacaacctgcctgttattaggcttgttatgcaacgaacgaaaccacacgacaacattaaccctaggacatataacgaccaattactaatgtgcattgcattggagagaaaaaagtcattatactgtatacattatgcatccatttcttaatatagtcctcgcattcaagtatcctatttttgtagtaatgtagatttatatgaaatatcatacctttaatatatatatattacatttattaaatataatgttattaagtttaattatatattatctttattaattactttaattaatactatattagacatatttttatttgtttatttatgtaagtactgcactaataaaatcaaatacggcattaaaactttttatatctaatttactatataaacatcactatagatagattaattatagctagactaattatctttattatccagaatcttcagattttatcgtattttgatgaattgtgcatctatgctcacctaatcataataaaaacataagatgaataataatgtaaaaaataattgccagattgtctaaaatattcaactatatgcttcaaaggtgataacatattgttttctattgaggagccacacatatgtgaatcccataaggaaatcagaataagatacatgatttaaaaagctataaaaacaagaatacattttttcttcaacttcaacccgtttacaaaacctcgttgaactccataatattttttaacgaaattatattgtactttaaatcgacacctaatgtgttacgtgtgcaatatcttaattagtgatagtttgactgtcattatgcattccctctctcattacaatttttttataaaaaaaaatctgattcaattggtggaagggggagcagagagaactgctgattattatgaagaaatttcttactataaattaaataatgaatgagtagggtgtgttttggtataataaaaaataacaattaaaaatttattaaaattaatgtaaggaatctatgataagacaataatctaaatcaaactctatgaaggtaaacgtctaagcttggcaacttgaaacaagaaatcctacaaataccctttccttttttataatacctactcaccacacgatcagatatgctgaggagagagaaagcgatagccagcaaaatattttttaagtaaaaaataaaaataaataaataaaatatttttttttaaaaaaaacttggtgaataaataacttctaaattattcagaaaaaaaacccttcttaattggtccttgtaaagttgtaagatggagatattttgattttctattctcattatacattttttttatttcattgtgacccttatgttaggttttgtgacttttgagtttgtcatgttaaaaacatgggaaattttttttaaccactgtatcaatttatcttaaaatcaatagttaatattcttttaaatttttcttttcttttttctttctttttccaatttttgtctctcttatatttttttcttttcttttctctttgaacattgttgttagcgtcattaccaccatcaaccatcaatactagaattataacaaatgcaaaactataaaggggaaggagacggtctacgacaatgtatttatgtttagctttggtgatggagtttgttgtgggatttgcctttggttttgcaattggccacgatgggttttgtggtggatttattgtgattcatagtagattttgcgatggttaagagaatctgattttaaggatggtaaagtagatcagtccatccaaacaggattggacttatccacttttggaaaataggctagaaatactagctcgtttcactttaaggtggaccagcgggctagtccacataaaaaaataaaaataataattaaaaaaaccaaaaaattattaaaaaaatacaaatgtaattaatttatgctagattaatacattaagttaaatttagcaaagcaagtagcaacattcatacattaaatttaaaatttgctaaaaacaagttagaaacattacaacttccaaaatgcaaaataattaaattgaagaagtagttgcatctaatcatcttgagtagttattgtatttgatcccttggaaacagttggattcatatttaaagcacaaaagtcatcctcatcatcttcatctataaatcataatcaaaaaataaaaatagctaatgaataataatgatttaaaataaaattaattggcaatttaaattgtaaaataatgaaattaaaaaaactatcattttcagcaaaaccatgcaatcaaggcttcgacattttctgacaagagacgatttctatacttgtttataacatgtgatccaatgttaaaagtagattcagaagtcaatgtaataataaaaatgttcaacacatcactagccattatggataattatggaaagtgattataattatccctccaccattgcaacacatccaactcttcatagtgcacaaaatccaagtttggctcattcagataaataataagttgtgaccttccaactttagaagcaagttgactactatgcattttcaatttctattatatatgacaagttgaacacaaaaaaattaaataaaatcaacgaagtagacaacacgaaaaagtaaatattatataataacataataataataattcataagcatgtatttataccaaacattctttgatttattcccttgagttcctttgacatggttgaagaactagtatgggttcttatgtcaagattgtgaataaagacagcgttattaatgtttcttgggtttgaatacctctcaaagaccatgtataactttgttcacacatgttgaatcttttcctcacttgtagattcatcagttgttaagtaacaataactcaatgaagtaaacttaatatgtgggtcaagaactgctccaaatgcaagaatgatgctataatgatcccagtatttcttaaacttcatcatcatcatttcccccatactccttataacctcatcttgactttgtaaactcttagtaagaacatgctgaattttccaaaacttgcaagaaatataggttggaagtaggatatgaagtgtctgaaatcaattttgtagactgattttgctcctgtttgcaaggatcctccgtattgtctccatcattgcatttgttcaattgcaattcaacacgccacaagaagacaaaattgtgcgtgagatctaagcaacaataggagttgttcatatttgggtttgaaatgtggataagtagtgtaatttggactgaatatctaatttggtttggaaaatggatttgcatatccgaagaagaaaggaaaaaaggaagagagaaagcaagaaagaggctaggaagaagatgaaggccaagtgaggagtaaaaaaaaaaagattctcaaaataaaaagtacaaataatgtgtaaaatattgctagtgtttaaacgagagggtgagaagaatgagacaacaacagtctcattttataattgatgtatgttttttttatttataatataaaaatatatcaattatatgattttgtcattgtgtaatgaatttttttatttaactatagattttgttatataaaaatatagggtatcttgttaaataacttaaggtcacgctgaaggtggctgttccttttcgattttctgttttaaaatgtaattttgaaacagaatcgtgtccgacaaatatgaggctgaattagttttctacatcttttcaaaacagattttatcccatatgaccccatttgagaaacatagcaaaatttgatttaatggttattgtttttgtttatacaacctcacacttcttccttcacgccccttcacctccatcgccctttgtcgtctcgccgtatcctgactccggttagctaccagaggcggaggcggcggagtcggaccttaggccgccaccagcagcgacgacgtcattggtaattacaacttcgcttgcatcctcgctgcccaccaccattgcaccaccaccagcctccccttcacatacccaaacagcagtgaagtaggtggcgatcatgaagttgcagaggaaggtgtcgcgggtgcgggtgaggtcgaagatgcggcgcgcgtggccttagcactgtacggaatcgaaatcgcactgttccgcacccgcaactcccactctccctttatcttcttcaaacccattccattcccgccgccgcagaaaccctaccctccgtcgaccacccctagctggaatgggtctccttcgtcgaccacttgaacaccaaaggctacctttccaccacttttagttattttctatttcgcaaccggatttcaaaatcaaaggttttcaaactaaaccgaatttgattttcaaatgtcttaaaactgaaaacagaataccattattatctttcttcttcttaaaaaaaaaaaaaaacttaattatctttattttttggaacatcaataattttttaattaatttgctgtaaaaaacaaacacaacatatactctctttatttagattttttttagataaacacaacaaatactcttggtaaatattttaacttttattctcttaatcaactgcttatagcaatttccctgagtacctaatcactgctaaggtaggacgaatcgtctcattaaaagtttacatgcctagtatttttctttctttctcaaacaatatataataagactttggacaatttttttgcctccaacaaaaaatacacacaaaatttacgtatatactaatatctatccatatagatacagtacaggacccttttgattcctttccctctacaaagagacaaaacctgaattaattaacaagaaaacagtgtttgcgtgagccagcacagtagtaaatatgatcacactcgtgttgtctcatgactcatgactcatctcggtctcattacatctatgactcagcattccacataacactatcatagatacaccagttttagggtgggaaagttacgcatatttttcatcatggaaaagtttttttttaagcccttggattttttatactttaatctaatggttacgtatttttcatgattttctttttttcttcctctttccttattcccttctttcttctcttagaggctgcagaccatgacgccgttgctaaactcgattttccggcgacacctgagttcctcttacatctgttgttcctccttcgcggttgagtctgtcattgttataaatttcgtagggacaagggagggctattttgggaaaaaaggagttaaaaaacaaaaagaaaaaacaaataataaaaagaatctgaaccattaatttagaagcagaaagatctaatggtccaataaaacttccccatagtggaaacatgttttaagttttccaccctagaactggtctcatagaaaacaacgaaacgcaacatcgtaatacggcattccgcttccgttcattgtttcttccttccctcgactcaactctctctcacccaccacaaaactacgaaaacaaactaacaaggaaaaaccttctttttttttttttctcttttttgttccctcatcctcatctattggattaactgattaatattatttggcccccttctaaaaagaagattcttcatccttccacacacacaccccacaactactgggagagaaaaaaggaaggaagttttgttcttttctgagacccttttgattttttatattttttctgctctgaagaagaaagatggaaatgatggcataccatttttcccggctaccttactcggattccctcaaactgctagaggccgatatacagcatgcaaatgctttgttagtttcatttctctctctctctcttcatcttaacaacttatccatcactttcgctcttcttatgtatagtttttttttatgaaaattgaaaaaaaaaaggaaaaaaggtttttttttttttttttgtagagaatgggttttgacttgattaaaggctctaggacttgaaatggggtgtcataatcacttgataagcatctgcctgttactgattgagattgatcatctttaattgctttctagtggttgataaagtgggaaacttttgtgctttttagttgaatttgtgctcagactggaatttggtggtaaatttgattgtgaaattctttgtttgggactatgaaatataatgtgtatgtttttttttctttttctttttttgtgttgtgcatcctctgaatttgaatactgggtgtgtgctctctagggctgctgcaattcccagagccaagggtgggactcttctccaaatgaaattggtgtacaaccacttggctcctctctttctgttgttgctacagtggatggagtgttcttgtacatgctttctacacagatatcttgacctcttccacatagttgtatataaggtaaatccctagatggatagaaatttctagtttgtgatacataaaaagttatattttggtctctggtgctaacactagactagcatttctagcactataaaactttctgatggtgataaactgcaactaaaatttacaactttcttgtgtagagactacaatttaaaatgaggacaattatagggaccaagtgaaaagtttaacaaaccttcttgtgataagcttttgattcaacaattttggttttgacccttgtttttctcattattgttgttgttggtccccttttttttttaccaaaggtacacaatgatggtagatcaaatatgacttctcatggaaggaaagcaagcatccgggacttttatggtgcgtgaatctttgactctcaaaaagcaacttttattttagttattccaccctaaaaaataaagtgctatatttgtggctgcctttatttattattcctcactgttttttggggttaaatattgtactttagccgttatccttccatctctcgagcggcttcatggtagcttggagaagttgaacatttgtaagaaaggtcattctagaacagatggctcaagttatggcaagaaaatgattgaaggtgatgagaaactaatcaatatcgatttggaaagagaagatgaatgtgggatatgcttagagccttgcaccaaaatggttttgcctaattgctgtcatgccatgtgtatcaaatgctaccacaagtggtatgtattcatattaaacatgcacatttagtcgtctaactgcatgttcaaattgttctatcattattttttttgtgtgtacaatggttgcactaggttcgagccttagatcttatgcaaactacccaaactctccaccactagccgaccctagtgattctagtttatcatcatttgtaacacccttatgctgaatctttccaacctgcaggaatacacggtcagaatcgtgccctttttgccgtggtagcttaaggagagttaattctgaggatctatgggtactcacttgtaatgaagatgttgttgatgctgaaacagtttccaaagaggacttgttgcgtttctacctttatatcaacagcttacctaaagatcaccctgatgcacttttcttaatgtattatgaatacctgatttgatgttatttttactaaatgagagaaaaattgtacagatagggaaatccggactgcaattgtgaatagtctggtaagaaatatttctgatttgtaaggcacagctctgctaagataaatttctgttattctagcccagaataaccccactcttgccttgttatatatcgattactattactattccaatttactttgaactagttgtttgagtcacggtaacaaaatttttcttcagattcaatgatctctaactaaagctttctaactagctaattcagatttaatccactagcctattagacatgagtgtttttacttagttgaaaaagaatgatgttgactatgtggatcaatgggaaacatttgttatttttagactaaaaggtgcatatcaatatatcttgttaaggttaatgataatcaaatttttagttaacaaggtgtacatatttgattgacagattaatagcttgtattcttctcatataatgtgttgttagtttgttacatgcaacatttggtgtgtaagtaacattttttgaaatgctagaagtatgcatattataagacaaatgacgaatatgcataatcgcttaactatatgtaatttatatgatgatatgaatttacaggagtaggtatgaatggatagattttgaaaatattacctgttatgtgtatatgttttaaaatatgataagtagtgttttaaaatatgactttaaaattgtaatttttattataaaaatattgcaatcatgactcaaaatacgactttaaatattttatatttaaaaaaatattaaaatttgtgttttgaatcatgatttcaacttcatgttttataaatttgtctagcattcccacttaaatttagctaaagttcaaggataaaattaattaagtagnnnnnnnnnnctgctaagataaatttctgttattctagcccagaataaccccactcttgccttgttatatatcgattactattactattccaatttactttgaactagttgtttgagtcacggtaacaaaatttttcttcagattcaatgatctctaactaaagctttctaactagctaattcagatttaatccactagcctattagacatgagtgtttttacttagttgaaaaagaatgatgttgactatgtggatcaatgggaaacatttgttatttttagactaaaaggtgcatatcaatatatcttgttaaggttaatgataatcaaatttttagttaacaaggtgtacatatttgattgacagattaatagcttgtattcttctcatataatgtgttgttagtttgttacatgcaacatttggtgtgtaagtaacattttttgaaatgctagaagtatgcatattataagacaaatgacgaatatgcataatcgcttaactatatgtaatttatatgatgatatgaatttacaggagtaggtatgaatggatagattttgaaaatattacctgttatgtgtatatgttttaaaatatgataagtagtgttttaaaatatgactttaaaattgtaatttttattataaaaatattgcaatcatgactcaaaatacgactttaaatattttatatttaaaaaaatattaaaatttgtgttttgaatcatgatttcaacttcatgttttataaatttgtctagcattcccacttaaatttagctaaagttcaaggataaaattaattaagtagactgattcatgagttttttctttttcaatatgtaaaatttgtataccatcacaggctgtgtcctagtttggcttcttttggaaagtataacattgacaatgattctagacttgcatttgttcaaacacatttctattttttacaacctctttcacctacccatttttttaaggatacaaatcatctaccatttttatccctttcacttaacccttattaattattttcacgcaaggacaaaaaactacgtctattttaacgagtgatgttaacttttataggaacttgctccctaattttatggcttcaacgtaagctatttctctttagagaataataatatatagatacgattatacatcaaatatcttattaatatatattattttattttaactctccttattatattatattattacttattataccactaatgcaagttgagtctagtaaatgaaattaatctcttgtaatagagaaattattaggtgatcttaaacaatcataattcctattaatttttatataacatttaatcaagtattgttaattttttattgaaaaaattgtaaaatctaaatgtattatataaacatcgattgagacaatgaccattgatcaagtggtggttcgagaataatttttcatcacaatataacaaattaaagttttaataaggtgtccatatttaatctttgaagcgagatacactaggggggaaaacataatactcttgctcccaatttcaagaatcgatacactaatggaattgataatcgatccataatttgaccaagaaattgatatttgttttttatgcattccaaagaaaaacaaacaccaactacaacgttcgaaactactcccacgaaattagcaaggagattgcttcttcttttttgtttttaggttgcttcttaattttaaatagttgacattgcactccatcgaatattaatcattggattcaattttaaattatctgatgacaagttgtaacaaatttaattgtactcataactgtttagaatttgcaaagaagtcaaacacctgtagattcaaaaaaaaaagtcaaacacaagctgattttacaaagcaatcttgacgtttaaaagcaggttttatgaagcaaacctgagtacgctaaaaaaaaacttaatttcttcacctcaccactatctcagtcctgtgactatgcgcaattgcataaataaaacgtttgattaagaaagataagcgataataaaatccattgannnnnnnnnnnnnnnnnnnnnnnnnnnnncaaaaaaaaaaaaaaaaaaaagagggaaatataattgacatgtgttcgcacttcacgcacgcccaaaacaattgcaatgtgcttcccttttcttcttccaagcttttacccccagttgagagttttgatccctgaaatgcggaaaatgatgattggggttttggtacaatttgcttgattatgctaaggtagtggaaaaccaaatgatgattggggttttcggtataaattttgtggcactgccttttacaaatgaatgaacctctacgcagaatcggaaatagctacccagagttcaattacttgtagtccagattaactagttaaaccaataatttaaactcagcagcatggatatcaacataaggtaccgacttgaatgaaggtctcaaatctagtcacttgtgatgccaaaaatatattttacttacaggatttattttaacttgcagatcaatttgcaaaatacatgaaaattgaataatatgtgtaattggaaattttaatatcaaattcatttacagttgttaataaaattctttttcacgcaattatcaccatttttgggttgaaaatcagttatattttatagttttcattaaatgaatctaataggataaattataaaatgatgactatttcaaaaggagcaacttgacccataaaaaataaaagatcaaaataattttttataatatgaaggatgaaaataaatcttaaaaataaaataaatcctagttttttttatatataaaaatttatcctcgttttagggactcattttccgtccctcttttttttttttttttaagtattaaattttaaaaaggtaaagacaacctccaaacctgaactcatacctaaaaaaatgaaatactgggaacgtgttgtgtgttcccagatcaaaatcttgttttggttcaaaatgggcaaacaataactttacattattatctcaatccctatctctctctctctctctctgctttgctctaaggtattttctcttgttcattttcagggctatgtttggccaagggtaatacatcggatctacatccgttgtttgccccttgttttcaattcactctgaacgtgtaaagttttaaactttattagataatcatgcatttgggtattggagtggatttgtttttttatgtttttgtatgggaaagccattttctcggatgggcttattgtctgagatagtttgcggcatgcttttacatatattgtgtatgtgttagataagatactgcaatcccagattttgttgagagtgtacaacttcagtgcttagaaacttcctcagttgttcattttttttcaggcagtaacttccaatgagtggcggatgtatttgttgattgtaattggtagatgcatttgaggtgcattttgtgaggtcatgtgaaagatggatcttgaaggcaaaaaatttgggaggggtaagaacttgacatgtagattattgattgtttgcttctctttttttattgctgatgcaaatgtgctactagataactatatgttcttagaagtggactttgtgattactgaatagttgaacaggaaacactgtgaaaacatatgcaatataataattcacagaatgcaaattagatttcttttgagtggactgttaaaaacaaaagattggtagttatcagagctttctttaccacagaaattgtttacagtagaactttcttgatgtcttggttcactgtttattggagccacacgaacagagaatttcgtgaggtttaaagtcagtgatatagcaaatggagcttactggacctaatgatcatgagatggtcatttataaaaatcctgttgagggctcgctctaacatttaaaagtgctaattccccacctttcttttggcattagttcattgatgactagataacattgtgttcgggctctatcatgtatgttaatttattatttactatcctcagtggattatttgataaactagtgcccaatgccaatattcatttttcttattactacgtgcatgtggccatatttgtaaaagcaagtatgagtgaactgattgttctttcttttctactaaaaacttaagaaatgttcaattgattgttatgattaaatcttgaatgtcaattcccagttctcccattatcttttaaaattaaagaaaaactgttagtgcaggtatttccatgtcttatgtttgggatgtaattatcttcaggcaaataactctctgttaatgttgatacagaggttaagattactaattcattattacgccattagacatattttgtctgttgttaatattttttttttctttcttgagggggagctaaatcatgtatggaaacaggccatcttagaaacagaattagataattaggtaaatatccatagatatgtgtttttatgctgaatcttttgacttgcagatctattttaacttgtttcctagagagtgttctgtctctagtgctctcatattgtgtttttagatagaaaaataaatatgctctcctagatggctagaattggaatgatttgaatttcattatgaacttatgtttgttaatttataataaaattgtattatgacttatgttgagttgtgttatagacttatgaactatgttgagttgtgtgttatgttatgtattgtattgtatttggatcttatgattatggtttttcaacttaagcttgtttaatgttgtgttttagaggttattttctttatctatgttgtttttatgtgtgtgtgtgtgtgtgtatgtgtaattttgcattttaggtattgtcttatgatcctctacttaaaagttttcaccccccttatgatcctatagaatctcatgtttaacaacattgtgtaattgtaactgaaacccttcttggcatggctctcactttctgcagtgatttacctatttaccaaggtgaaaagcttttcctctctcaatccctttgagagtattgggcctctggggatgctcaattagagtattttgatcagatttattttttaaaataatcacatgcaatatcactatattatctgtcattaggtgcttctgattaatatctgtcagaacattgatttaaatggctcctcagtttcttttctttctttttgaaaacttgcaatcaatgcatcaaattcatttttcttaaagtatattttgcttagtaaggttatttcttggaatcaggcaatagagaacttggaggtactcgtgatctcataaatcagtatagactttggccctactatgaattcttctgcaagaagtcactcccagtgtcaatttcagagacacattatcttcacaatgtggtgggtgacacaaaaatcaggaagggagaaggaatggaactggatcagctctgtaaaaacatggacacgagtgagaaaaaaacttgcttatgtccttttgacttggatgtactaagtgaagctttccatatgagggatatgaatccagtccacctttcttctgtaagatttttctggctgcacatttgatcctattcttaaagaaaaccgaatagttcaaattcacatttgattgttgtgttaaaaagatgtgttgtgctgatgtgttatacactggccagaaggggctaccaaatgcagtgcccaaattagagaaccagtctagagatcatgagaggaagaacaaaaaggtcaaagataaaggtgagaaatataggaagcagaagcatagattacatcaagtaaataatggaagttgtatagagaacatcagaattagaccccatgatcctcatcccttgcagttgaagaaccaacaagacaaggtttgctcagtcctttatcccactcttctgtgtggtgtgttacgttaaattaaatgcaaaatttattatttacataaaatttgctgcctgtaaaataccaaatactagaagtgtggtattctataattttattgaccttgttttcgtaccatagctagtatatttcatattctgttttgaaagaggaatcggcatcagttattagcattaaccatattaagctaatacatgattttggtttgactaaaatattaacaagtcttgctattcatacaacaatttttttatccatctctctccattgcatcatttattacatctcgcatttctctctttctatcttagtcgtataattggctgtacaaataacatttctttattaacatattgttgaggttaccattttttattgtttaatttgtcaagttgtcaatttttaattatcgagatctgattatgagttattaaaccgtaatatgcaatattgttttgttcctttatgttttaaagtagtaaatgatatttatttgtgacttaaattgcactaaaacccaattttatctctatttaagtctttcagaaaaggagggcagagacaagcaacaatgacccttctgtttgcaagcgataagatactagaatgagagcaaatttgaattttttttttcgggaaatacgtgatctaattcagaaactgacagtgaactctgctttgtcacatttaacattttctgttatcttctactctaaatctcgttacatgtcttgattttttctatttggctcgcctaaatactgaatttctatagtggatggggtcagccaagggtgaggattaaatgaaccatggaaagtcaattttaagtgtatagtgcgggaacaaaagcatatcatgttctgcagtttgtttattaattaaattaaagcattatcattttctttctttctttctttttttaagttttgcctttttgttttatcactagtttttcctaggatttcaattgtatttttttattaaaacaattgatggtgttaatgtttttaaattggactgatcattaaattgagaaaagtattattccatgatttgtttgaccatctttggtagtagtaattatgtgtacattttattatatttaataccatatattataaactcaaaaaaattagaaaaaatgacttaccccaccgtcaatcaagaatttttacactgattaataacttctcattattgctaaattgagagttcttataagatatatcatatttatataatttttcactgattgaaaattatttttaatactttcttttatgtgtatgtaaatttttaaaagatttgaagcataattatagtaaggtattactggttctagtctttatataaaaaataaataaataatttaagaccaataaaactaggtaagttagtttaattaataaaatcaaatttaaatcttattccaaaaatattaataatggtaatatttaacgatattacacataatttaagggatgatattttttcaccaatgaatgtatttgtattgttaataggtcaataaatatattcacttgcataaagaatgaatgagaatctttcaaaataaattaaagatataaaaaattaacaaataatataattggatctatgttcttataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttgtgacattggttaattcaattggtatttttttaatttgtaataataataatttattaactttactaaacctcttaaaagagagcacaagacgtgcgtttttaatatatattttagtctattcatttcttccaagacttcatatttctatttttataataaaatagttatttatttacggaaaaaaacaatttgtttaatggaaaaaaatgatttgctaaatggagatatgaacaacacaaaatgtaagttccttctcattattaagctgaaaaatcatttaaatttagtttatttttcctttctctgataatctgattatatatctttttnnnnnnnnnnnnnnnnnnnnnnnnnnnnnnnnnnnnnnnnnnnnnnnagaatgacaaaatcatgtgtgtgattgagttattttttcctgggaatatatattataattaataaattatctttattacaaaagttatcgttacataccaggcccatgtatttgacgattacaaaaattaaaagaagagcaagaattgcctattaaaaaaagtgcgttggaggtaaaggaaaaactattgcaaaatataggaacttgatagtaaatcaaattgtgggaatattgattgggcaagaatgaaatttgcgggatttttttttaaaaaattaagcacctatcatgaaggaacaatgagaaagtagttagatagtaattaataagagattatatatgaatttttactcatgaagaggtataccaatttcatgggaataatttttgctcccctcatgctgagactaaatattgatagaatatgagattatgtcttttcccaaaataaaatgttttataacctcgtaataaacatgggataatttttttccgatcattttttttagaattactacttagaaacaattcctatattatgtaagagaaatttataatgttaacttttaaaccatacaacatagacttaaacttttatttgttatatgctttaaactgtgatttactatacacaccagacgttaagtgtatattataagtctggtgtgtatagtgaatcacggtttaaagcatataacaaataaaaatttaagcaatgaaagtcatcttgtgttgcattacaaccactaatcagttggtaaaaggatttcagacaagacttaaaggactgcataagttaggttaatcaaacaagtataatctagatgcattcatctctaactcttaatgtcttacttttgcttataattgagttatatgcttctgcggttgtttgtttgaaatgttgcatttaaaaaaaaataaaaaattaaagactcaatacaaccccgcggtcttgagtccttgtgaaaatcaacttatacattttagtttttagagaagttaaataagcgttttaaaaaagtgcataccttaattttaatttgtaaaaaaagttgagttagtttacttttaaattttattctcctataaaggttgatagagaagttaatccaaacaataataacaagcttcgccaaaaaataaatgataactaacaatttacgtaaagtacaattcattattctaataaaggtttcagcaattgaaatccaaaataatcatttcaattttttccaccataggtcaaataagagattatcacctgtcattacatttctaatctactaaaatgttttttttttttttttnnnnnnnnnnnnnnnnnnnnnnnnnnnnnnnnnnnnnnnnnnnnnattcgtaataattaaaaaaattgaacgtataaattatatttggaactttaaagtggctataaaactacttttggtccatggagtcacaagttctgataaatctgttgtttaaaaagattggctcatagcctaacaacgaaacaccttggaaaaataaaacattaaaacaagttggggcattgagggtcatcataaaggaatctaacttctgctctaggtgatgctcgatccatctgcaacaaatcacattaaatacttaacaatacagatacatctaattgatttagaccatgaccaaccgtccaaccctgaaagtaagaatcttcaatgccggtgatcttgcaagcacaaaccgtatcaaatcaagtgcagtcttataggaagttttaactgtgattttcacatcttgaagctgattaaagtaacagttactgtagtcaaacaccttcgaaatctggtgtagctccactgccatgcaattgcactatgaaacaaagagaaagctaaatcaaaatatgacaattacaagaacaaactaagaagcataggtcttcttggtcacctttataataagtgtctctaggttagaagaacttccaagtaataaagaaatagtaaacaaaagttctcttgcttcattgaaatctacaccatccaatttcagatattttatagctttaagctgcacttgcggattatctgcctgcagacaaaatctatgcaaagaaaacaatgcaaaggtgagatatatttgaacacatccatctcaaaatacaagttcttagtataagacaaggcaccaaattaagaatgctggttcatgaaccaaaatgcaaccttgtttctcttcctgaacaacaaataaatgaataggataattttagaaaataaacaagggcaaccaagctaggaggtagaagaaatgtgacaactgtcaatttgtgatgagaatataaagcactcaatgcatgatgcatcattcattaacataatttatgatcgtcaaatgtttaaacgatatttagaggaatttgtgtagattttaaaaattgagtgaaagtgtatataattttcttagactgcaaagaaagtttatataggttttaaaaataaatgacaaatatgtaatatccttaaattttggaaaggtttgtgtaatttattctaaatattactatatgtgtttctacatgtgtgactatgaatttatttatcttaacattttattattatttaaaatgtaattactgcaaaatttaatatctctatatgttatatacatccattgccaacaactcgatattaacttataagaaaagaaataagattaaaaaaaatgagcttatctcgtgagttaaaattaatgcatatataagttaaaattagctttagaattagttaaataagagaaatgttaaaaaataatttatgtataaattaacgtcagcttataaaaaaaattgatttccaaagaagtaattaagtcaaagcggaaagtacaaataagtggtattcaaaagaatacataagcattatttaaaattaaatcctaatacacatgtaaagaacagtgctaactaaactcggtaagattgagcttttaagatatcatggtcttaggtacaatttctactactatactttcattgccataagccctaaaataaagataccttagccatgaaataaggtactctccctttccctcccctaaactttactaataaaaaatgtatattgcagttgtcaatttgtttggaatgactgtaagagcaatcaaactgttcaattgcaccaccatctaagtgaatgatcctagagatcctaggagggacactagatatgaagcaaggaaatacccacaaaatttaaccctcagacacaagtaccaaatggaagtagtctaaaactactgtgttttcatcctttccccctccccccagcccaaccacatagtagtgtatgatgcttcatctgatcatcatctcagttctttttttcccctctcttttggaaacattggtacaaaattctatttcttgtaaattgaattgtagcaccttttgttgtcattgtagttttctccagatattacctaggtggactaagatcagcacaagggcataaagaatacagagatacagtgacatgtcaaagaagcaaaattgttcgtgtggtcatctgaagttgcaacaacgagctcggcctctagacaatttgtcccaaagacagatcatctgccttggtgattggtaatgtgcagtgaagtagccctccatgcatccatactgacaaaacttccaattatgggagtactggactgctgccatggtattgttatatcgctcaacccacattcccatacttacatcctccattttaaacagctgccaaataatatacttcagtcacctataattttaattgatgtggcaacttggaaagggaaggggaggattgcaaaaggtaaaatacagataaaaatttaaaaggttaaccaacccttagtttcctatccttgtgttgagataggatgaaagtaacaatatcactagaaattacatatgcaggcccatttgcataaggaggatatacttcttctggccattcctgcaacaacaatgcacaacacctcagagaatggaacaagaacaatttacaacattctatgcattctccgtacttgccaacaaatatattttaaacaaccacaataaccaaggaaaagaatccaattacagaacagaaatataattatgaaacactgctgcatcctactacaaagtgtcaatcaaaactagcaatgtgttgcaccagtgcactggcacgttccagtaatatataaaacaactaaaatcatatttgcactcctatgcttactaactagaagtaattgtattgctaaatcttgagattttagcccaccctttaggaccctatttggacaaataaacatcacccacacaagtggtcatggcagcaaagcagttggtctagggtttctattctcccatgtttttaagaccctatgtaaggcaaaacaaactacactaacatgtgttgggggtgtaataggatataaagagaattataaccctaatatctacatactatatttaagctccaaggagagctgccaattgattgttaaaattaacaaacaaaagaaataaatgatacaaaattcatgtagtaactatcatacctcacaagtgactgcccatttgccatttctcagaggccgatgccgaagattgagattgcccatataaagggacttttcctggggtaccttctcaatttccttcaagacagtatcaacccttataaatgtatcatcatcacatttcataacatatgcagcagtcacattctgaatctgcataaatgaacgttaacttctttactctagagaacacaaaaaaaaaatataattaaaggaatcgggggtggcggggacagttttaagtggctgaaagaattgaactcaccccaaactcactaatggctacagttttaagcacaacaagctcatagcggtccataaagggcaaaatgacaatatcaccaaagtaagcagcctccttcttcaacactgcatttacttccgttcttggattctttaattggcacaaaaacagaaaatttagccatataatatcactacaaggaagacatgaaacaaaaatacacacaatgccatctaagaattccaaacaaacccaaaagggccaaaactaaaattttcatttgtacacttagattgcaattgcattctatttcaaacagacatttcaacatggaaatcaaacatcttaacgtatatttctgattctatcactaagcccaaagtggaaaatcagtgttggcaaccaaacctgtaggattacaaattgaggaagtattatgcacaagcagtcaaggtaggttcccttatatcaacttgtcatgaaccaagtaccccaaaagctcaagctatagggtgaaagcaaagcacaaacaatttttttattaaacacatccctcatgcaagatctgtatgggctttaagcatggactatggataaacctagccaactgtgtgctaaaatttagcttttattaagaataagggaggcaataagggttgaactctgaaccacatgatcataaaggctcttataccatgtcatgaaccaaatatcaaaaaatcataagtttttaggagagtgaaaaagcaaatgaatggtttgtatatcaaacacaactgatgtaatgatttatggtttaacctaaaacgtcaatcttgtcccatgcatttgtaattgatttacagcaacaacattatgtgatgagattgtaagaataaaagttgcacttgtagtcatcttattcaaagaagctagcttcatggaacccaaaatagcttagtcaaggtgatagctattcctaaaagtctgttatcactcacataacatgcttaagtcacataacaaagtcaatgggttacattgccaatgacggatcacatttttgcaagacaaattttggtcctaaagtattttttccttttgctttctaaaataaatttcagtagtacatatcatgttaggctttattagacccaaaaatattttatcaattgctataaaatataagtcataccttccaatacccaaatgtcaaattatagtaccaaactccaaacaaagaagcataattaacatgcttggttagttggttatgtgaaaaactcataataagagctcaagttttcttctgatttgtttattttatttgaaagaccacacccttacgcaacaaatgaatttgatacaagctctttgaaaccccacacccagattctatttgcaataccttcataaccaacagattaagagactcaaaagctcccctttgaagctcaaaccagagattctatcattgcccccatcattatttaaacccattttaccatgaaataaccctaggaaggttgtctttctcttctctatgaagttttttctgtgtcagtgtgtcatatgtctttcttggaatcatgcgtctctttgtgctcatgtctgagtgaatcacttatatacttttatgccagataaaaataaagacagaaaacttactagtgcaacaaagaaccgtgctattacatctgaagacttgattgcagctgattgcatccatgtctttctaacagccatacgttctgcaaagtgatttgaagctgaaagaactccaataaaaagtttaataggatgtttaggtaaaggtctggctttccaggtctctgacatttccagtactctttgaggtgagaaacttggatgggaagtaggaagagaagtagcataaattgaatgaacatccacatcccctttaattgccaatcctgtagcatcctcaagtgtaaatccctgaagattagacaaaaaaacgttagacaggaaaaaaaaaactgtgaccatagaagtaaattatagaaaaatggaaatatattccatgtattctcaaattttaagctataagagtcacccttcagcatgtagaacaggagttattaccattatcacaaattattgagggtaaaccaaaattctgtatctataaaacctataacatgtacaaaaggaactcaccagaattttttgaactccaatacaataaagttaaagcaaataaaaacttatatctcaccatattattgtcattaagaagctagatatcgcaatttcacaccatctagatgtttagtaaaaacattggatgaaacacctatattatctcaagaatctcaagaaacttacagtccgatatggaaatgaagttacatggcgacccccaatattaatatggtatccatcaacaccagcacgcaatgtaaggacaaacattctgccctctactaaaggaaatggccaggtcatttctggcttttgctcacgccctataaaccgcttaaaccaagatgtcatcttggactctttagcatctaaaatgtcattccgcatccatttctcacaccgtctgtatccatcaactgccaaatataataacaaaaattataaggatagaaacagacagatgttaggcatcaccagactccccataaacaactggaatatcatattgacaataaaataaaaatattcataaaacaactaagacataagatcctattactaagtagtagtacatgatatatcgacactataacttataactacaataaccattacatctattatgctttatagctttatgtaaaatacaccaaccaggaaggtaaaccttatctttctgttgaccatgcaatgaccaagaattaaggtgtgcatattttcatgattgtttttcaacctttgttattccacctttacaatgatatcaaatttatattttacaataatgacaatgatggagactcaattctgcagcactttctttaaatatgacacacatcaagatgaatatgaaatatgatatatcataccaagcatttcttcttcatccccagacggcagaccatcacatctttgagaggttccccagtgcattcggtaacaggtattatgctcaattactggctgtttgctccaatccccccttattcgaggattcaagtgaaggatctttggaggatcctccccatccactgacttcagcccttgcaattcaaccatgaattgggaaactgaaactaatcctccacctctcttcatcttggcaagctggggaacatactccttatgagcataatggggtgtccccaccacagtgattgaagaaccagctgcaagcccacagggaagaaacatcaaattatctcctttaatcaactcatccccattcattgacagccaagaagggcatgactcgggctttccatcaaggatggagttttttattgaccccttctcgtcaaccttatctacgtccttccaagccttcaaccccaatatccatgcctcatccgccattctctcaagcacagacaaatcattggtcctcttatattcccgcattatcttcccagttatcctaccatatcgtggtggaatctgcttcggagactccggaaaacgctcttcctccttccttggctccgtgtttggtctcaagggggcaccctggtccctattatcttccaatctcctatgaaatgcatctttataaacagaactcacaaaagacttgctcaaatctgaatcttcagagtccccaacagctgccccctccaacctatcttcactctcatccccacttaacgttgatacaattctcaaaaactgtggaaacttgcatgacacaaacaacaagtacaacaccccaatgccaaacaaaaaatgagacaatctaaacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattaaaaattattacattattacattagatatgagttttacacttttacttttatttctagttcactaccttttattaaatgttaactaatgaataagagtgtgaaaaaaatattatgttatcaatatctctctaaatattaaagagtattgaaagtgacggcatttttaattttcttataatttagttttcgtgtaaactggagtactttcttttacaaggaggaaataaaatccaatttgtgacattggttaattcaattggtatttttttaatttgtaataataataatttattannnnnnnnnncaagaagggcatgactcgggctttccatcaaggatggagttttttattgaccccttctcgtcaaccttatctacgtccttccaagccttcaaccccaatatccatgcctcatccgccattctctcaagcacagacaaatcattggtcctcttatattcccgcattatcttcccagttatcctaccatatcgtggtggaatctgcttcggagactccggaaaacgctcttcctccttccttggctccgtgtttggtctcaagggggcaccctggtccctattatcttccaatctcctatgaaatgcatctttataaacagaactcacaaaagacttgctcaaatctgaatcttcagagtccccaacagctgccccctccaacctatcttcactctcatccccacttaacgttgatacaattctcaaaaactgtggaaacttgcatgacacaaacaacaagtacaacaccccaatgccaaacaaaaaatgagacaatctaaacctcctcgagttgggaggatcacttttcgctctcttcatcttcaaaacaacaacacactttacaaacacaagaacaatctcctctcctcacaagaccaaattttgaaggcaaacccacattcaaattttcaacaacaaaaaaaaaaaagccatgcattaggcaatataaccgagcatttttcacgagaatttgaagaatcaaacctcaatgaagagggagtgatcgagtttcggaaatcaaccaatgtaacaaggcatcaacaaattgggaagaaacccgtttcaagtggaccccggagaacccttaaagcttcaagctttagacagaactccgcgaaaaactcgatctccacccttgaaccctaatgcacaaccctgctataatgatgacaattgaaatgaaaacgaagaggaggggacccagaattttaaaattaaaaataaaaattaaaaaatgaatgttcgttactttattgtattatttaatttaattcaattcttattcttatagctgaatttccgatactaactgtgtaccctatttaatgtctttcatttgcaaggagggtatttggaattttgttgtactgttgccattagtcaggaggatgagttttttttcttttgctgtataaggaggaggagaaatattaatatttaatagacataaataatccatcacagaatttttcatggtttgaaatttattaaaaattattacattattacattagatatgagttttacacttttacttttatttctagttcactaccttttattaaatgttaactaatgaataagagtgtgaaaaaaatattatgttatcaatatctctctaaatattaaagagtattgaaagtgacggcatttttaattttcttataatttagttttcgtgtaaactggagtactttcttttacaaggaggaaataaaatccaatttgtgacattggttaattcaattggtatttttttaatttgtaataataataatttattaactttactaaacctcttaaaagagagcacaagacgtgcgtttttaatatatattttagtctattcatttcttccaagacttcatatttctatttttataataaaatagttatttatttacggaaaaaaacaatttgtttaatggaaaaaaatgatttgctaaatggagatatgaacaacacaaaatgtaagttccttctcattattaagctgaaaaatcatttaaatttagtttatttttcctttctctgataatctgattatatatctttttcgtaaaaccctttttgttttcatcattttgggcatatgtgccttgcttcaacattaattagcttttctcatgtatcggtaccttgttcgactttctttattatttattagttaagggaaccacgttctcattatttgccggcctacgtttcttactttcttgatgcctaagaagtttgcatcaaacaaaaggaaaacaatgaaaatatcgattagttggcaaattgacaaggttattctttacctatataagtttaaagtaagatgctaacttaaacttggtctttcatttactgtagattttttcatttggaatgatctttagtgaaaaataaaatttgagattgtcaataaaacttacttaaaactttatatcacatgaaatatatttaagtatgtttaaaaatagttgtatgatgaataatttatacaaattaaaatttcatattatatgtttaaataataaataaataagttagcctataagttgaaatgactttcttaaaatcttaatcattttttagtgttacaataatgacatttttttagtcgactatcatatactttctttttttaacataaagatcagtataataaattttgtatctttcaataaaacctaattttctccagtataattaaataagattttctataaactaaatttttatgttaaacaagttagataatggagttttattatgtaatttattatttcatccctacatcattattagggttaattacattgatcactccttatgtttatcattattacacttgatactcctatgtttcagtacattacttttagtcccctttcccaaaaattgtctaagttattttaaaaaataaaatagaaataaaatatagttgtatgataatccaaatttactccttcattttaacattgttgattaggattggggtgacatctccttttttgtctacttcctccattatgcctgtctctgacgccaactttctccaccactgtgacgtcaaagaagagagaagaggttaagagagggtcatgcgagaacgagttgaagatcagaacatagaaagtttgatttctgaaaaaataaattgaatacaaattaataaaaggggacaatataattcacatactattccgcttttgtcaacagcattgctagatactctaaattatgtaaatacaaattatccttaattatggaacgtgtgtttattttttgttgttggtgtggtagttaagtagtactgattaaattgagttgaagtttttgtaaaacccaattatccttagttccatgagaaattgataaacctgcaacttgatttcttatatgaaagttgttaaagttccaatgttatagtgaacgagagatatatagggaaagatttgaagtccaattataaaaaattgtcttgcagcattgcaatgcatgggagtgcaaaaagcttcaacataaaattctttctcttatccatattgaaatctattttctctctacaactgcttttttctattttttaaatcccttgtttaaaggaggaaagaaaataacattttaggggaaaaaataatcaaatgtcaaatggattgcacgtgatttatttatgtcaaacattcaaatgatgttaacatgggaacgggcatctgttgttataaaaattggcctagtcatcaccctgattgagctattggatcatatattcaataggtgggttactttattaatttgatatatattttaaaaaattaaaatatatataatatacttaagaaaatgtaatcaattcatacttttatattccaaaataaaaattattttcatgatcaaactataatattatataatcatttgttactataaattatttataactattatcattaaataactaagaaaattcttatttttgaggattaaataaaaaatttattgaataaccataaataagtctggtgaaaatatataaaacatataaatattatatcataatcaatataataataattaattattatattattatcaagataaataataataattttatagaaacatattatatatcagttaataattaattattaacaatttaacatgttatagaaattgaagaaaaaaaaagaaaaaaaaacttctccatggaatcaccaagtcaccaagtttcatcaaactcattcaagtcaatttgggccaattgaattttcagtcctgcaccttaaccgaaccgtcctgcacattggatctcagtccaattagatgagccaattttaataactatgggtgtaaccatccttaaaaattaaggagctttttttaggaataaaaaatataaggttgttaaacgtgtaataagtgcaaacattaggaaaaaatttgtgtaatttactcttataattatttttatatttaagattatgaaaaggataaatattattagtttatcatctcttataattatttttatatttaagattgtgaaaaggataaatattattagtttatcatttgaattgagcatcagtgtgaatttactgatgtggattgttttagcttaactaaatatctcgaatttgagtttgaatatgtagctacattaaatactcggagaaagaattttatcattcataataattctttttgactcaaagaggattgaagatgcatgtggtttagacattttttatttctttagaatagagtgaaataaaattgaatcaaatgatatttatttcatttcattccacctaataactttattttctgcaagtttttttaccaaaaaatacaaaaaaaaaannnnnnnnnntcctctaataaccactacaagaagaaatgagcacttaatttggcaccattacagtgtcaatagatgtgtctcttttcaacaacagatgaaccctagctcgcttagcattcagccatgttgtaaggtgggccagtattttagacccaaaataagttaagcggagtggactaggccagcccacgaattagcccgttatttttcttcttcttctttaggctgtgtttgttttgaagaataagagtgatatacaagagaaattttatacttttttaatgtggaactcacatctcttacactttgctttaacttaaaaacttatcttttattttcatcctctcaaccaaacacacccttaataaaaaaaaaatactactagaaggaaatgaggttgatgggctcatcattgggcctaaagatagaacagtttttttttccttctttttaatgggttatcaaaataaaaggatgacaactataaaataacgaaacagaaatcagtgcatagccacaagaacatagccacaattaggggtgaaaataggccaggccaggtcaggctttgataggcctaagcctgacctgtttcactatcattaagcttaagcctggcttgttacctgttaaaaataagttattaaagcataagtttggcctgcataaaagtctggtctggcctgaaagcctgtatacaaaggctgattaaataaaaaaataattaaaaataaaaaattaacgtaatatcgatgcacaccgacagcccctacctcaaactgaagcccaaaatgcgatcctccaagtttaactactccatggtaaatgtccagaccattggagctgacttgtgttacacttggtttgatagagatttgagtgttgctagagtcattctatgaagtagtcataattcttatgtgtataagtttgtcaaaatcaaatagacctattttacttattcccacacttgccattcatcttcattagtatatatattatatagactttatgtcattcatcatacactatattattgttaataagaaaaaatatttttagaaaaataaatatattatttttaagttttaatatatannnnnnnnnnagtccatacaatataaatcattgatttttttaataaaaaataatattatagataaattatatttttttatgaactaatatatataaattagtaaaaaaaattaaaacaaaaaacttaatttttcttagaaaaaactcttttgaaaaaaaaaacaattatgaaatcggttccccagaaaaatcgatttttggggaaccaaagtactgtaaataaaataaaacaagtgagaaatcgatacttgctacagtagtagaatgcatcattgatgtaaatattttttgggttgaattatttggataaatatttatatttttgtattttttgggtaaaaaaactcttattttcttccacttaattgtaaaacaaatataactaatttattctatattcatttttaatttttaataatataataaaaatgtttcaacatgatgacactcagtgtgcctaatttatccctcaagctaaattccaaactataaggaatcatccgagattaaaaaaaaataataataagtgaagaatcgagatagagaagcaacaaaaatggttatcttgtcataccaacaaatgatttctctctttaaaatctcacttcacaccaaaatgcatataaaaaatcagtcgtaaattaaaacctttcgagaaaattatggtttaattagaatagtggttaaaattaattaatgactacttgaaaacagaaattttcgcacatattaagaacgaattcaattttgaaacctgtgtacctaaaatatttcttgcaagaactcgatatcatttggccctatctgaccttgtgtgttgtttcgaaaacgaatacatggcactcagagcaaaaggtaacgaaatagtaatgagaattgttttaattagcaaaatttataaagtattgggatatcattcggtagattttattttttttcaattaatacaaaccttcttgcgtcgcactgttataataagatagattttcctctcttaaactttcctattaaaataagttatttacttctcaaaaacctttttttggctcaaaatcttggaaagttaaaagtcacaagagtccaacacataatcgacaaaaaaatgcaaatttgattctcccatttttatgcttttttgctctcttcattttattactttggtttgtatcatttgttataacttagaacattggttaactttgcccatttttgttggctctgtgctgccataatttccaacgtagatatcagtgttgtcactaaataagggtttgatttggtccctaaaattggaagctgacgactttagagacgtatagactttgcttggaatttcgctactttgtcaaaacttgtatggtggggacatttcataaccatggctacattatgcacactgatgagcctctcaatcctacatctttagaaacggaattcacagtattaccaagtcccactctaacaagagcattacccttgcattttaactataaatttgcttgtgccgcacactaagaaaagttccatatcaacatatttatgcaagtagtttcattcatttataatgataaattgagagaatgagtcatgcgacaacgataaaattgtgtcttggtgacttgttaatcataaattcaaatccgaaaacagtctctttgcatatgcaagagtaaggttacgcacaatatctctctcccttaacttcacataaggatgaaccactcgacaatgagatacaaattttttttttataacgataaattgacttttttttatccgtaagaattgaagacatgttagggagtttacaataactcacacccctagttcaaccagttagaccccctccacaacgataaattgattgcaaacaaattcaaaataattggaaagatcaaacacgcggtattttaaaactctgctcactccttttgaaccccagcattttcattcagttttcacccatcataataagaaagaaatcacaatggtaagcctaaatttcaataaatttaggtttagttgaactaaaactggaggaacaaatagtattaaaaaagcaaactctctaaaagtgggaactattatttctttaaaaacaaacttaatcatacatgcactaaaagtaacaaggtggtatcagcatacctgggttcgaagtaagcacttgaccttaagaagagagtgtagcccttggcaccaaataagcgattataagtaccaacatgcactcaaccaagcatatacataaaaccaaaaccacataacagtaatttccattgtagtaaagcccttttccccctggtactcacaaggccatactctcgaaagggattattaaggattgaaaaacataaccatagttaataatccattaggcccacaaacaggtgtaacatggcataattaaatactccatttctcaaaggcacaatttatgctgaaccttgcaaaaattagaggaggagcaaaatcaaagttttcccttgtcttcctccttcatcttcttctgccaccttctcttcttgtaatccagcaacatctggggcatcttctccatcaacttcgcagtgtttgcgcgcttctcagcagaaatcctatcacatttgtgtcctttcctcctggttttcatctccttcctttcaggatcgtagggccaatcttccccagcaaggaggacttccttgcgaattctagcacgatgcctagcactgatactcagcggcttccatgcccccagctcccagtatccccacacacccttggcaagctcatccttatatttccccaacttctcacgccaaggatactgatattctgctaccgccttagccaccgaactaacacctttgcccgccattacataacaacctctttttctctacacataacataacaacctcaatcagacaaattcacaaacacctcctaggctaacatattttttttcctttttaaaccaaataaattgatgttaccaacttcatttttcacagttgttctctgaaggagtaacacattagtaaaaaaagaaagaaaagaagtaccgttcaaataaaaaaaaagggtctaaatttaatttaattataacaaaaaaaagtgattatgttccagggaggtaaatcataaagtcaattatggtgaataaagtaaagcgaacaaaacacaatttaggtcacgaatacaacacagaacaagtgggatctagttcataagcgagaaaaattaaacaaatgaagtaaaaacaaagttagacttacactttgtgggattgtcgaaccctcttgagtaattcacctaagaaacaaaaaaaattaaacaattaagaagagaaatacagtgatatgatagcgagcaaatcctctaataaccactacaagaagaaatgagcacttaatttggcaccattacagtgtcaatagatgtgtctcttttcaacaacagatgaaccctagctcgcttagcattcagccatgttgtaaggtgggccagtattttagacccaaaataagttaagcggagtggactaggccagcccacgaattagcccgttatttttcttcttcttctttaggctgtgtttgttttgaagaataagagtgatatacaagagaaattttatacttttttaatgtggaactcacatctcttacactttgctttaacttaaaaacttatcttttattttcatcctctcaaccaaacacacccttaataaaaaaaaaatactactagaaggaaatgaggttgatgggctcatcattgggcctaaagatagaacagtttttttttccttctttttaatgggttatcaaaataaaaggatgacaactataaaataacgaaacagaaatcagtgcatagccacaagaacatagccacaattaggggtgaaaataggccaggccaggtcaggctttgataggcctaagcctgacctgtttcactatcattaagcttaagcctggcttgttacctgttaaaaataagttattaaagcataagtttggcctgcataaaagtctggtctggcctgaaagcctgtatacaaaggctgattaaataaaaaaataattaaaaataaaaaattaacgtaatatcgatgcacaccgacagcccctacctcaaactgaagcccaaaatgcgatcctccaagtttaactactccatggtaaatgtccagaccattggagctgacttgtgttacacttggtttgatagagatttgagtgttgctagagtcattctatgaagtagtcataattcttatgtgtataagtttgtcaaaatcaaatagacctattttacttattcccacacttgccattcatcttcattagtatatatattatatagactttatgtcattcatcatacactatattattgttaataagaaaaaatatttttagaaaaataaatatattatttttaagttttaatatatatatatatatatattaaataggctagcctgataggtctaacaagttttttttaaagcttaagcctgacctttttatttaaacagacttttcaaaaagccttactatgacctttataataaacaagttaggtcaagtcagaccttaaataggccaaaccaaaagcacctgatagctaatctggcccattttcacccttagctacaatcaatatacattcaacattcatcatctggcccattttcacccttagctacaatcaatatacattcaacattcatcatcaccaaacagcacaaaaaagattattaacaataatgagtgcaaaggagaaggctggcggggccggtggggctggtggcggtgcggtggctgtgtggtgacggcgagacttggagttggaggcagtcaaaagactcaaaacgtaaataaaacttaaggaccctacagggtagtttggttgtgggggagaattttaaaaaatagtgagtcacgcgttactttttctctattttaatttaaatattcaatctcgtttctcttcgacaccaccaaacatatccgtaatagagcatgctcaggaaatgaagtgagtgggcctctctttgttttggcccaataatagaacttcctaagtctaagaattaaaggtccacagataagttgaatgtgtggagctaaaaagtttgaatcttaagtggcctagctattttaagacctgtatactatgtggtatgaaggttaaacggattgttcgtgtacccaaattcaaatgtataactccagtatatataaaggaaataaatgtgtttggtgtacatattttatatccatcttatctttgtaattacagtcatacattattatattttatcattataactattttcacatgtctaaaattagacactattttctattatcttttattattaagaaaaaaacatgaaaggacaattagacacgaagtgctgttttttcctataatgccatcatggaactcggccaaccttactattggacttatattgaaaatcacaactactttaattaattgttgtttaatatgtcacctagttacttagagttttttcattttattctatcaaaataatgtacttcataatatttttatttcaaataagatgtgataattcgaaaatgtcatgtaaacatttgtttttttgttttacgaatgtaaacatttagtttgagactactttatagaattaatattgtgattatatatgagtttatattaagtagaataattaagaaactcaatgtggtacttaagttgcaatgattggaatttgttaagaattggatcacaaaaaaacccacgtatgaagtgtataaagcaacagtatatcaaatacttaacaaatataagctcactttgacattagtcaagtgaaacttaactctaattttttaaacaatatcttgaatatgaacgttataaatgaaaaaaaaaataatcgagatgaaagattctattaaaaataactaggaagatttttaactaaaattaatcattaacatttaacaaaatcaataaatattttgcacctataacatagtataaaaatcacaaaaatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaatatgaacattataaatgaaaaaaaaaataatcgagatggaagattctattaaaaataactaggaagatttttaactaaaattaatcattaatatttaacaaaatcaataaatattttgcacctataacatagtataaaaatcacaaaaatatataaacatatagggacataaataataattcaatttacaaattaaggaagtcagtttagctatatacaaacatatcgatgttggttgacatagttataactaatatgtttaaattttaattatgtgcttacttgttttggatatcatctgacaataatatgattttttttaaagttaatttacattaaaatatttgaatctaatttgaatgtattatgagtataaaattacttttatattattatttgatgatgtgctgttaggttaaataattatatatatgaatagaaaataaataattatatatatgaatagaaaacatcatctatttctcccgttaaaaaagaaaaatctacttctaatcctatgatatcaccattgttcttttattttttggacaaaatatcaccattgtttttgttctcgacgattccgaaccactgtctttcttttaatagattttgccttttaagttatagatgtaggccactgtttgtgcttcttctattgatagtgataattttagtttgactagcaaaatcttgtcgttatatgaattgaagaagcacttcaggacaacaccgaagctcctctttctctggtcacgaatgaagcaaataataggcggaatgagcacttgttgatatttttagaccctgaaaagtgattccaacatcaaaagattgcggctacgcctagcttagcttcactgtgagagaagatcatatccagagctaccaatatttattatcaagaatagatacggcgtttctttttgcacattagtgtctgccataacatgtttggtcaatcaataatcatcagcaaagtgaactattctgtgtttttttaccagacaattttcacatatacttttatctctttctttcttcactgttatgctgcattatgtatattgtttttcctcatttttttatcacaatttaggtttatatagtctatgacgtaaaattatggtttttaaacgagaattatgttttagttattggtttcgaggtagaatcttaataagtaattgtattaaatatttgaaaaaaatattatccaaaataattttgtctaatgtgaaaatatctaattgtatatttagagcttaaagtcaagattatatgtgagaataatccacatgcatgatgatatttttaagagtaattttacttttatagttaaaggcatatgtatatttattattgcctataaagaatattatatttattattgtacatgaatatattattatgtttcttttttagaagccacaagaatattttacatgagagataattatattcgaaataggtagagcattggggataaaaaaaatctctttaggtaaaagtttaatgcaattacatatccaaatttaatcattagttaaacaaaaataattttgcatcattgatccacaaattcgataattgttatgttactttagtacaaatgtataatatgttattaatattctaccttattatataataaaaaatatattttaaaaatatatttaattaggacggtcaaattacagatttataattaaagatcggttgaagtcatgttttcattgggttttcttttccggcaaaaaaaaaaaataaacatatatattatataaaaatagataatacaagggtaccaggggaaccaagatcaaatactacactgcaaaccccatctacccagctcatatatatgttttcattggtttaactactcctattttgtttctaaaaaaaaaaaaactactccaattttgtacgaaagtaaaacaaacgaactactccaatttgaaaagcattatatatttgactgaaatctaattaaaacccaggttggttcgtctcaaagcatagccctaatttattccctatggcctacactatctaattgattcctcagctagatcttaaagtgctttctaaattaaaacatcatattttgtagcattattaaatcccaacagttggtattccttggaccaaaagatattactagtagtattgtagtaataaactttattagttaaaaaaatattaaaaattattactagtataatatttgtatcaatatatattttaataataattctacacttttaatttcttaaccataaattctttttagaattaatggcatcattgttgtctaacattttccaaaactccactcatcatgcttggaagtaatcccaattaataatcatgtggattcgttcacaggattttcactttcaattttaaaacaaaggagtgtccttcactgtgataaatgagaaggacaattgtttatttattgaaccttctaaggaggaaaagattaaaaaggttgtgtgggattatgatgggaacaaaagtttggatggtttcaatttcaatttcatcaaatcttgttgggatgttgttgaaattcatatccataaggtcattcatgagtttcatgttaccaggagagaggttgtccaggggaataaatgcatcattgctcactcttattcctaagaaggatgaccctcttgcataagagattttaagtccatttttctcattaggtgtctttataaaatcatagtcaagtagcttgcctctagagagttggggaaggtggtggaccatagataattgacattcttggggggaagaaatattttagatgggatcttgatagctaatgaggttgtacatgggggttcgagaaagaagaaatcttgtattatttttaaagctgatttcaaaaaagcttatgatatgatggaatgggaattttttgcatacatgcttcaaagatcgggcttttgtagaaaatggattaagtgaaattggtgttgtttgcgatcattgtagcatcctgatttttcacttattgatgactttaataatacaacacttcactcaacatccttgttggtcagaacctttcataggtagtccttttcgagacctcgtaaatcagctctgcctactttcaagatcaatgactgatctcataaaccaacacaagatctttcagcatgctttatcttcactcacacgctttccaagaaactttccagaaggacatccatcccataactactccaagacaagcatgcttaactttggagttttaagtgacgggctaccaaaaagtagatacatcttgttggtataggtagtactaatcaattcctttaagttatcctcaaatgtgcaatctcacagaagtacagcctctggatccctgtcatctagtgtgatttggtcgaggtgttacatgcccaccaatttccgcctagttcgtcctcgaaccacaccgtactggggagagatttgctctgatatcattttgaaacatccctgattttttactttttggctactctcacactacgacacttcgcgggatgtcaattcactcaacattcttgttggtcagaaccctccatcgatcaaaatcctccatcggtagccatttccacaacttcaaaaatcagctctatctgcttccaagatcaatgactgacctcacaaaccaacacaagacttttcaacgtgttttgtccttattcgcatattttccgaaaaacttcccagaagattacccatcctataactactccaaggcaaacacacttaactatgaagttcttaagtgatggactaccgaaaagtagatgcatcttgttggtataggtaatatcaattaattcttttaagtcatcctcaactgcaaagtttcatacctatacaacctctagatctctttcattctggtataattcaatcagggtgttacaatcatatactacctttgtccttgttaatggtagccccacagaggagttcttggcacaaagagggcttagacaaagagatcttatggtgccattgctttttttggtgttgcccgggggggtgagcggatttgggaaggtagcgaaagcaaaacggctcactttcgggattggtgttggtaatagtagtttgaatgttacacttcttcaatttgttgatgacacacttttcttaatgaaggattcatatagggattctattactctgaagacaatccttaaatgcttcaaaatgactttcagtttgaaagtgagctttttcaaaagcaacttgcggagattcctgtgaaggatgaagatgttgctaggtaagaaagggtcttaaattgtgcaactatgtcaattccttttgtctagttgggattgcctattagagcggatgcccaaaagactagcacttgacaatcggtgattaacaagatgagaaggaagttgtcctcatgaagaagacgacacccatcttttggaaggcacatttgtttagtgaaatcgatactctcctctttatcgctttattatttatcttttctcaaagctccaaaatgtgctattagtatcttgaataggcttcaaaggaatttttttctttggggggtcaaaggagaggagcaaaaagtttattgggtgaggtgggatgtagtatgccaatcaaaagaaaaaaggaggattggggattgggaatctaggaatcttgaataaggtcttagtgggtaaatggttttggaggttgttgagtgaaaatgagtgcctttggagagatgtacttacacaaaaatatgaaattagggatttagataggcttgttgaaggatctttgaacacaagaggatctcaatggtggaatgatcttgtgaagctttgtgaaattaagggtagtgggatggttggttccaaaaagatgttaaaagaagagcaggggacgctaacgaggtgaggttttgagaatcaagatgggtaggaatgcacacctttgttcaaaattcaacaggttgtatctaaattcttaacaaaagttgctcatgattgcacaagttggccaatggtgcaatagtacatggacttggactttggcttagcgtcggccttggttcgtttgggaacaaaatatgcgacaacagttgtggaacttgattggtggtctgggaccgaaagttaatgttgtggatgggtcggattggtccccgagtttggagaaaaaaatcgttgttaaagaggtgtatgaggctaagatcaattcgtatgacccagataaggaggagttctacaacatcttgtgtaagctacctgtgccatcttagaccaagggccttgtgtggaagcttgctcatgatcgacttcaacccaaagataatttacataagagactaattcttccaccgggtttccaggttcaatgtgtcttatgtaacatgcatcatgagaatgttgaacaccttttctttagatgtaaacttgcatttgtggtgtggactcagtgctacgtatggatcggggacatcggggtgctgccaacaaattatctaatgcacttttggcaacatctaggaggaattgatggcaacaaagcaaaattggtttggggagcggtgtggacattgatcgtttggtctatttggaagctaaggaatcatatcatctttaataacgtcgcttgtaatcttcaaagtctgatagatgagtcaaggtacatggcttggttgtggtgtaaaacatatgttaaagacttcgattttacttgtacgtgtggtgcatgggttatcttgtttcttcaagtttgtagacaattaatgtgggatttgtgccgggacattgcagggttgataacgtgtacttatgatagaagaaatagtatcttgtttgggtaagtttctctagaaatatttctaaaagaagaaaataagaataaaaaatgaaattaattttttcataagtaaaaataagttcttcattaattaatcttgagaaactcatcaatacagcttctctaaaagatgagatgacatctataaataagctaatgaaaaacctattttagcttatggagaagctcatttcatttttttcttcttctagaagttcttctagaaaagtttatatccaaacaggttctaagtatttgtcgggcagaaaaataccttgcactagcttattggttagctgtcaagaattttttgtatttcctttgtggttggacatttcttatgccaatcactttttgtgtatatatatatattgaacgctccattagttttaaatgaaattcagttccatggagaatacctttatcctcaaatgaattactccaatgagaaaaagaaaagttgaccatcccatctctaggggaatattagtggtagtagtatatttttccttttccatgtgacgctaaatattttatatgcaactcaaagctgaaacattttagtttaggcgtttcaaaatttcccccactacatatttgactatgttaagggaacaacacatgcatgtttgacatctcttgcaccacgggtgacttatttgctgcatggtatagatacaaagtggtacatccaatgtaatcgtgccacatttccaagtgtataaaagagacaaaaattagtaacagtgatatataattagagcttaacaaattgaattattaatgcaaatgacaaggattagagatttgacatgcgtgaaagacagaatgtttagtgtaggggattgtaggtccattttcactaaaccaagtattatagaaatgactagcaagtaggctagctagggtgattagcaaacatgtattataaattgaaacaaaaaaatgatcctataatgagatatgtttttcctttttgatgcgttggaatctcttatgtcacccaaaacatggccaagaaaaaatccataggggctgctggcgtgctttcatgctgtgccccccttggttgccaatatatacctttggtcaaacatgtttcattctgtgttcacctctctctagcaatgttgtgctctaattctttgggggcttgtttggtttattttttgaaaaagagacatgcacacttaggataaaccctttttatatcttagcaataattgtgattagcgaccctttcaacttttctttgtcacaaattagtcattcagattacactccatcatgattaagatcatggggccccactcaaacattccgttagggtttgcctcttcatcattacctttctactgtattgctcttggcttgtaaattaaaaattaataatatatttaagctggcgctggtaatcacatcttagcttcaagttagccaattagccgtatgcatttattcaaacaggataataatgtttatttttacctcatttatttttctatcgtatcgtttcaattttaagtaatgcatagaaaaacacgccttgtaaatttccctttactttctttttctccagacaagcatagatagatgtaagaaaatgtgtaaaaacactatgcatacaaattattcccattaaatatcaatatacaggagtatagtatttttttaggaacttaataatcccttgaaaacgcattaagttgtccaattaatatgtgtatttgtatttgtccacacatatttccagaaatatataattaaatgatttcaatacgaaggtaaaaattactactttatgataaaatttattttacatgtttctaaaatgtataatcaaatcatttgccatattataaagcagttagcacaaaaatgacaatctaactaaaatatagtatttgtaaaatatttgagcatgatttttcgaaataaacttttgttcacttcatgccaagaagaagctttccatttaatgaaaacgctacctctcgttatttcatgaaataaaaaaatttaattacaaaagtatctaaagaaatcttcatttgataaaagataaaagcaaaattatgaagataaactatccaaacttagactagtagatacgtgaaatctcgggtgattagggtatgtttgacagggtttttatttggtttctcctctccttaaaagtaaaagtgttggattaaacattaaaaaaaaaaactgtccaacttggactaccgcatttagattacatgtcttggaagatagacacacatgaaagaaactattgcatgaactgcacagattttgatgaagaatggaaacattaatacttttgattggtaaggaatctattgaggggatgagttttatgcttgctactcaaaacctgattgttgctgctggaagaaaggaatccgtggtggtggatatgtattggcttacggcacttttatatttatattgggattgaagaatttattatatggtggaattaatgtagcatggtttttatctattatccgttttgacatgagaattaaaaagtgtagataaccgatatgtatagatggttgtaaatcattttgtatatgggttttaggtatctcttatgagtatttaatatatttattttgtcgatctataaaaaaaagaaagaaactattgtttacatatcatcacctttagccatttaactatagattctttaaatattaaactttctttatatttttcaaatatctccttaaattagctagcttgttctttctaatactgagctctttctctaaaataaaattagctatttcatttttcacttaatacacttttaaataggttggtaaactaagtcaaacttttatattatatttaattttgaggataaaaattaaaaaaaatgaaaataaaataaaatataaaagatgagttccacttaaaacacacaaaatttttcttttatttttctcttctgtttctaaatcaaactcagcctgatgtaacctagttttttttatttattattattatcgtttttcgataactgtttgagatctagtggacaaatttgaatcacaaattctgtaggatcctcaaaattattgcacagggaaaggtctctcaattataacatacccttttctacatttgtgtacaaatacagtaatctgtatcttcaaaacattataggcaccaggtaattatcatgggtttgacgttttataggatagtttccttacatgcactgtcatcatgccagctaccccgagtggcataatttttcccaaaatcagttgctcattaaattgttgcatccgtattttttggctttatttattgaatcctatttaagtgaatctgtacacttagaaccatctagctacaatttagagatgtgacttcttctgcctaagagcaaagaccttacgagatatacagattattgaaaggatctcaattttaactaacgcttttggacttacatgtatgtacagtttatatagcttggagatattattatagcattaacttatgaaatttattatgatattccaattggaaaggcaaagttaaaagtctttaatgtgacattacaatagattctatacgaatattgaaagatcgcaacctacttgcaacttatctctcctctaaaaatcacattgcgtagaataaaatggaggatagtaacggtggattttggttttttcaatttgtagtaaatggaattaagtttgagagaaatgtttttgttttaaaatactcgttgcaattactttggtatccctagcaattttgatctttttttaatgttaaattacaattttagtttctcttataaatttgtgattctcatctctcatgatctttagttgataattttgattctcctaatttttaaataagcaattttgattttccatccaattatcctgattgacctttagcatgttaatattgaccaattaatttgttagggtgacacaaaaccttgtttatcaactattaactgtgatttgtagctaaaatgggtcatctttgacctaaatctttctaacccatcttcaccaacacagtggcgctgcaacacccccacctacccttcttcatcttcttcgacaccacaaacactacaaccccatccaccattgccatcgtgcccccttctgaacccatccactagatccgccatcagaccactacgcaacccatgtcacaccaccaccaactccgacgtcaccataacaccaccaaaccaccgccaaccaccacaaacaccaatcatatcaccaaaccgcgaccaccaaccactatatccaccattaatgttgatgaccataaccagcaagggcgtcgacgtctgccagctcttgtgtgaccttcgcgtggcactaattctcgacgaggaagcgcgaggcgatgatgcacggagataatgtgctatgacgcactgatgcggatcttgtagagaagctcagttccatcggtcctgaaggtgcggtcggcgacgttgagggtgccgaattgcgatggggggccggggggcatcgaggaaagctagaagtgctggttattcttgctactgcggcggagctgggggcttcttaaaggaagaagggttgaggaatgcggaaagctgtaagctgtttgggttttttctttaatattttaattaatttgacattaacttaataaatctattaatcataattattcattaataactaaaagataaatgtgacatgtcataaattatttggtcaatgttaacagtttcacgctaaactgaagttagttaacaaaataattaaaataattaatttaagaaattagaagatcagacttgtctattaaaaattaaaaggacgaaaattacaaatttataaaattaaaaatcaaaattacaatttaatctttttaattacacaattattagtcctcaaaatgaaatttatgatttaaaaataataaaaaaaattaaagacaaatttaaatttgtaatcatctttttcttcttttatcatctaaatcacttagtcgtttaagaattattgagggtgattgtgaatttagtttttaaatataatttttgatatacattaaatttgacaaaaatggaactaaagtatttttaattcaattttttttattttttattttttacatttattttcaaaaccaaaaaaaaatatttttaatttaattttaaaaagtacaatcttcttatatttaattgagttttgtaggtgttactaccaataccaaaaccaatatcatcaccattattatattgtcattattattagcattgttatcattgaaagtatcatcatcatgataactaccaacactattactactaatattattgtcatcatcattactataaacatccattcactagtggagtcaacaaaaattttaacacatactaaattttaagtagtttcaaattttatttttaatcataattaattatataagtatatataattattaaaaaaattctttgtcacttaataactacaaattttttttagataatatcttaatcatttacttatcaaagagtgacttcgtcgttatcgtcattaatattattatgatcattattgatattattattgtcaccattcatctaacaatatttttgttgatttcttcatcaccaacaaatacactcttttaataagtttcaaaacttttcaaatgagtttatcttgaaaaaaaaaagagagagagaattaatattaatcaaattttagaaattggttttaaatttttttgggatatccgaccaagcccaatatccgcggctccacgtgtgtcacgactcactcgttcgtgaatcgtgagtgagtgagtggtctgacgctggagtcctactccgtaagtaaaggcgtcacgtaaaaaaaggaaaaactacggaatctatcaatctatctaacttagactaagagtctgagaaaattcaactcacaaggacccgcaaatcttagctacaagaatgacctgttccattttcttgatatctttcagccttttccactcacccctctctttcttacattgaaaaaataaccatgaaaatgaaaggctacctagatgtacatgattatccacccgacccgttcatctcttcctcaatatgacaaacattggttgaaaatgtagcgcagcataattcaaatatttttattccaagaatgttttcacttaattcgtgttctgactctgattcgatttgtggtatgaaacataaaaataaaagttcaatatagttttagtataatttgtgtttttcatatcattttatcaacataatgaacaaaaaaaaccgagtcaaggtttcaccggtaatgttaacgtttattcgtcttttccttgcttcttttgctcgagatagatagatagatcttcagctacctaagcagtaagcaagcacctcatcaaatacttttacaacaattttggctgaagctaaaatcacgtttttggcccacaaaatggggttacacggtatttaaaattattttacaacttttaagattctcaaaattaatttgttataaagaaaaaaaatattaagtttatgcttatagcccttttagtaattttagatataaatgttatatttttaaaaacacgttatattttagataatattttattatacaaattcgctattaacatattatattcaaaatacaaattaattattttaatgtcaacctttgtaacattatttttttaataatgtatttcgaaatgtaaaccagacggaaccttgtttaaattacaaaaattaatcttattttcgtacatattttaatgtaacatatacaagaatgattaatttaaacacacattttaattaaatgtaacagttaaaagttaattctatcaaactttaaaataaacatgcacagtgaaaattattgtgctattaaatctagcagaaacttgcaacaaaagagcaatacatttttatttgttaaaagggaaaaagtaattattccttctgttctagttttattgtttgattgaatatttaaagttaaacaaactttcatcaaaatggaactagaaagcatatataatgctatagacactttacctgaacagctattatatcataattctatactattatgcacgtgttagtgattcggtcagaagttcagaacatcctattcgtggtactctttaaactcctcattatattaaactattttttttaacagcgttatattaaacaggattgacgtgagtctttccatagctcaagtatattgatcaataggtatatatctaattaaagcaagaaaccaaattataaattcatattattaatgagattagatatttgatttcatatattataattaattattgattttgattctaaaaacattaaatatattttcattttttttataatatatatcattcatcttaaaataaatgtcatctttaatatttttacacaatcaagaaaatataataaatgaatgaagtaataaatttacaaaactttaatcttgacccacttgtccaactataaggtccctaattttttggctcgcctaatgagggttcaaaaaaccttcaaaccatttaataagtgacttggatcataacttaaggagttgtccacaaattgtgactattttaaaaatatttgtttttctcaaccatccacaaaaatattttcaacttgacctcaatcacaatatatggaaatcaccctcgaccaaaataatcttaattcaactttgactagagtacgtattttcaactgaatatcaaacaaattaattttaacttgattagtatctttatctaaatctcatttaggacatttttacctcgattatgaccccaaccaatacatttttaattaaacctcaattagagcactttgactcaacctcaatcaagatgtctttagcccaaccttttccaaggcaaagtgtggcattgtggccgaatggttgtagcaaaatggtccttatttgtagcaaaatcaactcgacctcaatcacaatatatggaaatcaccctcgaccaaaataatcttaattcaactttgactagagtacgtatcttcaactgaatctcaaacagattaattttaacttgattagtatctttatctaaacctcatgtaggacattttcaccttgatcatgaccccaaccaatacatttttaattgaaccccaattagaccactttgactcaacctcaatcaaggtgtctttagcccaaccttttccaaggcaaggtgtggtggcattgtggctgaatggttgtagcaaaatggtccttatttgagagccctaatttaagtttcctccctataatcatgaacttactatatctagttttcttttggtggttagtatttggtttggattaaaaaaaccacttagctaaattttggctctgaatttaaacttgtgtacttaccattgaatatgtgtatttagatatgtgtttggcctaaaaagaaagggataggaaaagaaagaggaggcaaatagaattgggaaaggcagggaaaaaaggagaaagaggttattggaaagtgaaagtggaagggaaaaaaaattagggattaaaataaaaactggaacatttagtaaaactataacttaaactgtgtaaaatgttgtgtcatgagtttgtggtcacatgatatgcaaagattgttaagttaattaatttatgacaagtatatcgaccatacaagtaatatattaacaagtacatatacatatagttctcacaaagactgttgcaatgtcttattctcaaaacatgtagatgtcccctatattgagcgttgagttcaacttatatagcagcgtaataaatttcaactccattaattaatgttaccaacacctactgcaacatattagaattttctcagcagtactctatgttgggatcaatgttttaagcattagccccaaagtatcaaatttgattatctaaccctaaaataatggtaaccctagctagttcctacatatcacaaaccctaggttagttgaccttacacacttgggttggctcaagcataaggcgatcgacaaaaaaaaaaaaagaagagttatttagaattaacatttatacaaaatttataattttataattagatggtctagtttaatggtaagttggtaattaaggtttgtttttcatcagtgaatgggctttgaacccgaaggaaatttacttttgttttttgtaacacctctattttttttaagacctctacattttttggccttcaaaattaattagtcatgaaattcaatttaattaataggctgtttattaatatatcaatcctcaccaaactacttcatcaattattgttattaattagtgtttttgttaaaaaaaatattattgttagttttaataaaacgccaccttaaatttgttttaagcctggaaatatattaggtcatccttagcttgttacacaattattagcacacttttccttttatcagtccattatgtagcacacttataaattggactttaacccaatatatattcatataacaatatagataataatatgaatgtctaaacaaaacatccatattatctatttaacctgctttataaaaataaatccaccagtcaaggacggattcaaattgagctttgtgaggatagctacaccgacaagtttttttatctgttttttttttaatataatgtatatgtataattacaaactatttctataatttaaaatgtaataaaagacaatgcataatataatttttttatattttattttatgtaactgagaggtatttgttatcggttgacactcagatcccataaaattcattcattttgggtaaagtaatatttgtagttatgagtgtttatgttcaagttataaatcaaactctaaaactcagttaattaaaagaccaaaatgtcaaactccttataccaataattttggtttttctcattcatttcaggagtgtactgaccatttgattgtaaaacagaactgtcaaggacttctgcgcgcagtaaatatgtttttgcaaaatatctacatttttttgccactaatgatgcatcagacaaaagcttaatttggcttttaacgtaaggatcgtgtggctctgttgctttgcgcagttaaaagtgaaacttaattaaaagcatccctagcttatctttctatgtgtgagtaaaagtcccaacaaaaatgtgacgaataagtaaacgctatcatacttgcatagttgcatagcagggatatgcagatggacgttgatgttattccacttaatataatgattggcttctcatactattgctattgaatatggaattcgcatgaacttaatctgtataaaaccaaaaaataaataaattacaaagactaggaatacttcacattttttactaaaagttttagtcactaaagacagtgtcgaatttttaaaaatttaagttgtagaagtaatatttgtacataaaaatatgtgaaatattataaactgatctatttaatggtatttgaaattatgagaagaatgtataataattttaaaatcttgtaggtatagatagctgcccaaaaagggacaacgtcgattcgtccctgctgagggcatgctgaagctaattaaggtcttgggttcattattcaatttttgttactgtaaccttattaattaatcttatactattaataagcatagtattatccaataatgtttactttcattaacaagaaacaaattcatatatcaaaaaaatgtgattatgtagatttaatttttacgcttaattcgatccccttgcattggtggtctctctcttccctcatcgcatgcgcttgacttcaaccagggtttaagcctttgatgttaaattttattaatgagtaatatgtaaatatttctgtaaacattttttaaactttaaggtctattttaatttcaataaactcttaggatataactcattttaaatatttgatatctttttctttaaatgagatctcaattttttataataattttattaaatatcttacaactataatgtttttttctatccaaattcatctaaacttttttttttctaaaaataaaacacatggtatgtttaaataatataaccacaaaaatgacacgtagaaagagataaaaaaaaaactagagtgttggaaagaaaccaattgcgtatctccaactttgtgtaagcagatgtcacaatcgactttgaggaatttacatggatgccaccaagggcaagaaactgttgagcgttctgggtcggagcaataaaacgttgggtatgcgtgtgtcgttttcctctgagagcgaccaatagaaaaagtgccgtcaagtcccatcaaggaactcttttctcttattggacctacctttttcttttcttttcctcgcccatcggatgccattcatccttcgttttcgtacactgaacactcgttttctgtccgtaggatcaacgtctttgcgtcactgcgtttatcttcctacttcaatttcaaaaaaaatatcattttggcttaagtttttcttttctctcagaagattttttttcttatatttcaaatcttatacaaatatatttcatctctgatttattagaagatatatttttatagtcattaattattaattactatcacttttgttttttttatatgatgatgcattacagaattatgttaggtcacgtgttgataattaatgtattatatcacatggaatttatgtgaggactgaaattaaaaaataataataaattaagaacgaaatgaaaaatatatatatatatatatatgagaatttatgaaattaattttttaagataaataagatatttaaactaattatatataggttgctctttgtttttaaatgtaaaataaaagaatttgagtatggaagtatttggtttaatttatttaaaaatatattttaatcaaatttttaaaagatttaaaaaagcaaatattttaagtcaattaacatatatttcattacatgttgatatgtcacaattaagaatagaatagaagtagacacaattttctaataatgacgtatgacttagccaacatcaaattattcaggcaaactcagactttttcaaaagtagattggacttcgacttcggtaaaaatctatttgattaaaaatgtcatccttttgagcctaataaatcggcctatttaaataaatataaattataataatttgtttagtattattattatattaaaattataatagatttatgctttatttagacaacttacaaaataggttttttaacaagttattttaaaggtgataaacttatattattgtggtagacttgtctcttataaaacttaattaacttatttttacctttatcttattgagtaacaacaactttgatttttgtataaattatagtttggttcacatcaaattttttttaataatttatgagtttgttgtctaatgtaaagagaagttagatatatataaaaatttgaatatgaaaaaagtcttttaagtaaattaacatgttaaattagacttttaaatagtccatattagacctaaaaataaatcatatatcaagtaataagtcatgttggatcaaatcttgagttttttaaatagacttaatttaatctatctaataaaaatcttattcgacctaacatattttcactcctagttataataagctaaaaattcatttaatatgaatttatgaaggtaatatgtaaaaaaaacatgagaatactttttaatcacatgttatattttaacttttttaaaaaagaagggcataaaatcaaaatataatttcaaaatatttatcaaaataaaataaaatcaaaatttattacatgattagatgtttttaatttttttaatcctttttagctgtgagtcttgttcgttgcaccttcgagcaagactagggccaaccctgttattaattataactcaaataatatacaaatatactaaataagaaatgtaaactaagaaacttaagaactaattaaattatactttaataaattgtgtcgttttatctttatttttttattgttatattgtcaataattataagaaatacgtgtnnnnnnnnnnataactcaaataatatacaaatatactaaataagaaatgtaaactaagaaacttgagaactaattaaattatgcttttaataatttgtgtcgttttatctttatttttttattgttatattgtcaataattataagaaatacgtgtgaaaataaaatcttgtttacacagggcagagagagattatataagtgtagattacactaagtcattgattattatgccnggaaaagtatttattaatctgtatatattctcaaagtatgtcttacatagggatgtttagttgaattagttaaataatgtgtataaattattataaacatcgagtaccttagtttaatttctacgataagaaaatgtcttacattaattttgatgtacatatattaatccacaaaaacaaatctattaattaaataattaatattaattcaaatgaggagtctctatgattatattagataattgatattaataaactaaaatttaatctaataactagataatattaatccaccaaatttcagcaaatcctacctaaattcaacgaagattagctcgtgtccaatagattgtgtatactagagagtagagaaggcaaaacacttagatttttttgttggttgggtaattttcagaattccaaaaatagacccaatacaattatttgttaataaactaattaatttatttgatttttcgttttaattagattgtttgaattttgaaccctcagtgatttaatttaagaataagtggaatgaaataaaatatatactcgagaaatcaccttaatatggttacatacatacgagactgctaaatttagaaatcacatgggttagttccatgccacattaggcttaagcctaataacttacaagtccacatctaattaaagataatttggttttgtaggtaaggtttagctagttattaattaattggagacaaatctggagaaaaaagaatttaatagtttggtaagagctaggatattgttgaatttgataaaactttcattggttatattttattctgtatggattggaattagtctttaacttcttcaatacttagctcaatagctggatttgtatgcgggttatacttcatgagttgatccatttaatccatagttcacgtgaatctgtccatttaaattcgactttataggattaagattttggtatgcagatgtgttaaacatttagagaaagaaccttgtcaactataatgatcttatctgattactttttatagataatacatattgtttagacaaaaataaataaattaataaacaaaaattaaaacttagttgaaagtgttttccaaacataaccttaatatctaaatatttttaaatagttaccaagaataattggctatataaagtacttacaaccaagtgctaatgcatattttgaaataataagagattaaaaaattatctacaaaataattacattgacatgcatttattttgagtgagcctcacagaatccctcgaagccaaacttaattacattaacatgcatctttttaccctaaagagtaaaataaggaaggctgttgttcttacaagtcatttggaatccctcacttagttctttttttaaggtgagctcctctgtttctatagtgtgtgaagatggtcctatcgtactacaaaggtcctatgtgtactaaggtggggaaggagtttttgcgatgccatgagaatcctttcgaagtaagggttgcgatccttgttgtaactgtcatattgggaatcttgtgtgtttatcgaattaccgagagtgatctaaggttattctttacggtgtgtgttcttaggattttgtttgcccttacactgaccaatcgaggttttgtccatcacaactatatatgttaggataaaagttgaaaaaaatacttttgtaaattctaatgcacaaatttgaatcataatatgcaaaatgaagaagaaagaatttgttgcttcatgagtaaaaatactttttgagttgtcaaactaaaattcaaacatgcacgaagtatttagatatgaataatcataccagaatgttatctaatatataaataaaaataatttttgagatgtccaactaaaatccaaatatgttcctatattgtattcacataatatattttttatgagtaagcacaccaggatgctattaacatatttttttattagttagttaaagttagttaaaaactataaaattacaaataaaaagtctaatctacacaaaatttaatttttttggtaaaatttaaaaaaataataaagtgttttttagaaaattttggttgagaattaatatatatttctccatactttgtatatcaaaggtgagcataagagttgttgaatcaagttatgtttgaccctaattcgtctttaaccctttgtttggatgccaaaaaataaggaaatcaaaggaaaaattttcaaaatttagtatagatcccacactctcattactctactttaagagaagaccaagttgacatgaactataagtaacacaagttcctgttattttaattggaatttcaagaataatttgtatctcatcattatacataatattatgtaaatttaatgatagttgcttataaaccatagaaaaaatgtttttggcatcagtatgaaaaaatatagacaaagtaaattaataggctagagtttttttttgtctagaaaaattctggggatggaatgataacttagtccaagataaagaaagtctctggattcagaaaacacttacagaattatttatatttattttatcccaaaaagataggtgagtatttgaatatatgatctgttagatgtgagactttgttttgcttcactctatcaaaccttgagattatagtttagaatttttcaacaaataaaaagaatagacggaaaaaatataataatgactaataaaattaggagttgagcaaataatagattaagccgagatatatttaattataactcgttcctaaagttttactggaccaatttttagattctaaccatttttaaacccgaataaattggataatctactattggattgtgttttgcacaatcctagtaaacattgctctttcggcttgatcgacataacggttaaaaagaagcagtaacattatagattatgtattcaatatttcccctatgttttttactttttactttttatcaccatatgttgcatgatattaatatattcatgggcagatctagcttatgatttcaggggacagggtctctccttaagtctttccaataaattttaatatacttttaacatttgtttctctttaaatctttccaataaattttaatatatttttaacatttatttgtaatatttgttaattatttttattgcttattatatagtttgcggtgttgttaattatttttatgcataattcataccttaacacttatttataagataattaaagtctttactcttctttgaaatgagaagtacagtttaatcatatgcattttataaaaatattttagcatatattacaataattaatgttgaaagatctcaaactcaatacttatatctaaactaattttcatattatcattataatcttttgaaatcttatcataaattacaataaatttctttaaatattctattcaatctaaaataataatttgatataattatttatttatttttttagattataatttataattatttattcttttaaattttctttataaaaaaaaatttcagaaatactagcccccaacccaccatcaaatcaaatgtacaaacaaataaattttcctaatcctatcaccaatgccccctgattatttttctaaatccgcgtgattatacttgagaaatgatcattttcatgaagcacagatgccttgacactttttgactttgttgcctattgcttattgggaatcgagagttcagtttgagtccccagttggaccagataattgtgcttgacagaaataaaaaaaaaataaaaccattacatctgcaaacatcccaattctacctttgcatgagtgcttctcgaacaagttgccttgcaatgatgctttaagatcctgaacatgctattgctagtttgctactacttccttatccttccatgcatgttaaatcacccccctagtggccagctacaagttttcttctcccttcataattaatactacattaatgccatcataaaaattaataatatcattcataatttcttttttgtttccatcggacctgaggccatattcatactgtgtttgatcttgactcaaaatgcttgattagtttgagttgcaagtattgaccaaaattcaataccttgatacatccattttaatatgtatttgtgtgattaataaattacatcttgattcagaattaaattacttttacttttggtgggagaattaaattactttattgttatacaaagataaaatatcactgttatttttggtgggggaattaagcaataccttcggtgtggcacataaaaacaattatttaattcattaacatcgataaaaataattatatttattgatttataataaattttaattttattttaagattatttatgatattaaataatttaaaataattttatgaaaaaaatataaatttataatttttttacattgtcatttactatgtatagtaacttatttgacaattatagtaataattatcttaacaattatacctaataatttatgtttagatgaaaatgacttaattattaatttgattctcaaattatttaaaaaaatacaatttgatttctaaattttaaaaaggtttaatttgatcatcaagttctcaaaaatgaattaatttgatctctgaattcgattattgaatttgaacaagattaaattgaatcattttaaataatatgaagatcaaattgatttatttttaaaaaaattgaagatcaaattgaaccttttaaaattttaaagactaaatttaacttttaaaaaattagagaacaaattgtcatttaaaataatttgagacaaacatgataattaaacatattataattttttttagaatgtcagtaaataattacttcattgttagcttaaacataaaaatatattttataattaaactcacttctcccaatgtctcaaccttgtgnttaatttatgacatcaatgaaaataccatgataaaagttgtttcgtaaagtcagtctataatagtttcttatactatgttttaagaccgataattataggaattagatgtacaaatcatttactccatttttgttttacacaacttaaacaatcttctgtaaagaaagtaacacacttataacctgagaaattaaagtgaaaatttactcttacagcattaatagtagtaatttttggttacattagaatcgattaattcagcaaatcagtaaccgtcattttcacattaaaaagggagaaaataattgcacgagggcagctgtagtaaaaatcactgatgtattttcacattaatttcttttccctcgttgattgtctgaaaccgtggacactcaaaaggtcatatcgcattcacatgatgtattaattaatatactaaattataaatactgtataaagcaaaaatgcgaaaaatagtgaaatgaaatgaaatcttctctctctctttctttctttctctccctagaaaagataaatcatcatctgacacagggacacactctctttctcctccttaaaaaacacccaaaaacaatggtggttctgtcttcattcgctcaagcatagaaagagaaaaagcaacagtagcacgaccatagtcgccgccgaaactgctacccattttccattattgttgcttagaaaaagaaaagaaaaaaaaacccgacccgttttcttttttttaaagaaaaaaaactctaaaggtgttgtatcacactgttttcttgtcccttccgtgaaaaaggaacacgtacctacgtttgtaaccgtggtcgttttccgttgcaacgtttgcttcggttttttgtgctgtggagtgagtgcttgtgctgattcccaagtccattttgcgcctttttcccggctttgcttgagatccggtaccctttgggatttgtagctcctttcgctgagatctgtttcgttttggagtttcttcgcttgtttgtcttttcacgttgttgccaaaatttgttggtgatatagaaaaagggtaaaaagaaggtgctggagcgtgttacttgctattggtggttcaagcgttgttgtatgatgaagtgttgggttgaagatttgaactctgggtggtgggggttgaggagggttagaagcgaatgaagggtaggagtagaacaattgtgttctgttgtgacactggtattggttgaggattgaaaagaaggtgggaattttctgagttccttagcttttctcgttgatggttgagggaatttggcatctggggtgtttgagttttgtttagaatcatttgggttttggttggtgaagggggggtaaaggtaaaagaagaatggtattgtggagtagggaggaagagaagaaagggattgttgtttggtttggggtggaagttgggggaattctgttgctgctaaattggtctacttaagagtttgcttgaatcattgattttggggctgggtttaaggtttgaaattgctgaaactttgcttagatgaaactttcttcagcgggttttagtcctccaccccaggaaggtatgtgtactcttgtttgcatattcttcttccatttcctctccctttttattctccatttctatttttggggaactagttatttcatcctcagtcctatgggatatgtactcccgtggttttttttttttgaggttgggatgtggaatttgacctcttgtggctacagtttctgttctctctcatgtagctcagagatcagaaaaggaatttggttaaatttgctgagcaccctcctctttcctttgttgttttgagatcttggctctgccataatcattttgtcctctgaggcatttaagggggcagttatgagctttctattgcatattcatgacattgggatggggttttgcaggagaaaagcgagtcctagattcagaactttggcatgcttgtgctggtcctcttgtttctttaccagctgttggaagccgagtggtatactttccacaaggtcacagtgaacaggtaagttagattatagcttccagagagaaatccttgtggtagctatctggattttcttttactatagtatgtgtaaattgtaaagtaataaaacgaatcttcaaatcctggacctgaagatgctgttttggttacttgccttctatattgtgacatgaattggttcttagccatgcctctttggtctctaatgtaagggtgggttacatctacactcttataacaaaaactggctttgttctttcactatgttgacccttgtgtatagcttacctcacttttaagcacaattcattagtcttaaactgttgcagtttaatgaatttgctcttagaagttagaaataaaatatctccacctaccaccctgaaaccagcacctgaactttttacattttataacatatattctttttctgcataagctacatgcatatgcataaggtaatcagcatttttcttcttaggttgctgtgtctaccaacagggaagtggatggccatatacctaactatccaagcttaccaccgcagcttatttgtcaacttcataatgtgactatgcatgtaaggctggtttatttatttattcttttttacaaaaataagcttgtttattttggtttccttctttcaaattctcgcatatgctgatttctgcactctctttttctttaactatttgttcatttcttttggattcaggcagatactgagacagatgaagtgtatgctcagatgaccttgcaacctcttaatcctgtatgattccctttcttaactgataactagttgtttgagttttatgtttatattctaatatcaacttttggctatgcctgtgttttcagcaagagcagaaggaggcataccttccagctgagttgggcaccccaagtaaacagccaacaaactacttctgcaaaattttgacagccagtgacactagcactcatgggggattctctgttcctcgcagggcagctgaaaaagtttttcctccattggtaaagtattgttatattgtcatgctctaaaattttttgacttgttttcattaaatttatgaatttctttaacttcatgattgtgacctacaggacttttcacaacagcctccttgtcaagagttaattgcaagggatttgcatggtaatgagtggaaatttagacatatcttccgtggtgagtcataaagctctttttaattgcaaatgtagtatttgttttttattttttagttaattaatttatttttacttcagtacatttctaactgggtgctgaaaataagttcactttccatttacaatgtttgagtttggtgttttttttctttttttttctgtaggccagcccaaaaggcatctacttacaacaggatggagtgtctttgtgagtgctaaaagacttgttgccggtgattcagtgctgtttatctggtaagtaattttctgctcctctctttccaagtttttcatcgtgtatattgaaattggcctttggcagttatgtgactaactgactgacttgtctccctaaatcaagccatgtgatttttatgtcttttggccattcagaagaatataggggaatgtttttattgacatgtttcatgtattgtaatatttttatcagtttatattttgaggcagggatccatattgggctgctattgaagtatggtcttcctgtttattgtgatttcttgatggttcaggcttcctgtttattttgatgtccagatggttcaggctttatgagagttgttgtttcttatttctcctagctacttgcttttccatatagactttgatgatattatgttgagcatagttactttcattattaattatctaataactggtctaataaaaatgtattttattcaacaggaatgaaaagaatcaattgcttcttggcattcggcgggctaatcgacctcaaccagtgatgccttcatcagtgttgtcaagtgatagcatgcacttggggcttcttgctgctgcagctcatgcagctgcaactaatagtcgttttaccatcttttataacccacggtacaactgcatacattagtatagtttcaagttatatgatatattgcttaaattgacaaccttttttttccaattcagtactagcccatcagaatttgtcataccttttgcaaagtatgttaaagctgtgtatcatactcgagtttcagttggtatgcgcttcagaatgctgtttgaaacagaggaatccagtgtgcgtcggtaggtttttgaaacttgttgaaaatgatagtggaaatgctttcctttatattctggacattttggtaaattgagtctatatgcaatatgattttaaaaaatcaaacatggcttaaatttcaaaattaatataggccatagcctacatctgtagaagaattctgggtttgtgtggaatatgagtgattgctgtgattttcttgtgaggtgcttttaatctcatgttgttatgcatggtatatttggggaccaaacatgctaggaggctaggagccgtggaaaacattaatctggtcattatgcacttgtgtgataaatattaaattaattaatttcattttgtgcttatcttgataaacaaatgcaactttattctaagtgttacaacatgtataatgtttgactctaaaaataagaggatattcatatcttgtgtcccgtggcatatcaaatataggtgcatggcatcataaagtacgattgtttatcagtacttaaattcaatgcaacatatacatttttaattaatttgtcttgacatgttacaaatcaattgcctgagtaccactttgccttttatttattttttaatgatggtctgtaatttgttgcaatgagatgaactggagacattaatttgaatgtattattattctgatcctcaataatgctgtagcatatcaactaatgctcagtcagtttgtagagttggtgatacatgtttgttctgctaatttgtttatgtatatactcatgcagatacatgggcacaataactggcattagtgacttggattctgtccggtggccaaattcacattggcactcagtcaaggtttgtttgtaaacatttatgatatctcattgatgttatataatttatattgaatgttaattgtatcttcagaagtaatattagtaatatctttcttgggaaacattttgtctcattaaggattgaggaaggattttaaaaatggcatttatttgagttgtaggttggctgggatgaatccacagcaggagagaggcaacctcgagtgtctttatgggaaattgagccattaacaacatttccaatgtatccatctccattcccccttaggcttaagagaccatggcctccaggactgtcttcattccatggtatgcttgttaccacacgtgagctgaaaatattcatgagaattcagttttacatttttaagtcaatttcatttatgcatcaatggaaactcattctcattgtctatcccctgtggattgtagcaggcttgaaggatgatgattttggtataaattcttcactaatgtggcttcgagacacagacagaggtcttccatctcttaattttcaggggattggtgctagtccttggatgcagccaaggcttgatccatcaatggtgaattatcaatcagatatgtaccaagctatggctgccgctgcacttcaggatatgtggacttcagatctttccaaacagcatcctacgtcctcgattcaatttcagcaaccgcagaacttccccaacaggacttctgccttaatgcaaactcaaatgttgcagcagtctcaacctcagcaggcttttccagatagtcaagaaaatccacatccatctccatctccatctcaatctcaggctcaaactcaaacaaactttcggcagcatctacagcatcagcacttattcaataatcagaatcagcatcatcttctgcagcggcagcaacaatcgcaattgcaacagcaacaagtggtagatcatcagcagatttcaagtgccgtctctacaatgtctcagtttgtttcagcacctcagtctcaatcactacccatgcaagctatctcttcacttggccatcagcaaagcttttctgattcaaatgggaaccctgtgactactgctattgtttctcccctgcatagtatattgggttcatttccccaggatgacacatctcaccttctcaacctttctagatccacctcttgggttcctgttcaacatttaactgcatggccgccctctaagcgtgttgcggtggaccctctcctttcttctggagcatctcaatgtgttcttcctcaagtggagcagttagggcagccacagagtaccatgggtcaaagtggcattgcattgccaccctttcctggtagggagtgtacaatagaaggaagcaatgatccacaaaatcatcttttgtttggtgtcaatatagagccctcatcactcctaatgcataatgggatgtcaagtcttaagggaattaatggcaacagtgactcacccaccataccttttcaatcgtctaattacctgaacaccacagtacctgattcttcattgaatcctggaatgacacacaatattggtgaatcgggcttcttgcaaactccagaaaatgggggacaaggaaacccatctaacaaaacctttgtgaaggtgagcttatccagtgggagtattctctttcaaattaagcatttttagttttttctcattactatgtcgtgattgattcacaataaaatttgacgtgttcaaaagtcttgcattttcatgtgatgtttttttttaacaggtttacaagtcagggtccttcggaagatccttggacatcactaaattcaccagctaccctgagctacgcagtgagcttgctcgaatgtttggcctggaaggtgagttggaggaccctgtgagatcaggctggcagcttgtattcgttgaccaagagaatgacgttcttctccttggtgatggcccatggccgtaagtattctttgttccttttctttctaaatgaaattccatgccacttcagaataactgggttacatattcttcgttgtgtaccgtgagttcttatccttatggttcacagcttgtatattctggatttcatttctgccaatagtttttgttagagcaaatgaccaattgatcaggcttcttttcttacgtctttcattccatatctttggtgtgacagggaatttgtaaatagtgtagggtgcatcaagatactttcccctcaggaagtgcagcaaatgggtaacaatggtcttgagcttcttaacttggtccccattcagaggctctctaacggcatctgtgacgactatgcaggtcgggaggacccaagaaatttaagcactgggataacaactgtggggtctttaaactactgaatgatgtaacaatcaatactatgaatctctctctctcttgtattattacttctacttctccaccctttgtcaatggtgggaagtattgcttagttgtagttaataggctacttattagccttttgttttttgtctgttttcctgttttttgctgcctaggaccattcataagataaacaatgtaaccatatggcatcttgtcaatgtgctatctacaatatattgattacttaatctgttaggagttcaatgcccgaagagtgaagatagctctctctccctatccatggttatattgttactttattttaagcttggccataagatcattgggggtatgtatttgaccaagagtatacttagcaattgaattcattggtagagtgtctttcatgcatggagataaagttgatgataaaatccaatgggtgttgttcagttaacaactcacaatctccacaacatacactctttggcattggtgagagttttaagtataattaagttgtgattgataattagttttatagtcagtctaaagactcaaagtttgtgaaaatattttgagaaattgttatggagtctaaagttctaattaccgtgttattaaaagaaaaataaagtggatgataatacaagaaaattgcattgtaggacttacttgagctttttgataactaagcattttgggaaagattgatgtgacacctagaacatgatgaggacaccaaaaccatgtgatgtgtctctcttaacataacaggacggtgaacagatcactttgtgcttccattaatgtgaaagtggcctgttttgtattcttcttggttttggccatgcaccttttcactttaacttgtgatggatttgcttcatgaatggcaaagatgaaagatgtacatttgtacatttggatcttgttcattccttcacattctaatactaagtatttggaatcttaaacctaaaagcatccgaattccgtgccacctctaaggtatcctttcttgggaggttgacaatttgtttcttaatgatggtagttggctcatggctggcttcaaaatcacttacgtaactttgagggacaggaacggtgctaattgaaacagctaaggtgaactcaataaaatcttcacctagaaagtatagttttggttatgataatatatcatgttcagattccccaacacaatagcttaactgatatgaggaggcagaagagaaaggtaatatgcacatattgacaccattttgagaaagttgtatgctagttattaaatagtattacatacataataataaatattaaatgtagtggttggttataaacaaacacctaatccctaataatttgttaaaagtgacttggcctgtaaaaaaaaaatgcattgtcgtttattatgcgaggagaaatattaaattcaccttaaaatttaagaagcaattttgtcatccttataatttattatcctttaataacatgtgagagtgttgtacacaaatttaggataaatatttattttcatccttgaatttattaggtgttgatagttaggtccatgaaagatgaaaatttaaaaggttaaatgatcattttcgtccttgaatgtatataacattgacaaatttgtttctaaaagatgaaaattcaaattttaatatccagaaagtaataaaagtgcgacaaatctattcatccgttaacttttatttgctaacgttaatgaaagagctacgtgacacattcaatgacgaatttgtcagcgttctacacatctagagacgaaaatgtctatttatccaaaatataatttaattttcatttttcccttttctaatcattgtaaacataacaaataacaataaacacttaaaaaaataggaaaacaaacataagttagaacaaacacaataataaacataatattgattaataagaattatgtgcctattgttctgaaattttatattgtgacaatattaagtagtgacaaaatcaaattgaatctcaatttaaaaaaaaattaataactatacatttttatttgaatctcaatcatttgtaccaaatattaagttcatcgtggcacacgatcttaaacaaattaaacggctctgaatacttaaaacattcggaataccatgaagacacatttttctcctttctcctgacttgtgtttgtggtaggaagcatataaaaataatccagacatgctgctattttttttttgataaaaaactcaattgcggcacatagaatcctctccgacagtactgtttggcaaacatctttggtttcgaatctcactcgaaaatcaattatggtaagtagacttcatttagagaaaagcgaaaatattacacatctatattcacactaaaaaataaaaactgattctactttattactaaaattaaccttttaactcgtttttaaaacgtcctttctgaagaatacaaaccatggccatttttataattttaattcttttaacattaattctttcatattctattgaattataaaacaagcgcactctaaacgaacgaactaattagtttaatttgtaaagttggaaaagttatagttggatcgcatggcaataatagttatcaggatggcgttagcaattattcctggggtcacatataaagaaaaaatatccgagtgaaacacaaaaaagaaataattatagataaataattaaattttaaaagatgatgtaagcaaaatgttgttttattaaaaaaaagaaaatcataataattttttcctacaagaatacttttttaggaggtacgaagataatgctatcccaatatttttgaatacaacgatctatcttttcgtttcttagaataagtcataataaaggaaaatgtttttcatacaatagaaatggaataactattgtattttttgttattttaaggaaatatttataaagcttgttgttgcgtcaaaaacttgacgtgtaactcacgataagtgtgtactaatgttcaagtagtaacatgataaatagagtatcgttttcacgatgattgagacactaattttattgtaattattatttttaaattggaaagaataaaaataaagtaatttgtgatttgtgttgtgaattgaaggaattaaaataatagaattaaattacaattaaaagtaaagataagattgatgatgatttcagaatttatgaagaagaattgtggtgaaagcgcaatcacctctattccctactcatgtaattgaatggataattaatcgctttcagaaactaaaaccccaatatctctattgtgaattctagccctgagaactcttaatagattgataagtctatcaatgacaatcagaattaaataacaagataaagtgaaacaattataaaaagcttcattaatatcaattcaatccacacaagagttcacattgacttatggcctcaccacaatcaaagaagaattagccagacatagttatgtctgactcaatacaatgatgataaagaagatgagaaaaaaatacaaagaaaaagagtaatcaaacccctcgatcctgaccttcttcttgatcttcctaatttcttgatttccttcaatgcctcctttttatgtttttgcctgtgtttctgtgtgtttcctattactttcctatttatagtcaagtttgtaaaatcctaatatcttttattcttatcctatctgtaagctgattttgaatttccagaattgcttggctctttattttgtttcttttcttctatttcctgctcttagacattaaaataacaataattaataataaaattaatgataaaacaatttatatctattttaagtctttatttgatattttatgtttaatttcttaattattttatcctaaaaactacatttgctagcatcatatcacttgtacattaaaaaaaaagaaaaaaaagtgaaaaaaaaacaataactatatacagtttaaaaacctaccaattactttatgtttaaaaaattataaaacgcatgtattcgatcttatgattcattttatcaatttaaactgttaatagtagttaacagtaatcagtcgtagaaagtaaattataattttagataaactttagttatgatattatgattcggttacggaaagtatgacgactctaaaacactcttatactaaaaatatagccagtcaaaaagctcaaatctaggatttttgtcctgcatgagaactagctaaggcaaacaaggtgtccttttaagctgtggcactatagctatcgatgcactgggattgggtggataaagttggacttgtgagtgttggtttaattgagcaatttttagatgcatgttgtggggttgcctaatttatgacctttttttttctgggtatggaatggtgacaaggtaagacactatccaccataataataccaatgagaataggtagggttggcaatccaacaaccctagcccacctttattgttgatcataacttacactctatcttaaatctcacgactttcttatctctctcttccatttttcttgagtactctagtttatggcatttctccatcacccacgacatgatcaaaaaggttgtagcaaactggcaaccttgtataagaagtgcatggatgtgtcgttagttgtttccaccataattgatttataataatatacagcgagggtacgtatcaaattactctcttggtaaaattattctctttcaaaactttagttacatatttaattttcttgatccaatgttaaatttatagttttggttaagtgatcaagtctaggaatttttatacatttttaaaattatttgatacttcgctaaataaatttaatttaacatgcaatatatttttaaaaaatatataagtaaatattgactataagattatgtaactataaaagtctgattatctaaataaaaattagttttcataaaatcacgatcattaaattatcaatatcaaaatatttaattaaaatttaatatattatataactgtacatgtttgatttatctaaaatttagtgtgtatgattgttgaattaatatcaaaatattcaatacttagattaataaattttaatgaatacaaagagtaattgaagtgagtaattttattaaaaaaatattcttagactaaattaaccccttctcatcatatatgtacatataaactttttttattatgagaaatgaaaactaaatatttgagtcatgtaattatatacaaataatgaagcttaaaacttaataaaagtcacatgaccactcttaaaaaaagtcatgtacattttttcttaatcttaatcattcaattataatctaatgatctgtatttgtagtactcatttctcacattaaaataaaataattttgatttgaaatttaaggattttgattattttacacacctttatctgagatggtcactactagaaaataagcttttaacatcgccctcttaacatcggttatgaagaaaaccgatgttacaaaatacgcgatggcatttttgtaaataaaatgccatcgttaacatcggttttttctaaaaccgatgttaacataacaattttaacatcggttattttaaaaccgatgttggctaagcaatcaagatgattataacatcggttatttaaaagaccgatgttgtctaaacacttacaacatcggttatttaaaaaccaaaataaccgatgttgtctaaatactcacaacaccggtttttaaaaagaaccgacgttgttgttattattcacgcgtgcgcttttagagtactgccctcaccttttgtcttcccgaacattcactcactttcttattgttaagtttttcctcctctctctctgctcccccatttctatttttccattcatcatcatgtatgttttctctcttggtttttctctttatttatttttccactttcatttttttattttccaattttgtggatttattannnnnnnnnnagtttgcgtcttttgctcttcgaatctggttttgccttttggaagtaaaggatgcatttttttccttttaaggttgagttgtttattagagtttggatatttgtatttggccttttggaagtaaaagatacatcttatttatttaggtttgttttaagtttcaatgtaggtctgtgcccacgtccaaactgaaggtgcaatggtgcttttagaagatcctaaaatttggtgggttcatgtgcgaggaagccatctatattctggtactgattgnnnnnnnnnncctccgtcagccacagaatcgccgcaaactctcttcgatctcttcaccttcctcttgaatccactgatgcccctctatgcgttgtcgctacttcctctcaccaaacccttcactctctcgccgtcaatcatagatctctctggtgttttgagttcgagaaggtgtgacttgataatttctactcgtgtttgttggtgacgtcgagcgtgtggagcatcattggaaacagcacagcctctgcgatgacaatctcgaagggctttcattggaacagaattctgtagtttgcgtcttttgctcttcgaatctggttttgccttttggaagtaaaggatgcatttttttccttttaaggttgagttgtttattagagtttggatatttgtatttggccttttggaagtaaaagatacatcttatttatttaggtttgttttaagtttcaatgtaggtctgtgcccacgtccaaactgaaggtgcaatggtgcttttagaagatcctaaaatttggtgggttcatgtgcgaggaagccatctatattctggtactgattgcgttattttaacttgttgtgctttgttcatttgctttcatctagatgaaggatggaaaggatggtgctagttcgatgggttcttgaaagacgttattcagatggtgaagcctgcgaagggtactaatactcttgcttttatatttaaggagggtgttatggtagctgctgattctcgagctagcatgggaggatacatatgtcagtgtttgttagattttaatttcatttttcattgttttttgttcctttggctgaggcagagtttttctttttttgtgctaattgctgcaaattaaatgatgggttttatctatttacattgtgtttgatcttgaattctgactgttggccttctccagcatcgcagtctgtgaagaaaattatcgaaatcaatccatatatgcttgggacaatggttggtggtgctgctgattgtcagttttggcacaggaatcttgggattaaggtaatatatgcaaccttgaacctacagtctcctgccaaattgctgcgatagtctcccacaccttgtcattccttgcaattattattattgaatattgatgttgttttagttgagttggtaagatttacctctttgaagtacatttatactcattgcctaaaaattatttgtccataggcaacatcttagcctgtgttttggaagcaaataaggagtgaaagagagtgaatggaatggaaattgaactatgggagagtagtctggtgtcttgtttggattgccatgtaaatggtgggaatgaaaatgataaggaaaataattatgttttgcttgggaaaaatgaaataagttgtgaagaagactatgataattaaaatccagatatatcctttatttaagatgaatttgttgagaaggatggttatgcaattcagaatttcagatataatctctttcccatgtataaagtgtggagaattttacatctaattttcatttacttagtattctttctacctatatccaattaattttttctaatttataatataaccttccattatttttccattgataacatctagattggtgctaggaatgccatttaattgccatttgttgttggataggttgcttttgaatgtactaggtttcattctgtcatttttattctacctggtataagcattccagattatggatacgtagtttgggtcatagtgtcgtttgcatgaattggcaaataaaaggagaatttcagttacaggagcctcaaagctacttgccaatattttatagtcttatcgtggaatggggttatctgttggtaccatgattgttggatgggatgaaacggtaattcacacgacaaagtgctaaacaactttttctcagctagtgcaattcttacttacaacatttaatctcttttttagggccctggtctatattatgttgatagtgaaggaggaagactcaaaggcactagattcttggttggatctggttcaccatatgcttatggtgtatgggacagcgggttagttaaactttttaaattgccacaatttcagtccactgttgtttggtttaaatattgaaagtggcttcttttgctaggtcttttgtcacttaaatcaatttatagccccatggttaggtgcctcataccttgtgttagtgctgcattgcttgatcaatattttcccttttattggctaaaccctgacgtgaaagttggttggcttagatgataatatactataaaatgtgctgcttaaaatagagtaatatatgcttacaataaattaattatttaatatgcttaaataatgaaataaatttattattattattcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattattattcggtaatatacattagtattccaaaatgtttccattcttttttctatattagataggtttcaatgtttataatgtcatttaaaaatttattcaataataattcttggtaattttttttttttacatttagattcatggtcaaatatttgttttgaacgaattcaattatatttaatttttgaagaaaaaaaatctgattattaagtgtatttgacatcaaatttatctttattaattggcaattataaaattaaaaatttaaaatttgttgtaataaattgaacttaataaattttcatattatctatacttagatattttttattgttatatataactgaaaccaaattaaatttttactttttctttaattctaatatgtactaattattagatttaaaatgaatttaaattttatattacacacacacgtttaaactttaaagtattattatgattttttaaaatatttttatgaaaatagactagtataaaaaagaatacaatttaaaatctaattggtttgaaataaaaaaagacaatttatgtctttgttgaatcaaacaatcgagtgagattataaaataaataaaattaaaattggtactttaggcctagtaaatatttggcttaagctttataggcagtattatggtcgtggagcttagcctccacacacacacacacaagtggataccaatccagctctacctatggaattatttgagcaatgtaagcctcttgacatagtttttcttaaactattgatgtagtgaaaaagtactatacagtgtacatttgatttagccatgagattcttgtgagacggttcagtagaaatggttaggttttaaatattatttacatgtaaaataaattttaaatttagaacagtggaagtgaaagatggaggaaaatggttaggttttttttttttcatttttaatactctatatttatacccttttcaatgctccataacgaagaaatggcttccattcattatcagtnnnnnnnnnnaatgaaattcacatgtcatttataaagtatattatatttattatgttctcatcttccacacattgaagttgtatacattgagatcatggggttatagagtatgactgggagtaataaagagaataggtctttttttttaaaaatgacattttaaatcggttatttaataaacaatgtagaaagggaaaatataacatcggtttctaggaaaaaatcgatgtaaaaaaggaactttctacatcggttcttccaagaaccgatgtaaaattacacacaacaacatcgatttttacaaaaaccgatgttgatatgtaaattcaacatcggtttttatgaaaaaccgatgttgttatgtaaatttaacatcggtttttataaaaaaccgatgttgaatttgcatagtttatatttttttcgttaatttcttattatttgacatcggttttttaagaaaaccgatgttgtatagttatgttaacatcggttttcaagaaccgatgttaacgttgatattttcaacatcgctggtttcaacatcggttaaaaaccgatgttaaatgtccaatataaccgatgtggaaagcgatttttctagtagtgggtggggaattatagcacaacattacttaaggacgcatagttaaactttttaccgggggttactggaacatggtcagggtcattaaaggtgttgaatgacattttggtatgcagttatttggtctatatggtcgggctataactgtttgatttttacaacaaatattacagatgaggaataacgtctaattgaaaacatcaaaatgtatttttttttttgaaatggaaccaggttaaaagagcttcacttttcctctttcgggttggatgatgaacgccgtgttgtgtttacagtaaggtcaactaaggtttttccttatgtctattaatagaaaattaattgatattaaatatatatatatatatatatatttagggacacataacagtcactaattgaataaattaaacggtaaggattgcatctatgaaattttaaaaattcatgtcacccaacaacccatgtattcttatatatgagtgtgcaataagttactaacagtaattataaaagaattagaaattaaaattttctcttaaaaaattctttactaattcattattaatgttttctctcttcttattctcttatttctcttattttttaagacttgaagtgaattgcataatggataacatatgatatatcaaattactcagtcgctttgttttcaaagttgataacatatttctttccttattccctttatctatcaacattaatttttcatttataacaagaaataattgctcagaatccctttgtttccattcttttatgttctttgcttttcattgactaaatgaattaaatgttataggtgacaataaaaaaggttagccgacatatttgaagagccttaagttgaaaagttaaaatggcttgagaagtgaagcgaaactgcaacaaataacatacaaatcatttgtcacagtttctattcgctttgcgtaagacatatgttaactttcaacttaacactcttcatatatgaattaaatgttaacttcctttgttggcttaccttttttgatgtattcaaaatttgccacttgaacgtttaattcatttattaaatgaaaagtaaagatcatgaaagaatcggaacaaagcgaatctaagcaattgtttattgttataaaagaaaaacttatgttgataaataaaaggaagaaggaagacaataacggagattgaattcacataactttttccttaagcccaaagtatgtaatagtgcaatcaagaacaatgttgcaccaagaaataatttcgatgtcataggaattcttcctccattgttgttcacaataaaccgaacaaacatgtgtcatgcaaatggtgaatagacgaaaaataaagaagaaaaggctgagcgaaaaaaaaaaaataggaagatggtgaacaaatgaaaaagaaagaagagaacatgagaaaaacatactgagaatttttttttcaaatgaaaaagaaagaggaaaagattgtgaggaaaaaaaaatgcagagcgatggtggacaaatgaaaaagaaagatgttgcgtgatcatgtgatgcacgtatagaggatggggctatttattttattgccaagacgtatcctctgaatgtgatggcggcgtcactttatttacacttttcaattgtaaccttacatttagggttttacatattaaattggtagggcctctaaggtcattttattttattttttattttgagctcctaagcttgttattgtaaccttgcaattccatgtttcacttgagaacattgaccatggtaatattagatgaaaaatgactttctatcactaattcatacctaatcattatgttaaaataaaatgttatatatatatatatatgatttttttataatattttgtttaagatttgtcagtttatatttatttttttaagaaaatgtataaacagattcatgtagtttaacttgtgatccatcatttactatcctaactcctaatggcatctttaatcggagatgcttcatggatttcttagcctaaggaacgattttttttagttcttcgacattggaataagtgatgtggtaaaactaatttcttcaacgaacgataaattccttatataaagaatcatttcttaccaataaaaaaatattattttcataaaatccgtactcctcaaccacaagaacaaaaaaagtgatgaaccaaagaaagaagatgaacaattttaacaaaacaaattaaacagatgaagcaaagaaagaagatgaacagttccaacaaatcaaattaaacaaatgaacaaatgcatagatgaagtttcacaataaaaaattacaatttttccaaacaaatcaaatcacccaatgcaatatcaactcagaataaaatacaaaccaaattaaagagtaccaacactgatcgtgaacagagtatgaatagtaaccgtgactccaacgacatcgttctgaccaacttcgaacatcgtgggttgcgtatgtcaggtcatgggttgggtggtgttgcacatgactagtgttagggtctaggttgggtggtggcgtgattaggggacgtgacagtgttggaggacgaggtggattggctcaataagaggtttgaggaaaatgaagagatgatagggtggggtgacactagaagtttgaggacagggtgggtagggatggttctggagcaaagagagaaagagacaaaaggtcgatgcatataggtgggaagggtttggagaaatagtttttctaagaaagaaaagagaacgagtagtggagaatgatataaaacatttatcacaattgtgattagagagagttggagatattaaagttgtgagacaatttgtttatcgttacatactattcactttaaattttggatcttgttgatgtagttttgcacataatatttctacttttattttttctcttatttttattaagtctcatttttttttattctctttaaaatggaccctagttagtatttttaattaatatttaaaattctcttcaattatttatatttattatttgcatacataaaaattgaaaaataaacaaattattttatttgaataataattaaattataataaaaatataaatgtgtgaattttttgaaatttcttctgatttcttaacattgaagtaaaattttgtatgaatttcttagtaggtatcacaaaaaatattacaaagatcataaaaacataattaaaaaatccatcaaggttagaaatactctaagttccaatcggactcgtcaaccaatctagttctaataatactggatcttcctattagtcctccattgacaaatagcaacgctgcgaggaacataattttattttttgtataaaaagaatacgtttaattcaaaaaagaaggaaatcagtttcacatttgggccattggaagagggccacgatattttgggctcaggggcccaacccaaaccgggtacccgattgatagactagggtttatgtcagagaaattgggacaccatcgtctacatattgaagaggcgcccaagcaagttagttctttagccgtcttcgctcacaactcgcaaaccacaatggtaactgctatttcgttttctacgtctttgatttgatttatacgatgtttatttgttcgtgtcgaatacgatgtttatttgttcgtgtcgaatacgatgaataatgttctgagttttgtgtgtttgtgcacgacacaatacagcctaagcagatccacgagattaaggatttccttctgacggcgcggaggaaggatgcgaggtcggtgaaaatcaagaggagcagggatgtcgttaagtttaaggttcgatgctccaagtacttgtacacgctttgtgtctttgaccctgagaaagccgataaattgaagcaatctcttcctcccggttagttattattactgttccttttaacactatcgtatctatatgtatctgggattatgaatttgtgttatgggatgcatgccatttgttgtttgcaggtttgagtgttcaagacctgtagaggtgctgagtgcggcagcgtgtgtttgtttatctttttgttacctgatgctctagattttgtggcttgcttttatattttggtaattgttatgaggctatgcttattttccatttgccatgaaaatgtgaaagttttattttgagcacaatttaattgaattacccataattttgtggtttattttatttattatgattgagtactgtggttagccctttgcctagaacaagaggatttcaaatcggcaatttggcttaaagagtcattcaattttattgttctagcgatactaactaggttcgactcgcatggaattgtataatgttgcgcataattttcagtctgtggccgagtgaatgcttctataaatccaattgtgcccgaaacggctatatgtttaactgctgaaattccactactgcacgaactcaatatcgcgtgttggggttagttttatggtaaaattttaatgttaaaggtatagccacaagtcgttctatattttcatggtatcaccatgatttcatggtacccataaactctttgcatcaaagaaatccagacttggtcatcactgctgtaaaaatgtaggcacagtcttctcgtaccttattctcatttaaacacgtgtagcataaattctcgtattataacaattgcgtagctaactcaatacctcagctcgatactttttcgctagtaagctactcaactcattggggaggtgtcgacatctaacaatcttttttacttaggtagagttgtttctgctagctgagtttgatattggtgatttggtaattttagtctttcttgagtttatgttaatttgattagctgccacaattcaaattgtgttatgtaattgggagcgatttcattactgttgttggttgatccgatttcattagataacaaaggaagctgcccttagatatgagagaatttaagagtaaatattctgctaagtcaagcaaccaaatgatatatctcgatgttagttttactagctcgatcaattcatggtcaagttagatcaataatagttctaaattgctcatcgtagtgtatgttaaattgatcctcattttgaaattttaacatgaccttgattcgtgaaacctattcctatctctctttttctaccgcttcgattaaactgtgtgaaccaaaccctccggtttctcttatcaattaagtcatgctggaaaaaaaattgaatatatggtgaatgtaagttgttaggatcataaataagttccagaaaaggaggggggatctaactcacttgttttttattcctacaaataaaaaaaaaggcttaattatatatttaatttattaattataatttaaagtttaatttagttcttgatttattaaaatgtttaattaggttccttaattatttaaaatacaataattaaccctttccatccaatgataattgatcatgttaagtggtgatttataacccctggtttaattattataattctaagataatcataaaattatccccaaatcaatttcaattataacaatatccaccccaaatcaacacaatcaaaatcctcccatcccaaattaacacaatcataacctaataacccccaaatcagcataattagaacacaattagaataaaaattgaaaaaaaaataaaatagatatagatttggcccatggtatgttcctcgttgatggatgctcgtcgttgtcatctctaacgttgaagctctgactctgagcgctgcctctcttgtcgatgttttcactatcagagccgctttcggatttgggtgcgaaggttgtggtgttgtgggggttgcaatgcacaggcaatgcttgtcatgggtggatgtggaggttagtgggtaacgtgggtggtggggtggaggttggtgatgtcgtaggtggcaatgtgcagttggtggtgggtgccgatcaatttgagttcatggaggttggtggtggcttgttgtgtggcatagttagaggaaggggttgcaggttggtgcaaatatgatgtttgagaaaggaaggattagaggaatagttagagaaagggaaggaagaggatgctagtcaatttcattagtcaatgtgataaaattgatggaaagggtataattgttgtgttttcaataattaagggacttgattgaacatttaataattgagagattaaattgaacttaaattataattaagagactaaatgtataattaaatcatgaactgcgttgattagaaaattattaaatgatgtgttgattgacaattattaactctacactttaccttaaagtgtaccttactctagaagagtcagtcctctcgtgaatctttgattaaatgtgcatatttggttttactttttttaagaaataattaaatttaatggattttaagagacttttaaaaataataatttctcaaccactttatcatgcactaaaattatacaatgcgatcatagtcattgttgtggttcaattgttcaaaccaaactcatggtagatccgaaatcatgccactttacgaaattgatctggtcaagtttatgaacttgataatttgacaatgatttttaaccactaaattggccctgaatcgatgaaactagaccgatttattacataaacggtttgggttaatttaagaaaaagaaaagtcccaatctagctgattggagactaaactaagtatcgaggattcaataaacatgcatcaagttatttgtttatttggaatggcgttaggaatatcttctatttgacaacaagaaactctaattctttttatacaaaagaatcaccaaaatagatagtctctctcccaataaaatattttcttataccaaaccgggatcaaatctcacttagcagcttaagaaacattcatataccaactatgggggatgagatctaaaccaattgagagtctcacctctcaatgttcaaggaatagttcaacatacatttggtttagaaagacatcaagtgcttacgaagaactgtctctagtaatagtataaggctctatatgttctattcgtaatttccactacaactatatgctccgcgaaaagatgctagaaatgcataaacaccgattcaattgcataagtatggtatgaattacccaccttgtgtgtttcaagtaggggcgtcaacatatgcttgctatgagctacaacattcatcatgttaaggtggattgtgaaggtgggggatttaattttgcggttttgtgtgttccaattatcgaatacactattctaaatcatttgcgagttattgttgtatctttggagcttatcttaattccattatatgctccttaacggcattgccccatttttctaccgtagcatcatttgttgttttaatcatatctagtgagaattggatttaccaagtttctcatagatgacgccaatgattagtataagatggacaaagttgatatattagagatggactgctactttgtccaagatagaattgaagggatttaactcagttggttaagtaaaatgattgataaaatatatttgtgtatagggtttagagatgagcttaattctctgacagtgtccaaggcttctcttggacaataacacccctatattggtgtagaaatagagcaactatacttctgagatgagatatgattcgccgttcattagtgcatgttaagattcttgtttttggattgagtctaagcccagtgcataacatgaacagtacatgtaccgtattaataggtttgacttttaaaaattgcccataattgttgaaagtgtttagaaccggaatgtaacttaaagaaagggactcgtttattgtaagagcaaattaagatgaaataaagtaaaattatataagttaacttataaaaattatgaaacaccttcagacgtgctatttctgttcactaggatccaaatgtgtttttgttttttctgttaatgtgaatccaaatatattttggagcattgcagatgttgctatgtagaactgaacccaatgccctacaccataggcgattccctgagtttttcatgcagttcttagccaattcaaagtccaaacctagtgagcatgtgattgtggtcccccaattctttctccacttgggcaagttataggaggcaacttcacttttacagccttgtggaaacttgtgtcatgctcaataccaaactcagcccaagacatgcaattggcccattacattcgtttcatgtggtggctagtgaaaggtcgaatcaataaaaggaaaaaaaatgagcatgtaacaaacttgtgtacatcttttttcaatccatgcctattttattcatggcttgttctttttaaatatttaaggtctccctctaaatgttgtcagagtcatgaaagtggagcgcaatggcaagttctttatgggattttaaagagccgaaagcaaaatggacgtacatatttgtatatgacaccaatgaatattaaacacaagtcggagattttggaagctttaaactagcagaaattggccagtacttatttattgcgtgttatcatttatgaaaagtagtttttgtttatttatttatgtatttattcatcttaatatatagtgtggtttgtacaaatttgacagctattgtgatagcctacttttattttattttcatatgagacatagcctactttattgcttgtagcatgttgcaagcaaccaattcacatttaaactcttagttgcatttcataataaagctcacaaaagggtcaaaacatgcttttgaatatcacagaaaaagaacgaacaagcttttactggtccaagtctaactttggtaaaagaatttttttgtaatggaacacaataaagtcactgaatcatttattgggcgctaaaaaaagcttattttctttacaatgctttaatagtcaaatttaatcctctagaaagcatgtcaataaatgaatgtttgttatgtttctcatagcaacaatattcaaagtatatggtgtgatagataccaaactctggatcttgttgagattttcatacaagtttgcaactctttaataaaggaatagaatttgtataaaaaaataagataaactgaaagcaagatcacaagaaaatttacattagagtaaaataaaaaaggccaggtacatcacaacaaacatttctctctcttttttttgttttttgaagaaaaaagacagttttgtgacatgtaaacattactcagcaatcaatttaatgtagcactcaggtgtttgaaaattacaaggtttcagtaaagtataagatgatataccagttttaatgacccatatcatccacggtaagaaagataagcaatcttgtagtaaggtgcattttcttctaaaagcagtgtttaaggtatatatcacagccaaccacagcaaatgtaattggaagagggcaatcgtcctgtttggcgaatgtattctgtttgagccgcagttctttctgcttctcgattttttctagcttccgctgctgcacgtttttcttctgatctttgcctcgccatagcaatctttttcaccatttttgcatgtgtctgagctctcatttgctcaactttggcctaaaatgcatatagtttcaatcaaaggcaaggtagtagtaaagactttaactaaagtatttctaaagttatattgcaattagataatggccaagcatttcatacaatatattcaagtggacacgagtaataatcataacaaaatttatcatgcctttctctccccttccctctccatacacttggtttaaaatcctttctaaattgtgatctcttcaaactacgtttaggtttcaacttttgaacatgcaataacttggtttccaatgaatacagctatgtaaacaaataactacctcaattcttctcatttctgcttctaattttgccttttgttgactttcccatgcttgaattttgatttcctcacgcttaaatctgcaaattttaacacaaacacattagcaagaatgaacaaattacatggtctataactactttccaaaaaaaaaaaaaaatcatgatttacattagtctagagaatgtgagtaaaaataaaaccttgcagtatgtttagatttctcagcttcctcccacagagccgcacgtttttcaaattcaattctctgctgttcatgcacattcgcctcctgaggagaagatttgttcttttcctgctcatctttgcttgcccaggcagcaatattcatcttaccaagctgcaccccaagggctgcaatctctctccttgtcttgatcttcatttcttcttcagacaaattcctttttccattttcaactggaaactgggaatccccatctgtcgtgttgtccaaaggtgtcggtgcaggtgcacctctcctaggagtcgacggcattgaggaaactgggctccgtagtggtgtcgcagatccaacaggagtagcagtccgcgaaggttcttgacttggcacaggggtcatttcagttcccatgtctctcatggcaacagatcttatcccaggcatcactgtatcatgaaaacaagctaatctacattgagcatgtcaccaatggatgtaataagaacatgcaccaggatattaactttcaatgttttagtgttccattcctttttttttatcaccatgtgtatattttttcaattaaaataagaaaatgcataaaagattaatttcaatagacaacaagtgtgtataaaaaatttcagctagcgataactggcttatattttctattctccagttatgcaatgaagtaaaggttgccttaaattagcacgaataataattatacaaatgctttgtatactttttaatcttcccaaaagaggatataaaaaaacctatatcatcaattttgagggttgaataacatacatgactgatcatctgtacttcttgagcaagataaacctaattcattgacttcctttagatctttgctttggggaagagactccactaccggatttcttccgtgtgcttgacctgaaaccgaatgagcatcggagggaacaaaagagaatttctcaaatcccatatgtgatgttggctgacagaaatcaactcgctttgtttctgtcactttgcctgttggttgtttatgatcataattaccagattctggagcaaccctccccatatttgttggcatgcgatttgcttggttatgtgcagtattcttttttgagtgattcgcctgtatgttttgcctattcattatccatttctcggcatcgttccacttagaaggaataggtctgaatagggatctagtagcaggattgttccctggtctctcccctttatcaaactcaaagctggacgagctagcattgctgtcataatcaagattttcatcttctattgcccttcccgcatgaattgcacttgaacttccggggtcaaccttcggaaaatggtgcatctttgcacgcctggtgtcgccattttccttaggcattgtctcctttggttcataagaaatctggtcattctgtttccggtccagcacggcattactagatggctttaatgacagaacatccaagctcggagatgtaactggaaggaacaagtttccaattagtcaacatatgaagcattttattcaatagaaaaataaatacacaaaagctgggataaatactgactaacacaataacaaatgtacatgaaaaattgataaattgcaattgcaaaccttcatcatcaaggttgtcatttttggagtcaagtaagctattcacaaattcagtatcctcaatccttgagggggaggttctggatgagttactgttggatccatctttcttcctatgatggtgaggtcctaataacttcatccttagtttactgggagaaattattccagcctgcagaaaaaatggcatacttaccctcatcaaaatcctagaagaactcaattagaaaatttctaacagaatccatgtagcagtacactgcataaacaattatacccaatacatgaccactttcttcttttccaccaaaaggcccaccccaccgtttcaacccacaccctttattcactcagaagaaaaataagggaaaatgaatcctaccctttttttttcctttcccttttcagcctttttttccctctcttcctcacccacccacccaccaaataataatgacaaaccccatccttccattcattacaaaagtagaaaaagcaaaagcatgatttttgaaaccatgtcaaaattcactcggaaagaatcaatgaaacaaagcccacaaagaaactgaagggatgatgactattctgaactccatgaacacaaagcttgaataatatggaccatttagccaccaacccagtttaagaaacaaaataaagatttaattttgatgaaaaaaaaaactatgaggttgaatggaagaggagaggagaaaagagatggcaacagtgggctaaatgccaaacctgaactttctctatcctctcgtactccatttgatctctgactctcttctttctctctaagttggaaggtagctgatgcagaagtggaaggaagaaaagttgaattttacagcttggcttggaagtagttatgactggtgagttgtgactgtgaatgagagatagtaacaataagacatgagagagaaagagtgagattatgaatgaatgtgatgcagcaaggacaagagcaggaacaggtgtttgcttgctcaagaaagtgttcaagttgggttcctctacagtacaggagatgctgtatctatctatcatctcgccacgccattgcaacatctcattatcaattttttttttttttttttggtacgcacctcgtgtatttttataggagcccatctgtccatgatcgtgaattcatgtcgtgggttataacttataatttttttttaaaaaaaataaatttatgtttcttttctaattcacatttgtttagaaagataattatgtttcaaataaatttttaaatcaaatataagaaaaggatatacgaaattcaaacctgtaatcttttaaatgtgagtctctattttactgtactcggtgaatccgaactattacactgttttctacttttacttttacttatgccttctccccttccacccaaggatnaaaaaaaaaaaaaaaagaagaagccatatttatttattttactttgcagtttacatggatgccctgaccctgaccttacagataaccaacatacgtaacgacgtcaattgaatttgatgagtttatatttatgcttcaatggagaatttaaaatattttaagagattaaaaatgtaagaaattaacttgttatgttcaattctttctatgttgtttttaattctaactgttattgaataattaaatttctaatataattttttgtgtgtacataaaaatatttatagtaaatagttaacaattagtaatatctgttgaaataaatagattatcaaaataaataccgtctcctcctccaaaatatttctcattttttttgtaaaacaaaaatataaaaaggataagaataggagcataacaaattgagtaaaactgactgataattaataagtattgcataatcatttaaccaatttttctatgaacattttttaaattttgaagaagaaaaaacctttatcttttccttcaattcttttgtctgcgtgtcaattagtaaagcttcatggatttatatttgttttttcattgtaacttttgttttaagacaaagagcagattactcagtaactttaggacagtcttcgagatcgaaacagtgggcatgatcagaattcagaagtttgcattatcaattttctctgtatagtaactgtttatgcttgtaggtcatagactcatagttcatcaaacgcgaaaaactactacataaggaaaagtaataaattagaaaggaatttatttttaatgaggtgtaagtatacggattcaagttgggatactaaaatgtgacgtgatagaatatatattattaaatgatagatttagatggtatatgtttttttctaagtaaaattttagatttaaatattgagtacataaaaagtttcattgagagaactaatctcaacatattaaaaatattttaaatttaaacaaaatagtgtcctttaaccaccaaacacttaattatttagtgcgaaatcattctaatttaaccaaaggccttagatgaaannnnnnnnnnnnnnnngtattgtgttaaatagtaatacttaaagaaaatttttattacccgtaatgaaaatgcatgtgttctaaaaaaaaatccagtactttgtagaaaatatatactaatgatctaaatataaaaaatgcacaaaatctgttgaagtttgtacatgaaatcataatttattagttctacccaaaatcataaatgattggataaaattctccaatacaaaaacaaacttaccccttaaccttgttgagttttttttatatatataagagacctgttgagcgtttatactggaatttacaaaaagaatcannnnnnnnnngtccatgaaatatttctctttcattttattataaaacgtaattttgtgtgtgttataaataaattatacgagcatgaatcaatttactccaaaagtaactttaaaatacataaatttctttatatttcttttttttaattataagtttttttatacaacaaactaagaaacatagaaaagagtaatggtgaaagttggagtaatttgcacaagatcttctattcaaacctagcttatcagtgtcattgtacacaaaaaaagaaaattaggaaatagaatatgcaaacatacttcgatggaggggaacaaaaaaaaaacaaaacttgtcttattgtcaaatctaaataaataacttaaaggacggattttaaaagaatgaaataaaaagnnnnnnnnnnatatccatctatataaaaattaacaatctctagaaattttgaattattgtaaaccaaactcaactaagtagaacgatatgtattatctaagtttcattgcccaaactaacgactttttttgtaagtatacttatatatattgtttttgtgtatcgtcaaggattacaattttgaagctttagtactccaaaattatttttttgcaggatatatatgggatatttatgtgttcaattcttcaaggacaaattttatatgcacttttcattacatttttaaaattgcatgctgataactatttacttctccagggacaactttttatatgtcctcttgatcagttattcgcctttaaattttcaatttgagttttatatttaatttttatgtgcatatgttcgttagtaatgttactttttattactggaagatgattaatacataccggaaaatttgatagattaaaattttaatttatttttcaacgatgatatataactatccatttattttaaacattttattaatatctttcatttttttttctttctcttcttnnnnnnnnnnatactggaatttacaaaaagaatcatataagggatatatatatatatatatatatatatatgagagatgcattttgttttttgaaagcgaagatatgcacattaagtatatgttttagataattattttattaaaaatagtcgttttaaatgtaaaataattctaagctcaaataatattagatgtatacatctggattttttttatagaaacggaaagttaatttcaatttatgcccaaattatatattttgcaagcaacattttttacgtaactaacataagttcacatgttataaaaaaaaattaagtccacaacaacactcaaaatgtaaaatgaagttatgaaatttagtattatggttctatatcaacaccttattattcatataaatcgaagcatatatcataatattttttttataagctaaagaattcattactaaaaacaattaaattgtgcacaagatatgtccaactcaaggtgccaaaatgatatagttagagaaaaaagaaacaagtactgggatagtgtcattgttttggacaaaaatccaaaagacccaccccaattgaaaactaaaattaacgaaaaatcatgcattggtagttactagttaacgtgaacttattgccaaaaggaatatatatttgcgagtctgcagtgaattacacacatttttctacttgtaagatctgagtttaattgttattgatactagtaataaatttagatttgggaattatttaaaaatttacatttgctaaaaaatattagtcggtgttcaaagttcaaatcaaacagaacaaaacacgtgaaataaagcctctcatcaaacccgtggatgcggacattggtagctaactaattattccgataatttcggctccgaatacctttcttattcttagttggaaaaaaaaaaattattaacaacttttgaaagaaaatacaataaagacaacgtggtttgaattgaattcctcgaggaggagctaacatatattgggacacttatgattggatagaaaatattactagtacctcgtttcttcttaagcattattttaagggtttcaactttttatgtataaattaaaaaatatactactttatgtccttactaaaggttcaatcaactaattaatcaaaattaaagaaattaataaatttaatttataatattaaatttatcttgaattgatacttttttcttcaaaactactcatattaataaaattaacaagcatccataaattataattttctcgctgtcacattattctatgattgactctaattaaatatgtttttattaaaactaactaatgcaaaatatattttagactgaattacacttttaatttgatccttataacaagaacaagaaagaataatatttatccttagtaaaatatagtagttaagaagttatttattttatcttttttttacatcacagtaaataaatatcatttgctttttttaatctcaattccataataaatgagtaaattaatcaaaattaattaaaaataattaatattatcttaaaaatgaaaataataaataaataaataaggagaaacaattattttcaatggtatattaaaagtttaaaaaataatgatataaataatgatattttttaaaataaaaaaaataatttaaatgtcattatttaatttaaaatttaaacaaatcatctgaattnnnnnnnnnnaatttaataaactaattttttgattttcaaatatcaacttctaatttttcaacttccaaataatttttcaagaaaggatgaaagaaaaaaaaaacactcatgtaatatgttggaattgattgtacaacatatttgattaaaacctctttcccaacttttgaaagattctcggaagaccaatgattaattcttctccaaaatctctctttggtgaaagtaaaaatctctttcttcctcctaccaatgataaaaggaagtttaaggtatttgcctttgtcaacggtttcagttacacccgaaattgaagagatgttgtatattcagatgggggtgtgtttttgctaaagaaaatcttcaaatttatggtaattgatgagttgaacatacatagcgtcatatgtatcaagaatcttcctaaggaaatttgtctcattattttatgtcttgcaaactaaaaaataatcattaccaaataaaatgtgtgagaattgaaattttcgtactcactatcacatcatagatctgtaacacttttttaaaaggaggtcctgtaatgtgtgaaatactaaaaacacattttctaatatattttttgattttttcttttattaattgaaatttattaaaaatgataaaaaaaattggtatcacattaattttttattctaattttataaatgtcaataaattttaatcaacaaaaaatatatttaataaatatattagaaagtatcttacgaatatttcctttgaactcatattaagaaaaaattattttatatcttaaacttaaatataataaatttaactaatttcattcttatttaatgatatcattattaaaatatcattcatttaattataactttattttatttatgatattaaattttaataaagaatattttcaaaataattttattgttaatcgatattaataaaattaaataatttcagtcaagagtatgaaaatatttttccttatatttttgttatatacgaatccattcatcttggaaaatactacaagtaaatgaatggtaatagtagtagatgacaaagaagccatgaatatattccttggtcggtcaaagatacttctgtgaacacatccacaaacgcaggctcatactttaagattttaattaatttatttgagagaggggaatatgaattaaattaattagggtgtcagaacacagaagccgaaggagatcagagttcggaattctataatgtaacttctcctatcactgtttctatttgaccacagtcgccactttccaccctatcaattccacacgcccacaccatttcaattttcaaaaactcacgtttttgctatgatgctaaatttctagaaattcatgctacttatcaaacaatacaaaataccaactaattactttagtttctatcttttattttctaagaattaaataaaatatataatttcatctttttaagaattattttaaaatgtctttgacattaatgcttttcttacaaaacatccttaattataagtcatccttttgggatcaataaattataagtaaaatatattattttaaactcttaaagaacattttgaaaacttaatttaattttcttctcccttttttgtgtgaatatttccctttccccgaatccattaatcatatattatgcttaaaacttgattttcaaatgcattttctcattaacattctaaaataactaagtgtcttgtgtaacaaatattgtttcaacactgttaaaacactatttgaatttttttatttaattagtttatatataaaacaagtattgaatgcatgagttaactaatataaaattaattgtttcatcttaatcaaatatcttaaatttgagtctttagaatgtaattacattaaacatttaaagagaatttttttcacccataataatcctatccaagttaaatatgattatttctaataaaaaatacttattctattaaaaaaaagtttttgtataaaacacttgaagaagttttggtataaaacactagttcaatataatatcatgtatcttgcatttgtttcacttacctgatcgaaactactgtgtactaaatcaaaaatttcatttaccgaactttgttgttccatctttactaaaactaatctctatttgatactactcttggaagctttggtcttttgagtctgccaaacactgttttaatcagcaaaaaatatatgtatatatagagaacacaaatgggtacccaaaccattttcaagattggtatgcacacagcatattgacttgccaaacactttctaaacaaccttccaagcaccgactcaattcttaactaaagaatcaactcaagggtttatagttttcaggttgaaaattttgtaaagattgcaattcaaatcatctctttgttttgttgtgtcattaatgtgacctacaactctatgaataattcaatccaaactaggctagtttaatttccatttaactcagcgtttattcacaagttggtgtgtatttttcaggagattctcctttctctttgaagattaaaaaagcagtagacagacgatatcacgatcataaaaaagttcaatatcaaagtggtaaaacatgtgaattaaagtggttgaaagattttatcttgttgatctattcaaatattcaaaagtcatacaattttattgtcataatgaaagcagtattgcaaatagcaaagaacatagtatttcatgagtggatgaaattaacataacgaacgacattcttcatgcaacttatattccttcgatctcatactcaattagttgatgtcttctgcaagaccttagacaaatagtttgactacttttttattttttgcaagttgggaattctaaattccagtacactactttgtatttagttgatgcagttttagaagtttgagactgatcgagcttttttatatatatccatctatataaaaattaacaatctctagaaattttgaattattgtaaaccaaactcaactaagtagaacgatatgtattatctaagtttcattgcccaaactaacgactttttttgtaagtatacttatatatattgtttttgtgtatcgtcaaggattacaattttgaagctttagtactccaaaattatttttttgcaggatatatatgggatatttatgtgttcaattcttcaaggacaaattttatatgcacttttcattacatttttaaaattgcatgctgataactatttacttnnnnnnnnnnnnnnnnnnnnnnnnnnnnnnnnaatttaataaactaattttttgattttcaaatatcaacttctaatttttcaacttccaaataatttttcaagaaaggatgaaagaaaaaaaaaacactcatgtaatatgttggaattgattgtacaacatatttgattaaaacctctttcccaacttttgaaagattctcggaagaccaatgattaattcttctccaaaatctctctttggtgaaagtaaaaatctctttcttcctcctaccaatgataaaaggaagtttaaggtatttgcctttgtcaacggtttcagttacacccgaaattgaagagatgttgtatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaaatctaaataaataacttaaaggacggattttaaaagaatgaaataaaaagcaaattagaattttaaatgaatatatataaagaagcataaatataatttgagagtttttatggtattcttaattattttggaggttttgatactgttaattttttaatcaattaaattatatgtcatcttcttattaatgatttttttttgttttttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctctctttctacactatgttaatcataaataaaatggtttcaaagtcattgtcaggatgtttttttatatatcataacaaattagaaaaatagtgacttttgtcctccctattaatgtaattaacgcggagtcaattatgtataaattaataaaaacatctttaaggttaaagaaaagaataaagaagagtactcatctaaatattctggccttatattttacaaaaaaaaaagtttttttataataaaaaatattgaaagtaactaaagagattttaaagttcaaacttctaaaattatctttaatcatattttttaattttaaaagttacaatttaaaaattttaaaaagataataatcaaagattaatttgaaaaataaaaaataattaataaaaaaatgacatataattttattgattaaaaaattaacagtatcaaaatcctcaaaattattttcagcagcgtagaaactcatataattttatctttctaaaatgtctttgagatcttatttcaaattgtcgataagccgtaacttcctttgactaattaagtccttttatgacgtacatgcacgagaaacactttgtagtcaactaaggatgagaagtagatatataagtccttttatgacgtacatgcacgatccaaattaattttagctatcattaaatgaatttagaaaacggatcaagttagtaaatggcaggctttgttagaactaaaataatgatatattgcttgtatataggtagggaaaaaaaaggcccgaataaaaaaaagatagaagagtagatatgtaattgaaggaaatattaatattcctttatatcaatgaataactctaaaattatgttttgaaaaataattggtttgtataaatgcatcccaattatgataaatatatttcataaaatctgaaacacagtaataaattgtggttatgcactaaaagtaataacattaatttttttacaaatactctatctatatttttaaggttctgataacatttgattaagaaaaaactgattttgcctataaaaaaaactgattgatatggtgaagagtattaataatattaactagtacttttttcacaatttattattttaatttattgattaggaaaactgattacaccttttttatcccttaattccccacttctattcttcggctcattaattaagatgtcatttggaaacgtagccaatgaataattgaatagtactcctcgttcttttaactgtatttgcaaatataattaacttcccatatcgggctaagaaaacataattagcattccgggatcttaaataaaaattttaaaagctcaaaacccaatgggaaaagtagggaggtcgtactacactttttgtttgcttttcattatatggtcctataaaatccttctatttaagttacattacactttttattatttactcgtattaggagctcaagaaacattcttttattattgttaatttcatcaattcattaaccaaaagttgatgaaagattagggaattccggtcatagacgcctattacttcacacttcacatggtgtgttctcattttgtgtggggcccattctcctttgaagattttgggtatgacgtgtatgcccttcaaaggggctttgaccaatttgtcttattttcattcgttttggtatgtgaactcattgattcgcctacatgtttgaccactttccatttccacatatgcattcacgtattgatcgaaacgactccatactagtgttttatatatttttctgctcattttttgtgtgaaacatattgggaataacagaggtcgggatgaagtgaaaaacatctctttcaccttttttaaagaataattgttataacttgttgttaatattgacatttttccatcgtcgaaacaatgatctttttgaggaagtattgaaaaataatattttaatatattattttgattaagtgttaaaatatatttttttggttaattataaggtgacgcaagaaatgaagatttagaaaatatcaagatattaaaagatatcaatggttgagattaaatatataagttatctaggatgaagattgaagaccaaatcatccatagtaaaaagtgaagacaaaatcatcaattatgaagatcaaagaccaaaattattgacgatgaagatttagtgaaaatttataaaagttagagatagttataatttgtactttataaaagtataacttttatgttgtaataaaggagattgatacataatcacttaattcctcaaaatatcaacacatttaccatcgaaattggcaaaagttcaacaagttatcgtatatttattcaactctccacttttatgaatcttcacatttctaaatcttaactttttcaatctccatttattctcaaaactttatttttccaatccttatttcttcttattattgaaatttcttagaaactaagtactgaatcaaaaatacttttataaaaaattattctattatctgatgattacaactttattataactaaaatgaatatgtttatcaaaattattatcttaatttacattaaatattaaataattttttattaagttgaaaactatgaatttacttgttaacaaaaaagaactcataatcaaaaataaattttatgtttcacttttaagtatttatttgttaagagaattattcagtgagaatttctttactatcttaaaaaatattttccttttgaggaatagatataattttgacgattaacacttgtttaaaaaaagaattttagattgcaatatttttaaaaattgaaaaaatgtatgccacttgtttnnnnnnnnnnnnnnnnnnnnnnnnnnnnnnnnnnnnnnnnnnnnnnnnnnnnnnnnnnnntttatacttttatcgcataagtatatccttgtaaagttttgtaagctaatgcagttgacctttattgacttgttgaatggaataaaatacatagatgaaaaggatgatagatttttcaaaactagagaaatatgcagaaaaagaaaagaataaatgtaaaaaaaataacccacaatgaaaaataaaacaaccaatatattagatgtatcctttaaaatgtaaaatagaaaattaaaatttaaagataaaaaaatctcacaaattattatgaaaactttattttatgtttgactcatactgtataaaaagacaaaaaatattttatgaatttcaaaaaataaaaaaataactttaaatttagaaaaaaaaactaaactttaacaaattaaaaacatatttaaatctatttttatcatcatattatcctttgtctttctcattgaagaacacttcacttacaagtgacatcccaactacgaacattattgttttcgttgttttttttagaccaaattctttttttgaaagcacaaaggcttgacataaaactctagtcagagtgtgtgttgactaaattttgtaaaattaatttacttacatgattttataataatttatgttttaaaaacattaatatttttattaaaattacattggattggaaacaaattgaataaattttaatgcattccaccatgacatcaaacaacacttatattccaaactaagcgacaaaaagtacaattagtcatatttattccatctttaatgataactctatcttagagataaaagcaaacactacatattagcagactttttaatggctttatgaggacaatgaccaatgatagtatcaaagcaaaaattaaacaagagaggtaatgagtagaaaaaacacgagtgggtggcatctactgaaagttttatttgtgtggtggtcgccattctagcatgcagatagaaatggttccacttccagctcctagtagaaacaaaagtacccctttagttctagggtctcattatcccatccttaaggataggatacacatgcatttaattaatgctaaactaaatcacttatcttataattgacgatttatttaactactaaagaaaatagtttaattaattaagacttttactaataaaacgtgtaagacattcgataatcaggaaaaactaaagagtatttctttttatatatattaaatactttatttttgtttaatatttaatattttcaattgtttaacaagtttctttaattttaattttgatggcattgattaaaagtaccaaaattcttacaagtaggttagaatctcccgtacccagtattcagcttggactgtacttgctttgatgtgaattattgagtatctttccaaatactgtgtatcttatcgtgaagcaatgtaaacttgtcagcactatcatataaccaaggcaagtcgttttctcacattagattcaggcacatggtctgggcattgcgttgattgtggttagtttgcagaacgtaccaaaaccaaaactattgttttctctctctattttctaggttaatttataattactaactatatttaattctccaatctccatggcattattccatggcattattctaatggcacaagtaaatactcaatttgatctttattttttttatataaaaattcattaagtttctgataaaaaaaatcaccagacaatttcttaagattataaatgttaggcattctagccttctatttattagataaaagaactaaaatatataatgtttataattttgaaaaactaaatactcagttttcttagggatcaaaatattgtcattattattttaggaatcagtttgagtattcacctaaaattatataaacggaacttggatcagtttgaaaaaaaaaattaatctgagtattctcatgcttaaaaattattgactattacaaattataaatgagactcgtcaactaagaagtaacacctataaattaaatttgtgtgatgtccaataaatttaagtcaataatagcaagtgtgttcaaaatagattgttagaaaatatattcctaacatttattttacatttaattgtgataatatttaataataccaattcatctaattataaatttaaacaaatctaattaataaaataaaattttaaattaaaataaaattacaccttcataaactatgataatattaaatgtcttaattcatttattaataaagtctttaagatgttaacttcaagggtctagttgagtcaaacaaaacctcacttgtatctttgagatgatgtatatgtaagtatatataatacttttataagcactcaaaaattttcttgtgttcaactaatgcgttatcctcttccctgttcttagtgaaaaaaagatcttttatattgttgctttcaacttttccttgggatgaaattcgatattcaagaagtcacccctctagcttggaattatcaatattaagcaaaggaaataaatgaagaatatacaccatccactgtgtggtgcgaataaattggtgtgagaatattttaactcaaataattgtttcgaattcgagtctgaggtgttaaatattgaatgagaaaacttttccaccaatagttgtgctacattgctactcaatttaaacaggattagttcctcatccctacaaatgatatatatgatctataaaaaaaataagattggactgcatcatttgatggctagaatttacatttgtgtgtgattataagttgctttagtgtgtatttgtgtaactttagtatcagaagttgactttgattaactttcatagatgcatttgagcttaactaagatggatatatagtgaattgggctcacacccaatccgtaacaaatgtcatgcacacgagtcattgttataatatacaagcagtcaagcacaattatgaagtaaacctatgcaatgtgggtgcctacaattagtaaatatggcaaaaactcttgacatatattatatatgtggctatgcattgagaattatctagttcaagcagatgagtattgaacgttatagcgtctaggtggattgaaccttggatagtactcaacccaaagttgttgctaaccttgttgaatgttattgatatttgagctccttgaagattgagcttacattctttaactttaacatattcaattatcatagttaattaagttaaggtgaacaatggataaataacacgtctaaaaaacaaaaaaaaaagtaatttaaataaattatcattgtaaattttcttacaaaataaactaattagaatcaattttacatataactattaaaataattattataaaattaataattttaccatatataacattccataaatgaacggaaatcttacattgaatatgtaattctaatcaaattcaaaacgaaatatcatactatttgctgaacaaaaaaaataaaaaaaaatcatactatttgcttaagtagctggtggcatattgctgtcaaaattaatacccacaaaaagaaagaattcatgtgggatctctgcgggaataaatttcacaagacagaatactaagtttgttgggaccctaatgaactttgactgggaaaaagggattgcagctttctgattttgtgaccctttgattgctatctttgaaaaatctataaaatattcaaatataggtgtggaaagtcgcttcctcatgctttaactaatttcccttttgtcaagcaatgagaattttggcttggcttggctttaaagtcaatgatggtttacaacttttggaagcatttaacgctatggtaaatccaaacacttttccagagaaattttaaaaaagaatcatcataaggatatggcccgactatatttaatggaaataaagtttacttctaaagagaatgaagaccaacgctaccaactaaaaggtgcccttcaaagtgtggcatttgattataatgcttcaaggaatcaaagtagccatggctcaaaatgattgaaaagatcattgtttactttaaataatgtgttctataagcttcaaatgtgtatctaaaattagattttagtataaactcgataaaggctaaaatcttttcttttaatgggagatatacttcttttaactttatttatccgaaaagaaacttttcttaaaaaaaaaaagaatttcaatgaagcacaatgacgttcaacgcatttaatttaccctaagtttctaataacattaggcttgcttctgctgtttacttagattggacgtatgtgtagtgcttcctttgcaaatgttctttggggggccatgggtcgagatgtaacctgtaattaaagaagaatgtttcttgagcacaaatttaagacaacaatttctttaaatttggagtgtgtttttaaaatgcataaagtcaaagaaaataaaatccaagaggtagaaataattatgtatatagtcttatatatggtgtttacattttatgttttaataataaaattggtgattaaatttattaattgtcactgacccaacgacaacagaaaaaaacacaattttccattcaaatgtgtcacaatgttatatatactgtttaaggcagcccacgctaatatctagcccagcagtgtatgcgtagcccaaacgaccatcgcgaccacacacttgtgtcgttgtatattcatgatcgggattgctattctcaccttccatcatttcctcacaccgcctcccttggcaaagtgggacagcttaccaaaaacaagtcaggctggtcctagctcacaaaaaatggggtgggccaagctggttcactttgcaaaattggctagcaatgctatccgactccacttttttagtgagctatatgggttgacctgtcagaccatgctcattttgccattcctaatttaagttaggaatgacaaagtggaccagtccaccaaaaatagaccgaactggccttagcaaaagaaaatgagatgagtcaaacgagcacactttgtaacgtagtcattacaagcccgtcccacttttttcaatggactagcccgtcagaccaaacccatcttatcatcattactcctcgtccctctctttcctcaaccaccaaatgcttcatgtatttattttattttatttttttaatttaaattttattaaaattttgtgtatatatattttaatttaaattatttaaaatcatttgatatatatatatatatatatatatatatatattaatttatgtgtttcttatttaaattttgaagattttatatttgtcaattttttattaatatagattttttagttaattttattaaaaaataatattttcttaatttatatttcattaatttaaatttataatgttttatatatatgattttttattttttaatatgataatgaaatttaattttttaatgttcatatttattaaaaattcaaaaatctaaaaatgtaaattaatctactaaaaaaattcaaaatagaatattattaaaaaaatatagtagaaacagtgtacaaagtctaaaatggtacaagaaagttgaaaggcatgttgaatgttgagttatgacaatggatatttctaaaatgaaaatgtaattgtaccctttacaataaaaagacatctcttttctctgatatattgcataaatgaatctgtcattctttaagaaaataataagtaatatctgcatctactcattgtgttgttctatctgtattatgatcttttttcttcttctattgttcacatacgtagatagatagctaaaatcagaatagccaaatgatatgggcaatatagaccacctttgcctagtgagctaaactctactctattgaatttcaaaatctatgatttggtggtcctaggtttaaattcttcatgcttcttcaaacccaattgaaaaggtttttctggcttaagaaacaagattgaaccataatttcatgcaatatttttcttattagtttccaatacttatggttttgtttcaccaaaaagattttgcatcccttttgaggggttgttgggaatatttttaaaataaaatatagaaatagtaagaacttgcagaaaaaatagagattaataatgaagaaaaatagtcaataatattgataaggtaagattgtttatatatagcttacaaccaaaaattctaaacagcctagtttatcttctatcatatttatttttaactaattaactgaaacaaaatataaaagataagatctgcaataataacaaaatcaatacctaaaatttattctaaatttaaaataagttaggcaatatctcgtactctagcactcctccattagatttgtcatgaaaatcctaatttttaactccaaagcttcaaacttattttagaagtgcattaaatctatttaatttaattccttccggcttcaaagtcttcaaacaccgtataacaggatttgtcatctcaaattcatcttgcagaaacttttactacttcaaattaatttgactaaatctttcatgccaaacatcaatttcatcaattttgaccacaaaatcatgatcttcaattaaattaaattcccaataaaactatttatttccaatcatttcaatttttacaatctctgtgtggatttgaggcatatgatagttttaaaggtgaaccttcagctaaaggatgaggactttgtttaccccatggacacttccaaaagtccccctcagtgtgcttgtgcccaataatattgttaaaaatgattgaaaaattgcaactcataactcggatctacctaaactgggagatggaatgagtatgctagatcattccatagagaactgggacgcagaaagctggaatataatcccaacaaggactggtgcaagttacttaaatgatatacttgcttttcgggataagagtgaagaagagaagggtaaacctttatcagaacgtagcagttataaattttggcatggttggaacttgacgttaattccttggccgtacaaaatctaccacgaatgtacaaagtccatttgtcccttgctgcataagtaccattcagtgtagtgtgtctctatgtagttatgaaggttttgctatgacatttaataacattctacatgtttagatatagttataaaacaaattgatttgtgtctgtctcttgtagcttttgtgttttattgcttgctaagctaaatgattttctagtagttatttccataaaggaaatcattgtttattgatcttattgtgaacttatgtgcgtttttatttccgtgaagaatgaatgaacatttgtttcttttgacgagttctaatcaatttatgctgataggaaggatttgatgacactcacatttagcgattccaacggcgacggtagcctaacacgtcgcgctcgacattggtaaatgccagattcggttatccaaattaaacgttaagcaaatttgcttccttattttggttgcttgatacttggttattttgatgacttgtccttcgtctttgtctacaaaatttagaaatgatttggtgtctgtaagtatgtttaaattatgtgtcaaatcttataaaaaattcacacaaacacacatacacctaagtgttaaaaataattttaaattagcttaaaattatataaatatgatatatcttaataagaattctcaatttagcaataaattttgtaaaataattatcaaatgaaattttatcaatcagtgtagaaattcttgactgacagtggggtaagacaacttttctaattttttattagcttataatatataatactaaataaaatatttaataaaatgcacatataatcactactagcaaagatggtcatacacaccatggattaacacttttaccaatttaatgaccagtccaatttaaaaacattaacaccatcaattgttttaataaaaaaatacaactgaaatactcggaaaaactagtgataaacaataagacaaaacttaaaaaagaaagaaagaaaatggtaatgctttaatttaattactaaacaaactgcaaaaaaagaaatgcttttgttcccgcactttacacttaaaattgacttttcatggttcttttaatcctcacccttggcctgaccccatccactataaaatttcagtatttaggcgagccaaatagaaaaattcaagacatgtaacgagatttagagtagaagataacagaaaatgttagatgtaacaaaacagagttcactgtcagcttctgaattaggtcacatatttccagaaaaaaaaaattcattctagtatcttatcgcttgcaaacagaaggatcattatggcttgtctctgccctgcttttctgaaagagttaaatatggataaaatttggttttagtgcaatttaagttaccaatatgtatatttactactacacatttctcatgttcttgattttgggataaaataatccagattaaccaacgaaaaaaaaagatttaatattctagcaaaagttaaaaaaaggattagcagttatttttggttaagatttcaatatctttcaacttatttttacaaaaaaaaaaaatatcaatgtacaaatcttttgcaacacatgtttagttctcattagtgcataagttgtccttgttcatcttctaacatccgattaggagaaccatagggaagattcaccacactgtcaccactaacataaactactcgaaaaatatcatacttcatctcagtggagaatcgttcaagatatggcatcatccactttctatggtctgagttgagaatccatgagtaacaaaattgtagggactgccacacatgaatgcataccactcttggtaagcattggcctttcatgcaaaggcccgcagttatgccttctgttttgggaaaacgagacctaaatattgctaggactgcatagcacaagtcattaaggtccttagtagttgtgattactgagttcatggagattatgtcaccagtgctgaactttacatttaaagatccatctcttgattctccagcatatgcatcaaggaaattgtgttcaaccaagactgccattctagttacattattggttagcattgattgctgtaaaggaaaaattgcaaaattgaataaataaataaataaataaataaataatcagggcatagcatgttgttggagataccgcattaactagtatatagacaaaaaattaataagagacaattcctactccaggagctagtttttagagttgagttatgctcaaatctaaattctaagatatatgataaactaatcagattacagaaattaaactatggatctagtctgcccaagtactaatatatcttcatttttaaaataataattctcacgtgaatatttaaaggtgaagatcaatgcacattgcaatcatgaaacatttacttactccagctactttataagtttgagatattctgtcatatcaggaaagtagaaaactagagctggcttctaacatgaaatgttaaattatttttttatgaagagggttagtttttcttggcatgcctcttatgcatggcataatgtctataaagacatgccagtcaaattctagatttcttgtcccgcaaataatatttatttagttggaatttgaagacatggatgtgaatgagcctttggcgcttcatgatcatgcatagtaaaactttttcttcatctacattttattccagaattcttcctcatgaagagggtgtgtccatgttaattaacgggggtaatgtggaatttcatgtaataatactttcctaactactctttgaaaatgtccaggtttgggaaatcagtacataatgtgattaatatcatcaatttgctacaacagcataaaccacataaggctttctctccagatgttggtgtttgtgttatagtttagaagcagctagtcaacagatcgattttgcattatgctttgtgattctgctagacagctgcagatacagttttttagatgacttggtgagcattgttttgtatttcatttctcttctaataattccttcttttatcgaaacacacacacacacacacacaattgtagttcacatataatttttgctcacataaaggattcatcagaattgtcttgtttttgtatatagatgtctaaattttattaaattgctgtcctattgaagtacttcaaagtctatttcagtgcttcagaaaagagaaccaataaagcagtccaatagttagggatcaaacttacaagatttgctgtcagcttatctttttcatcattagatcgtttctgccatgctccataccatatgatctgattacaggacatgatttttttttttaacacaaagtgcaaaaaagaaaatagtgaagcaatatatgctcagtgggggaaaaagaactagcactaacacgtaccaacatatgttccatgtaacagagtaattttcagtgacacatttcattaaaaaaagaagagtagccagctcattaatgcacctgaactgaataatgttaatgatctgaaaaactcaagtgggttggtcgtcttggttccaagaaaaaatttcagctaaataatattaggaattagaatttgtgtttctaattttaggaaaatgctcactgtagattagccacatgataaactactttaacacattaactacgagttgatgacatatttaaccatcactgatgctagactatcacggaggtatgaaacaaagaaattctcatctacaaaatattagaaatattacaaaaggaaattatgtggaataggaaaaagaaagctaaaagcaacaattgatgctatatattttgtccttatgttgtgtctactttgaagccagtcatatctaaaaatcattactaattttggtgcaatcttcccgttatggctatcccagtcaaacaatacttgcattacaatttaacagaagaaaaaagggatttcataagtttatcagcaaaatttcaagcatctaaaaggaaaagaaagaacatactcttgagaattgagattagagataatttaagagaaaattttcaaaactaaatgacaaaatttaaaattagagaaaggaaagaagaacttaccatatttccatgtatgctcctaaatatagagctttgtacacaaccaagattctgagtgagtaaggaaaactgttgcagtccatgaacaagatggtcgacaattactacagttggcttgaaaacatagaagcttatttccaaatctttgttgttaaaatccagagagcatgtcatccttttctttatgactctaaattctcttctgcactacaaacactatttatgttttatttgaaaggctacaaatactgttctgtctgtgaaatttgtcaaacacgagtcgtgaagcacaacacacgcattctcaaaacttaatcaatgccaaggttgcttcctagaatttgttccaaatattgaatttcggtgtagagcagttcagttggctatttcgttttgctttgccagaaactaccaaatatatttaaatataaggtgacttggaacttggaattatacattcacatgtgtttgacttattcaagatgcttactttattgtaccaaaacacagatttttatctctaacttgtagaattttttaagattgtgtctttaatgagagtttaacttttatttaagaatggcttatgaaataaaagaataaaaaaattaattcaagttcgaatctttactgcacaattacgtcaaatatttgaaaaaataattttattatttaaattaaaatagtttgactaactcaaataagattatctctttcttagaaaatgtaccatttttttttattgtattaaatagaatttggttagtgtgcatcaatggtattcctcacttcacagtaaatactaattcctattgagttagagaaataattgaaatgaggaccatctttctcaataaataatgtataggttttattttttattctttaataagtggtccatttataataactaatgctaaacatatggcaatatataatttatagatagtaaaaaatattttaaaataccaacaaatttaaattatatctttctaactttcaacttgaaaaatgatcctttttaatatctgaaaagctcgagtcaagatgttaatcaagtgataaaattaataaatgaccaaaatttatatttatgacaaataattatttcgactcggtaactggtggtttttttttttttttnnnnnnnnnnaagaataaaaaaattaattcaagttcgaatctttactgcacaattacgtcaaatatttgaaaaaataattttattatttaaattaaaatagtttgactaactcaaataagattatctctttcttagaaaatgtaccatttttttttattgtattaaatagaatttggttagtgtgcatcaatggtattcctcacttcacagtaaatactaattcctattgagttagagaaataattgaaatgaggaccatctttctcaataaataatgtataggttttattttttattctttaataagtggtccatttataataactaatgctaaacatatggcaatatataatttatagatagtaaaaaatattttaaaataccaacaaatttaaattatatctttctaactttcaacttgaaaaatgatcctttttaatatctgaaaagctcgagtcaagatgttaatcaagtgataaaattaataaatgaccaaaatttatatttatgacaaataattatttcgactcggtaactggtggttttttttttttttttnatctgaaaagctcgagtcaagatgttaatcaagtcataaaattaataaatgaccaataatttatatttatgacaaataattatttcgactcggtaactggtggttttttattattttttggtagttgaaaataaaatatttagtcttttttttttttttttgaacgaatatgtaccttttgacacgttcaggtctacgtgaaatgttcatgctttaactataaacacatataaggcaaccacttaattaaatgctggtgtgggtcaaatcgaacttgaatgcgtattgtcttttcggttttgagtgagagcgagcgagacaaggtcacaaagaaaaacatattttaatatttcattaaaaaaacaaatttaatatttcataaaacttattaaataaaaaattaaatacatttacatttaaaaaaataacaatttaatattaccttaaattattgaaagggagacacaagccgaaattcgaagactacgttcacgagttgctgttcattgtagacccacaccagttcctcacgtgtaaacgttatggaggcgttaatacttaatataataggtcacacgcatgccatccaaaatcagtcaacacgcctaatagaccacaaatatcttggccactagattttaatgttgattaaattagtttttttcttttaattttttttagatttgatttattattctaatttttaaaattaattcaatatatattacagtctatattaaattaacatgtcaagaaaacgtattttgtaacaaattaaaattaaaactaccactaaatacttttaaattacctcaaaacatatatttcctaaaactgttaatttaatttagaaaataagagcaaattaaatcaatttttaaaattagaagactaaattgaatctaaaaacaaattaaaagaccaaattaaatataaacaataaattaaaggaaaaaaactaatttaatctttaatatttttagcctcataacttttccacctaggttatgtttaaacgttttacagaatggaatggacgaatgtaattaacaactaattgtctttctccatcttgattaagaacgggaaagaattttatacgtagatcttcaatataattttcaagaatttttattttatactatataacaaaattatagggtgaaataataattgaagtttttaaaatgaaatcaaaatcattcttcctcgttacacttattaaggcgaataaaattgcgagtttggcaaatagttatccacacagtaccttcacatgacattatgaccccattccaccacaaaaattaacaatgaaattgaaatacctccccaactagattggagttttttcctttctcctcaactatattaaattgctgtctaatttgttttcagcatcgggttgtagattacttcttcgtatacaacttcaaaaagtttaattagaaaaatagggaatccaccacaacaggaaatcatcctttctcttacatagaactaaaaatgtcttaatttttgggtaaaaatatggattcatcagattgttgtaggatcaaatgataatcttaaaaaattatttcagtgttctccaacctaaccaagatcaacagtatggtaatattctcacgctcattaccctgcaaggacacgagaatcaatttttcattgaaatacaaacatgatccacaggaaaaggtattgggggacgagacaaagtatcacatgtctatggccaagtatgacttaaggtgaccttgtttaaggagatcaggaaaatagtttgaagaaaaagaaaacaaaaatagaaggtaacaatattcagaaatgtgataatttaggaaatgcaccctcgaagaagggtgagacctcaaacgcaatgcatgatactgatcatagtgaagagttcatagtctgtatgtgctacttttgatgagactcagattcaggtccatgagtattaccttactataagtttatgggcactctcaaaccatcgtgagcaagctgcaccaatagtccttccctaagcacaattatagaagaataaactccgtaatttgctaaaatccataacataccactgagtacaagcaacaaaggtaaatacttgaacaacattcacatagtgtaccttctggaccagtccattaaaaactcattgtccttgtggtgatcaaactcgtgagtcattccaatcaatagggtttgctttggacataacctcttcacagtttcaagagcctaaattacaaccaatgagactttgccatcagagacataacaagcctgaacataattttgtaaaaagcagaactaacctgtggaagacaaaagtgaacattatgcgatccagtctgtggtaacataaagaggaatatcaagaacactactatctttgagaaaataaagaaataagaaaactaaaaaatggaattgagaaatatgtattagaaaaggcaagaggcagaatagtcaatcaaatatgaaccttaaaaaatgtcaaaatgaagtcaaccatatgcttttgagaaaatttcagaaaataagagctgactaagaaccactttcagtgactgccagccggcaatattctatgctaggagagagttagaggaactgataaattgataaccagactgaatgaaataatacaacatagtggagtcactttaaaaaaaataatctatctgagatatttctacgtgagtgtaagtgcattgtcctttacacatgagaatagccttattcacttagtggcatataccacgcagactgagtgaccaacaacagttgaaaatgaagcactgacctttttcagcgtatccaatataagaagatccaactgtccagccccacttttcgaaatgactgtagaaaataggacattttgcctgtcagaaagccattctctgtagggttttataatgatgtataaattcttcaaaaacttctcattatgcaaactgccttcctatgaggaagacaaggctattcaaggtattcagcagttcaatggctttgtttatggttaagtaaatagtgcttactgcttcttcttgatgacataacatccatgagacattgaggttactttttcaggtctgaaaactaaattttagctgatatttgccgagttgaataaatcaatatcaaaatactttctttacagtttacagagtaacttgttagttatttttttataaccttgtggttaacatcacactttctctcttaacttactagttggtagtcactagcatgagatgagagataattgaaaaacaaaaccctcccaattgtgactctctcacttaacacttgacataaaagagatggataacatattagcattgggtataaaaggtagaagtagttggtgatggtcttaactcttaactatagagaacaaagttccacaatgaaggatagctgaagcctcctcatcaaagaattgcagggtaatactcatcataagaaatttggaatctttatattaggacataagtatagttgcttgtgccataaactatgcagttatgtctatcttttatttacaaaaaagacataacaatgtgacatgctgcacacaacatcaaaagatagatagaaaagttttaaattctaatttcaaactaattaactaagacatatacttattgcacatgaataactttaaagtttggttaaagagaagaaaagaaataaatttttctctgtttttatagaaaaatgagaggaaagaaaatgctattgtataaaataacctatatacccttattataatataaaggaaaagaaatgtgtattaatactccttttgccaaattctctccaatcaaatgaagtttacgagttaccactgatgaagtaacacacatgtttaagtaggaagaaatgacttcaaaactcaccatactctgtactagctggaatccgtgaaacatcagatatataagccaccctatttttctcaccaaaaaggaaacccaaacagatataatcctctccatgcattacctacatacaaaaatgtagcgcttaattccttataatgtctaaaaggggtattgcattcctaccatcaatgacaaggtttgcggtgattaactggcaaaggaataaattttaagcctgacgcagaaaatggctgattacaatcatcagcaattatgttccagcaacactgagctacccttcgtatttcttgcccttctttgtgtttcttctgaaccaaataaggaaacaccttttccatgctgttgcaaatgtgtaaacaagaaatcaactatcttaagcaaactggatcaataaaatcaagtgaaaggggaataaagctgacataagatttgcactgtaatcagaaatatttttctaatcatacaagcacccaaatttgatggttggaatgtaggtcaatagagtaccttttaacttcctgaccaaaaagtgatacaaattttagcttattagtattaacaaattttgcatcaattcacttctatatagcaaaaaactctgtttatcaatgcttccttagagctcttactttaacaaagaaaagcaaaatataataagacaacacctatgctcccacttgggtgccaattttcccactaatctaggatatttgagcagctggcatcaaagaaaaagggaaagttagtagagtttacctatccattgaatgctgagttaagtaaatgggggtgggatcaatatcattagtgggactaaacggctgcacagctcgtatatcatccaatccaaggactgcatcagcatgttcatgagtcaaaagaatctgcaattcaaacaagaacaaactaacttaatacaccaggtaaactattaccaaatcaagctccatctgcaacaaaacaaggcacctgaacacatacaaagtttcactcatatcgaatctaagttttgaaaatctttgaccaaaataataaaataataaagaaggagatataaggttgggtgattgaaagaagggaaggagggaaaggtcccgggtttctttcttgctaacaaaaaaaaaaaataataataataaagaaagaagggaaggtgagtgggtgactaacagaatctattcttggaatgtgatggaaaacaaaccacctaagtacagtctccctgaaggtcttgccagcgtcgatcaatatatatttgtgagtggcgtcgctttgagagtaataatcgattaacagagaggtattgcacctgcaaagttaagtcaataatgaaagagctcaattcagtcactaatttgtaagtatggaggaatgggaaatgtgaagggaacctgtagttagggtttaggtgaggtgggagggagagagattgagtgcagacaggacatggagggtctgaagggtcgatgaggcacctcatcgagggaaccgttcctgaaactcccgttcccagaaatatcaatgccgactccatagccacaacacaacactaacggaaaatgtaacaaaaatgtttggacgaaccaacactagagatcaagtcatgtatctttcataaaaaataattctggtctttaatacaattttatactcaagattctaattcagacttgacattttttgattaagttaaaagaatcttatgtcacacactcgatgatattttcagtaacacagaaaattgaaaaggagaattgtaataaataaataatttatataaagtaattttaagattaattaaaaaatgaaaattttattattattattagtattttctaaatataaaattatttctaaatataaataaattattgttccagaaattaaaaaataacaaatcatacctcatgccaatttaaggggagggaggaagtattttttgacgaatctcacaaaaatactcacttctaagtagcagtagtcattgagattaaaaaaatgttaaataaattattaaaattggaatttgttagtcatattgttctgttagtaagttatacatgtcacatgccagaatgacaataattttaattttaagaatttatttgatattttcttgatttgaaggactattataatttataacaacacttcatagatttcggaattaaaatgatagttttttcaatttttttacttcaaaaacttttcctgccttaaacttgaatatcatcttcagtccctaaattttactcttaaaacaaaaaatagctccctttattattgtttttttttcaaacaaaatgtagaaacttgatatttttactatttgattgaaggtattgatcagtccacaatttatcaatgcaaactttacaacggaaaagtgttcatagacatccaatatgtcattatatacctaatgagaaatagagaaaaatataggtatcatagatattttaatgtgatatgatgaaagagataaagagaaactatggatattgattatgtatttaaaaagtacaagtgtgtgttacttttgatgagaaaaagggagattcatgtccacaagtattaccttactataagtttatgggaactctcaaaccatcgtgagcaagctgaactgatagtccttccctaagcacaatcatagaagaataaagtctgtaatattctaaaattcataacataacagagtacaaactacaaaggtagtaaatattttaaccaccttcacatagtactgttaatactggtgtcgtgattcaaatatattacctattgcatttttagcagttaaagttgacttccttgaaaaatgggaagtgtaccttttggaccaccccattaaaagctcattgtccttgtggtgatcaaacttgtaattcattccaatcaatagggtttactttggatgacctctttacagtttcgagagtctctgaaattacaaataatgctatttcaccatcagtttgaaaaatgcggaactaaacctgtggaagacaaaagtgaacgttaggtgatccagtctgtagtaatgcaaagacgaatatcaagaagtaaacaactatcttttgagaaaataagataagtataaaatagaattgacaaatatgtatcacaaaaggccagactgaggatgatcaatcaaataaggtgaagcttcacaatcatgggacaacaatgatgatgcatcttgcaaaaaacaagtgtagaaaaaatcaaacagaattgtttgttgacgattgagagaacaacaggaataacgagcagaattgtccattcagaaattgatgaaaacaagtttcaacttcaacttcaaaagctgataaagcaatgaattattggggagaaaacattgtttccaaatcattccgctacaaataatcgatttacatttattctgacatgtcttttttgctgaatctatctttacgcgtaacttaaagaacaaaaactggatactaaagtttaattgttacatccaatagattttatcttaataggagtagtgtttagtaatcgtattattggcctttcacgataaagtttgttgagatctcacgtcgacttgatatatcactaatgtagtctttatgtagggttgagttaggttttaagactaaattctaagatggtatttaaatctattgtagatttgttattaggacactcatatttgtctatgctgtcaatgtctattactactcatgtgcaggtattgttattgagccattcgcatttgacctcactctatatgtctcgccctaggtgtgaagggtatgttgagatcttacatcaattagaaataagaccagtgtaatccgtccttataaggcttgggcagttttcaccttacaagccgattttgtgaagtttagttaggctctaagtacaaattctaaaatagttatcttacttgtgaacaagatgttttgtttgtcttattaaaaaatcaatggggaaacttactataggagacagaacgcttaagtcattctgtaaaacaattgacaaaagaatgaatcatatcaagccatacaaatgaagatctgacgaagaaccactttaagtgactgctagtagcaaaatcctacgctaggaattgagaaattgaaaggaccagactgaaagatataatgcaacacagtgaagtcactttattaaaaaatttgtatgagattcttctacacgcgagtgcaagtggcaagtgcattcttatcctttgcaattcagtggcagaattcacacattcacctggaatacaatatccacactccataccccacacatccactgacaacaattgaaaatggaagcacttaacttttccaacgcatccaatataagaagatccaactgtccagtcccgcttcttgaaatgactgtagacaattttgctgttagatgttacaaagcacacttctgatagggttttataatgatgcattaatgcttcaaaacgactcattatgctagctacattcctattgtttcaatgaggaagacaaggctacaaattcaagctattcagcagctatggctttgtttacagttaagtaaataatgcttacttactgcttcttcatgatataacatccatgagaactgaattaatttttcaggtatgatactaaattatggttgatctttgatgagttgcataaacaaatattgaaataatttctttaaatgagtaatttgttagttattttcttataaccttgtggttaatatcacacttccctcttaacttactaatcagtagtcagtagtcactagcattagatgggagatagtttgaaaacaaaatctgctcaattgtgactctcttacttatcacttgactgaaaagaaatggataacattgggtatagtaggttgaactattgaagtagttcgctatgctcttaaatttagagaacattaagttccacaatgccttaaattataataccttagtattttctctgactattatagtcgtttgtggcatacactatgcagttatgtcgctcttttgtttacaaaaacacatgacaataatgtgcatttctgggtgtaattataatttcataacaccatctccccctccctccactttttttattttttattttttattttttttatgcaagttaaaaacacaaaaaaaagcccattttctcatctatattctttcttcacaatccaatccaataaagtttatgttatgagagataataacactaatgaagtaacacacatgtccaagtaggaagaaatgactttaaaacgcactatactctgtactatctggaattaatgaaacataagatatataagccaccctatttttctcaccaaaaagaaatcccaaacggatataatcctctccatgcattacctacaaccataaatgtatcacttaagtcatcataaagtaaaagggttattgcattcctaccaccaatgacaagttttgcagtgaataacgggcaaaggaatcaattttgagcctgatgcaaaaaatggctgattacaatcatcagcaattatgttccagcaaaactgagatacccttcgtatttcttgtgcttcttctttgtgttttttctgaaccaaataaggaaacctcttttcgatgcttttgcaaatgtgtaaacaagaaatcaattttctaaagcaaaatggatccataaaggcaagggaaagggaaataatgctgacataaaatttgcattgtaatcagaaatattgtctaagtatacaagcacccaacatttgatggttaagaagaacacataacacgtgttttcatcttaataactcatgcacccgcaactactctcattttagagtattttcagaaagtgtaatttaattgagttcttgtaaataactgcgatgtgataacaacatgagttaaatcatcaaatgctgaaacttaaaattgaagagctatgcagatcaatagagtaccttttaacttactgaccaaaaaagtgataccattttttgcttaatagaatcaatgagatgtattttgagtcaattgactgtatagcaaaaaaaaaaaaacgcgtttaacaatattctctaagttcatctagtgtatatgctttcttaaagctcttaatttcacaaaataaagcaaaatataattacacaacacatatgctcccactaggatatttgacctgctcactctgcatttgagcatgactctgttactttgggtcactgtagagcacatttaacttgtaaaacttttaagtgacatttctgtaggtctaaagaataaagaaagtagtgcatcagcatgaaatttcaactttatcagacaagttaaataaaataaaaaggtaagtttactagagtttacctatccattgaatggagacttaagtaaacgggggtgggatcaatatcattagtgggactaaacggctgcacaacaagcatatcatccaatccaaggaccgcatcagcatgttcatgagtcaatgcaacacaagcaagcactatctagtttattacactaaataactattaccaaatctaaatttgaaaaatttaaccaataaataaaaaataaaatagtaaagaaacaagggaagttgagtgactaacagaatctactctaggaatgcgatgaaaaacaaaccacctaagtacaatctccctgaaggtcttgccaacatcaattaatttatatttgtgagtggtcactttgatagttgtaatcgattaatagagagctattgcacctgtaaagttaagtccgtaatctataattattataagaggtataatcccatttcttttggacatttttactctcaactattatatattactataacattttattttaattttcaacaacaactgttatatctttcaaaacaagttacacccaatcttatatatgtaatttccaagtgcagacacgaaatactttttttgcactagtatatataatgtaagacttaattcaaaattagcacaaacgtataatgtgttgtcacgttaatccttgaaactaaagaaattccaaataattttctgaaatttctaattgtttcatctgagttcctcaacttaatcaattattattgttttagtccggaagcatatgtcaatattatcatccaagtcaaacataacattttgaattttggactaattgattgacggattgcaatccagtttgagggactaacgtgacagtactatacactacttaaacgttgtttacttgtttctgaaagcagtgtttgaaaaatgaaaattgtcacataattcattgaaaaatgtatttcatgggtgaaattagtatgcgtgtggctactgcgttcactcgtagtcgtagacgagctagatcgttaaaatgcatatttaagcgacttatgtgttaatttttatgctagagttgaggagaggactaatactaattttccgtgacactgagagtgaagaagaagcaagaacttgtagttaggattgaggtgaggtgggagggaaagagagtaagcgcatacaggacatggagtcatggaggatctgaagggtcaacgaggcacctcatgcaagaaaccgaacccgaacttcccgttcccagaaacatcaatgctgattccattgtcacaacacaatacaagcagttaagtgagtaacgtaggagggaaggaagagctcaagagaactcattttaatacatatatagcctttaatttgaatatctctctcttcacacgtagaatataggacacaaaacaattcatattttacgtgaaatcctgcattttattttattttatttatgaacaagttcaaacaaggactctgtttaaacatatctatatttgccattgtataaacgaactgtaatttaatttataagatatgtaaagaaaaatatattatgaagatggcgtacgtatgttatgggcggtccactgatcaaatcgccccacattttaggacaacaaaacataattaaaagtaacaaaagatgattattatatatatatttattgtagactaaaagtttaggtgaatttgcttctaggaatttattaggattaggataaggtttatcaaacttttgtataagtatttataaattatccattaataagttctttacatcaattgcgaaattcaaacttatatctctgtgggatgagtatgatgcttattattcattactaaggttataagcacaacttgattagcattagagccaagtcaaaaaaactgaaacaacacgttgattgttgagcaaatagaatcggaaccaatgagaagagcacattaaaaaccaaaaattgaacaaaacgtacggataaccgaggaggaggaagagaataataaaagataagcatatctggtagagatgagcccggggtaaaggaaacggtggcagtagattgcgacttggggggagttgcaaacaaaagaaaaaagtaaagattaatgtttgtgacgagattttaaatacgttttccagttaattcaaatgaaaaatttataattttatgtccttaaggtgaagtttgaaacacgttaaaataatatacgatgcaacataaaacaaattatattttatttttggcatatttgaaaacagaacaaaatatggcacgagattagaagttttcttggtacgatatatatatatttttttgtacaaggagacttagaagttaggtggatatatttgagttttacttaagaaaaggtaaaattaaaacaaaaaggaacaaaacacaacattcttattttgtgttgtgcatgtgtcaaatattaagtttgtagaacatgattcttaaaataacatgtttcaaatagcatacatttaaaatattatatcatatttaatattatttttagaaaaccaagagaccagctcatacaaatccgtatttaaaacattatatgatatttaatattacataatttcatcagccaactgaattaaattctttcaatatttttttaaattctaatatcagttagttaaacaactttcaattttgtgtcattttcttttacatttcattgacactcatgttttttttttgttagtcgtcctttttcataacatcacccattataccacttaagagatataagatttatttaatgacaaaagagaagacttaagaatattgttggtttgaatctttcacttatatttctaacaaactaacatataatataaaaaagtccatcatatcacttacttatttataaacaatcactccccaatataagattatctaatggtttgattttcatatgtacctagatttattggtccaacctaaccttactttgagtcggtcgaaggagcggtgctcaaactgtggctgtaaaatcaataccaaaacaattaatcatgatggtggtaaccagctaaaaaccatttatataaagcacatgcacttcatgccacgatgaagcaagaccacattctacttgcaagattaaccaataagcagttgtaagggaggtagtggcatggtaggatataggcataagatccctaaatggattagttttgaggaatcttgtagggcagatgctagtgcatgttcactttccagtgtcacatgagaagatggaaatggggccaggatctagcttttggtgattgaacaagaatggcatgcgcgaacctttgtatcaatatgcaacattgaatgttaggctggtggggatataatatatatatatatatatatatatatatatatatatatagttttgaagagataaattcacaatgtgcttcctaccccaaaattgtgtggtttgccattcagtagaatttaatttgattacatgcatgttacgtacgaccttgttgtaatttcaactaaaaagaagaaatgaaagaacggaaaggtgtgaaagactaatgatttaagagaaatgcatgcaagctttgacttgcttttgctattttgcacagaggacatgcatggtgaaggtggttttacttttcacatgcaaaggcaacaagaaacggtttgtgtttgcctaagggcagaactgccaatgattttgcttctttatttccccccctcatttgtttaatcatataaatttaggagaagtaagatgctctaccttgtttcatatatatcacttagggttaactagtaaaatgaattgaaaggaaatcatcactttcaaaaatctgtatatataatttcatccggccggtcatacacattgattgcttgttctcaaagcgctaaagggaaatattaacaactcgttatctaacacatttattcaaaattataaaattttatgagttgtatttcatttttaataaattatactaataattttataattttaatcaaaccatagagaatatgttaaaaggaatgtgtacgttgccacactcctcatatatagtgcatgttatactactttccagtttaggaaatcaagattatatgaaataaaaaaaaaagaagagaccctccattctatatccaagaggtcaaagtaaaacactacttcacgtgagtgactattaattctatggggaaacttttatgatcaatattgtcaaccgatatcatacctatctgaaaccactatacaaaataagaaatccaagtttcattatgaagtagcgaattactttaagattatcaaacatctatacggtacccaaaaaaaacatctcttataaaaataatttctaattttatatttttcaactgccagctgattggtgcttgaaaatcaattcacttcatgattgagaaatacgaggggacaaaacacataattagtgaactcaaggcattcaatccaaaaccttaatataattaagttaggtttgtgttttttttttatagttatatgttacttaacttgttaatttctattaaacgtaagataggtagataccttttgatggatcaaatcaaaccttactctcatggaaacccaagaaacaaaatatcttaagtatattattcgacagttattggttcttgaattgaaaagtacttgaaaatgaggcatcaacaacaaaattcatcctgaacagttctcgatctgtcgtacgtagaacgtacaccgatagatcagttttcttgttcctcatttaagtattcgactacaacgtctagatataatactatattcatatgttctaatcagttatctcttgaaatagttaaaggcataatgacactctcatttgatgttgaatacgaggaagacgttgcaatattacatagtagaacattgtgtttaaatcatagcaatactacagtgcttcctgtctatacttatcttgtcggaaatatcttttatatatatatatatatatatatatatatatataaagggatcaaattaaactggtttaattttaacaactattatatcatttttataatttaatatacaatatgacttttattgattttaagttaaattatatctatatattatcaagatttttttttgtgttaaattttatcaaaattaaatagtaataaaaaggtaattaaatgatctatattttaatatattttgaaatatttatattatatcaattttaatatatataaacgagataacaaataaatttagattaatatgaaattttacatatataatcaatgtgaaagaaactttcaattcaaatatgagttttaaaaaaatattatctaattaaaagttataaaaaaatataataattattagaattctataaatataaatatgataaagataaagttactgaattttagctaaatctactcttttctctttcctttgaaagttggcactatctatggatatatcagttaaatctacaattctacacttccttggaagtttggcacacgcctgattatatgtcctgtggatagtatggtaaaagaattgaatagatgtgattgacttagaaattctaaaatggaaaaactgagagaaggaaaaaagaaacactaattttaattaactgtaaaaatgtgttttttttttttgagaaaaaattgattggttaatacctaataggtacccagtcatatctcaaatcagaactaattttagtagcgtgataccaaatcgtgtatccttttttaaaaataattttaacaagtatctaagtgcatttacaggtaccaataagaattgagatcacctttttcgtgtctcactgcttgtctctctaattaaaacttgtcatttcaattaaaaattactacatgtaggatttggaatcttctcaatacttctttcgcactataaaagcgcacacacccaatacgttcttcgccatctactcctaggtcaaagcaccgtccaccacaacaaaacactgatttatagtagcgagccactaataattaatgatcatgagaccgtcataaaatgatattaaattgaaaagtaaaagagtgatttttgtagttttaaatttaaaatttagtattagtaactactctatcttttatttgttcaaatattacgcgatacgatcaaaatcataacttatcttcgaccaagaatcatggagatagaatgacattgaagactattataaaaacaaccctcaacctagagagcatatatacatgtcacacacatttgaatgctctggttaagtctcccaaaccttagaaaaacttatatgagaaaaatattgaagtatactttaatcattgaaaatattagcatcgtactcatcaacacattttttatttattaatgctgtttgaaagacaaagataacttgatagacgatcaaataaaagaaatactaaaaaatatagatacgtcagatatttttaaggtataacttttatcttacacttaatatatacactcaaattcgtaactcttgatatggaaacctattgataatcataaaattatatgaatattttccctattttaataagttttatttatattttctaattttaattatctataaagaatgtggtaaaagaatattttactgtcaacaaaaattaatccatttgaaaaagattagactcattccataaagatatagtttgaatccaattgtcaatataaaggtcatgttagaaatcaatctataagtattttttaaacctttaagatatgttttatttcttgtgagattctgaaattcaagtacctagaattttgtctacaaaaaaagtattttctaattcctctcactaaataatggaaactgagaagtcaagcttacgtatcactcttgcacgttgatattgcatttaaacgaccaattacaatataatggagaaagaaaaggacacaataaaaattgaacaccataatcatttaggccactcggttagttgttggtagtcttgcatcacctcagctaaaaatcaaaagtataatgattatgatctctaaatggaataagtaaagggtgaggctgatctcaaatcaacttaaggcatgcattgtccccttttgaggcatcaatcatccttccactcgtccactttttgtttacttttttcttcttcagctatatacataaatccacagttctgacattttcagccaatcccccaattaaaagcaataattagtgacaacaatgttctaagggtactagcttgtttacccatgcttctttttttcccttgaattatttttatccgcatattcttttccccaagttcaaaataatacactccaaaacaatggcttgacaaactcgatttggggcatgacgacaaccgaaagggtaacacagaatcgcatgtcccacagaaaaagaaattcaaaagcatggtgcgaaaaggaggaaaagaaaacacaaccctcattatgatgtctgtggggacttcaattccagcataagcatctttccaggaaaggaaagcaattctatcccaccatgcattttcccttcaattatcacacaccatttgagagaaagcaaaaacaatcgtaggatgtaaacaaaattaattttgagtattaattaacctttttttttacaaattatttctatccatcagttttcagtaagtaaattttgagcttatttttattgaatataaaatatttttacacattttgtatttttttaacatatttaattaattatagatcatattaaatgtttttaattcgcagaattgatacaataatacaagatcttattaccgtattaacagtctatctaatatgaaaattatgttcaatttcattcttatgtacacaccataatcatgattaatcttttgatcccaacaagttacacaacacacatagtgtttaaagacccaacacaaaaaaatattaaatgtcttttattgaaaaaataagactctactaaaaaataattaaccaaattcatcaacaaaacttaattattggcaaatttacatctataacatgataaaagcacacacaaacattttatataaacttgaatgaaaaagacttagtatgccatacaattaccttttaacatctctataaataatgtgaaaagtataaaagtgaaaaaaaaaaaaacgtcgtagtaggaaaaaaagagtgtaaaagtcaatcaatgtctttttcacaaatcactttatttcttcagactttctttttaaaaaatttgtgcgtgcattgctctttcaactatcactctatatattagcgtaagctccatacatcaaacaatcataataattaaaaacaaagcacacgctacacattgtgttttccggtgattattccggcaactgcatgcaccggtgaacgacgccggaaatggacgagtcacagagaattggcatcggcttaatgcgtagtttccctagccggagatcggtcgaggaccggtcatcatctcggcggcgacgctccatcttctccggcccgggcatttcggaatctgtggacgccgacgactttgccgacgtctttggtggcccacctcgaactctccttgcgcacaaactctctagctccgggtcgttttacgaggaagttttccggccgccggagttcacgtgtccggcgccgaagggtggccggagcttgccggtgttcaggattccggcgaggaatgagggattttacagcgacatattcgggtcggacgatgaccggagatcgagagagaggtcgaggtctctgtcgaaagagaattcgtcatcggcgatgagttcggaggagataagccctcgccggccggcgattggagatgacgtggcactgtctggttttgcttcaaagctaaggtacttttaacagttgagagaatgagagagtcacccactgagaactcaactgtttttttttaacaattttacatttatgtccttgattattagttatatttgcataactatctccttcttgatgcatgcagttcaaccaaccgtgttagccaaattaattttgatttaaattgatgtaatttatgtttaaatatttttattacaaaagtaagttaagtagtaaaattcagtctaactttttggatgcaatgcaaaagttattaaagttattttaacctgtaatcaactatgaattccgaatcaattgttttaacgataaactattgaaaattcacccagaatcatgttaataggtatttcaacgtcatttatggagaatcgaatgtgaaacaaaacactgcattgagtgcatgtttgtatatgatagagtctaaaagcttttttacttaaagtaatattttttcttttttcttttatatattgaaattaggaattgcatgttgaaattcataagaatagttttttaattttaatccaaacaggccaatcaatattccatggagatggaactcatccactgtgatgcctgaggctgaggaatacccaagtaaacttggggtgcctctttttgcatgcaaggatcagtcatttgaaattcagcatcaggacaatgaatacaaggaaaacttcagaagcccccatttaggatcctcaagaagagtgtcatccccagaaaccattagtctcgaatccaattcatatcaaagcatcaaagtgtccactgatgactgggagcttaattcctcattttctgttgtctcttcgctttatcaagaacctgatgcaaaattttcagtgcatgatcatgtgctttcagaacaaattatagaaggtgatgatgatgacgatgacaacgatgatgaaattatgaactcctatgtcattgaactcaaccccaacctcagaagggaagagtgtggagaatcagccattgatgaagcaattgcgtgggccaaagagaagtttcaatcacgaagctctgatgaagaatcaagcgtgagaaactatggcaaagagaaaactgttggaataggtgattgtcttggctaataaaaagttccatacaaagttaacatgttgtagtcttgaaacaggcaatagcagacacttatgtttgtatcgtatgttgcaggaagctctgatgcaagtgaataccatgatgatggaattggaatagttcaaactcaggaggtaatatattggataagcctaaataagtatcagcatatcatatcatataactgatacaagcttaatcagatcttttatgaaaataaatgtttgaaatatgatgttgtaaaattgtgtgattaaaattgtgtgagtaaaaatgagtaaatgaatttccaccaaaaattacatgtattttctgaagcagtcaatagttccataccttgtaaaggcagtggctcgtattagtgttttcctttgttattttatttctatttcctcagaataaaaagtttatcgatacctgtgctttttctacagaagcaacagacagaaacagagaagttagacagagatataagattgtggtcatctggcaaggaaacagatattaggttattactttcaacactacatcatgtaagattttctttgttgatgatttcttatgactgaatttctgaaatctaatgttttattcgccatttgagtatacagataacacaggagaattgacctggttatattttttttcatttccagattcttaggcctgagagtggctggtatgctattcctcttaagagtctattagaatgctcacaggtgaagaaggcttatcagaaagcaaggttatgcctgcatccagacaaactgcaacaaagaggagcaacactccttcagaagtatgtagcagagaaggctttctcgattcttcaggtgtgtgaaatttatagaccatttatggataaattctacttctattaccattaagtttttttgagacaataaagaatgcactgaggatcaacgctgattttcaagtttacaatgaaacaggatgcatgggctgcattcatttccatagacgtttccttctaaccagtagatgactctaatcttgataactcagttttgtcttgagatttgtggacaaacaccaagcttgacattcggaatgtcgggagtgttggttgacaagcagcagatatagctaaatacatgaaactttaaaccatcagctcttttgtacaaatagttttactgatggatctgctgttttatttatgtttgtaacataacttcataagctgtttgttgcatgggtaggtattatttctgatgtagttaacagaaggtaatttgactggtcttagtatttgatttgtatatgatatgacatggaagcaagagttagtttgtatatgattcatatggaaacctataaccctattgcaactccatctcattgactacatgtcatactcaagaggtttcaatctcctacattttattaggaaaagaaaaactattcaatacccaatattaacacatgtaaatgcaattaatagaaattatttttaaaaaaaaaattataactacaatgtctcaaattcaatgcaattataaaattataactatatgaaacacaaggtggatatccttacatctaattgagttttatttgaattatttcccaatcaacataaggcctcattagcctttcaactataaccataactagtttaaatagagaaaagagtcctgcaagagtttgtgcataagtgggtggctttcaagcagccttttgggcttatcagttggcattcacagggttgctgtgggttgttcggaattagaaggaagtgaaggataataggaatagaagacgaaagaaaagacagaaaagagtctaaaagcaacggctcgtgcaactggcgttgtagacggaaaataggagtgagactgtcatgccattgcgggatgacacgttcatgtttgtttttgaatttgacatatatgatcacctcagtaatgaaatgacgaaattcacatttatttagcagtaaaaaaatgtacaccatttgaaatttaaacagaagggaaattttttaagaaaattctaatttaacacattactaaagggccaaaggcctagacacaattccgccataaaaggaatttccagtatttacaatttttaatttaatgctcaaattacacgtctttgaagcaaataaatagtttgataaaaaaaaactattattgattggcaacacagaatgatgcaagatccccgttctgctgaacaaccggtttccattgtggcattagcatgtgaaaaagtcggggaaaagcaaacatgtctgctacaatctcactgaactttaagcaagggaaactgaaatatataagcataccacgtatagtttggttaaatacgcctctataatcctgcaaaagctaggacaacaaaaacagttagagaaagcagggcaaagcaaagtttgagttgaaaaaatagccatttaactcttctaaagtaaagaagggttcatccacctttgatttaaggtgagtaaagtttatgaaaaatgtcaagacttaattatcaatttgatctccaaatttttaaaagctctaatttggtccttcagatctaaaaacacacatcaatgggtgttgttgctgcatattccttctattctcattcctggcgctgttggtgctggtaacaaccctagcggtgaagccaaagaagctgcagtttgatctggagcaagttggggggggggggggggggggggggggggnnnnnnnnnnnnnncactgcttcaccctctctcatcattttcctcctcttcgccgccgccaaccccaacaaggtcgcgatcaggtatggccagtctagcttcaccatcatgtaccgcggcatcccattgggcaaagccaccatcctcggcttctgccaacaacttcacagcaccgacgggtcatcaccatcttgtttcccctcctcagatctgcacgtgttttcaaggctggtcgcatctccaatttggtcagagcagagagggatgcaattggagagtaaggagaggatggagacgttgacagcaagcatgtaggccatggtgaggaaagtggcagtgtcggcacggaggtcagtggtgaaggtggagttgcattggggaggaagagaagggaagaagataatgaaggaaaggaaaagaagaaaaaaaatatagtggtggtttttagtcgtcactatttgcaaattaaactgccaggatttgcatcctaactgtgtcagtgtcaatttgatggaaaggacctaactgaggcattttaaaaaaacttgagggtcaaattgaatcttttaaaaacttggggatcaaattgaatcttttaaaataatttagggaccaaattgataattaagccaaacattaaattaaatttatgagtggatacaaccttacttttctcatttcacatgcttattcatttcagaggagccaaatctatgatgtaaagtgacaacactttgtttatcatcaactttttaagatataagtctataacattagccacttacaaggaaatggaaacacacccaatactgaaacaaaatctcagagttgaccatggcttcggctcatagagtggttgcgaaagagtttttgaccaggtgcttgctggtcattctgctgcaagagattcaagccagagaaaatgaactcaaattattcaatgtagggtacacacatttatggattaatttaattacagaaacaaacaacatatgaagaattggatatttgtacacaatttctcctaaagttttctgtcttcctctaccacttttggttgggatgtcttccattttaccttctccaaaagactgatttgaacttatacctaaactaattttaacttataggagaagcttattcatttttttttctaattttcttcttttataagtgcttatggaaaagcttatccaaacaggatcctaatgcatattataagaataaaaaatgcatacacatggaagttggtaaagaaaatctcagtttgtcacctaaaggaacctaaagaaatcttcacacccatcaaacaaagtgagacagacaaaccttgtacaaggatgcagcagactcagacggtactgttggaattgcattgtgccccagcgacaaagcatccaaagcatctaatgtcagctgccaaccgcaaagggcaatttcatcactacttgtgcttggaacagaactagcacagccagcagcagcaacattgccattcacccaagggcaacattgattgtgatgcacaataggatcaaactctgcagcttcatagttactctctccttttggagggcctaaagaattgctcaatgtcagtagctatgctccaaaaatatgtacaactaatgaatgaagtgcaacaggagtacaggcattggaagaaatagatatccattttcaatttgatgctagatgaaaagtagcgacaagagtacatatatactcccatattagaatatatagttggagagtgatactctcactctcacttagacagtcaacattccccgctcttctctcttttggaggtgcatttcacatactacttttgcaactagccaaaaaaaattgtttctcaatgactcaactatctcaaactaccctccttttatcttatatatttgtttctcaatggcaatagtgaaattttaaaaagccacctaggtttcactttttcaaagatttgtaagggaaatggtggacaccaaaacggttgtgttcaccatttcctatacaaataaacaaaaataaagtggcattttagtaattgtttctgaaaacaaaatgttttctcaaataaacaaaccctaagtttcatggtaacatgtcaacaataacacaaaaaaactttgcccactaggtgaagcttgctacatggatcatgcaacacaattgtattctgtcatgaaccaagttttcaaaatctatttagacccaagtctttttatttgtctcacccagagttttttcttgatctttcctacctctcattattggactacctccataatccactctttattgggatttccattgattttcactcacatgaccaaaccactaaagggtgagaagtgagaaccatcttttcgtgctacccctactttctctaatgcatttattcttgatcgacttctgtagcactgacaaggcagggtaacaagaaaaaaagttaaagaccattaaaaatacagaggttacctatcccatttgcaatggcaaaatctgattcagggagagcacgattgttggcaaatgatgatttaccatccttcatgaccccttccttggtattttcacaaccagaataaacattagcattacaagaacgagatgggtgactactattagcaggtagaagattgcagttttgactaatcttttcaccactttcaacagattctgcctttgtagaacagccaatttttgacccactgtctgttcttcctgcagagtgagtcatcatctcctggctatcaccaataggatcttccctgttcatatcagggataatctcatccatgagacctggatctggaacagattcacctgtctgtccctgattttcagcatcttctactctctgttccatttcaccaacaacactatcagctctgtgcacagatatatcagccccatggatctcagcttcatgactagcacacattccaacactccctccactgatgcccaaactaattccatcacgagcctgagcagtcacagtttccgcattgaaaagttcttccccatagtttgtactactgacgcccacatcaccacgtgcaacttcagtagctgtttgtaagcaagtgctttgctgagcttgattgctgttattcagttcagatgtttcattcatgtccacattgccatatatgctagaggaggggaaatgaacatcatcaaggtctccagggtagttttcaacactttccatagaatcaccattcacactatgacatattgtgtccattgcaatgacagatgatgcacgggttgagtccctagctgattggatacccattgggcgttcactaccttgatggtatgaagaaactcgatttccagtaacgtaagcctctaaacccattgaatgacttggaccagcaccagatgaatctcttcgatgaggtgagcaatatgtgtcaaaaatatcagagtcacgtgcacgttttgaaggaccagctgaatattgtccaccatctgtaacttcatcaccatcacgatcaatgacaattccttcaagactatcagcctgctgctgcaacctaagaacaggcggattatctgagcttccacctttttcaagatttctcttacgagagcttggcccatgtgattcatatgaagcggcacgatcaccaatctcgctccctgaaggctgaccgatcattaaatcccttcccatatcatcatgagtatattcagatgtagctgtcctgcccaaaggagtaaaaggaaaacccgctgccatggtaagatttaaatctaaatccgtgttcgccaataatttcccctcatttgttgttgcaacttcgtcacggtcttcagtctgatctttctccgtatcgtcagctgcaatccaaccactgattccactagcagcactcgctccacgggtcaatcctatttttttaccagtatcaggaatatctatactgttagatgcaaaacgagcaggacgaggaactgtcagaaaatctgaaattctaactgtagcgccacacaagctacaatcaagcaaaggtgacctagagtcaagtctagactccttaagaggcgccttttcctttctggcatccaatttagtagaagcagaaactgcctttgacccaggatcttgagtaagatgaagttgagttttggttggcccaaaagaatatccatttctttcagattgggcagagtgttcttcacaatcttgaacatttaaaagccagcttgattcccacccacaaaggctaataagcttctgtgcctgccaaaaggaagatacattaatagaaaataagcatgtgacagagtagcaagcaaagtattaacaagacataaaaaagtaaaaaaagaaaagcttacacgagaatataaacagtatgcctcatcttgagagttttcaagctcagatataatgtctggtttgatatctacttctcctgacataaaattttgagactgtgatagaaagcgttcaatctgtgggccacaagaaacagacatcaactcaattgcagagatggctaccacaggaagacagtcaaattgtacgagtccatcacatctatccttgtagcccccaattaaggcagatggaggagttggagggaactgcactaagctttctggacagctgtttcctttccaagggcagttaactttatgatccaaatccaggtgcctggcaaaggattcactggcattttgagctttggcaatgacaataagaaaacaagttaaaaacaactgatgaatataatcagcaacagcagagaagtcctttagcctagctaccggatacagtttgcttgaaaacaagatcaaaataagattatatttgtctaactctttgaagaaaacatatataaaaagatctcaaatgatttgaacagaataagagtcgcttgaatataaagagtaataacttatcttgtatgcacaacttacatactactttatttttatttttggtaaagtcttgttatacaatacattataggaaccttgaaacaaagtggtacaagtaactaaattacatccattattattatacttacatgctaactggtcttaatgttaaaaacagcgcatccacccacacacacaccctccgcggcccggtaacagacatgagctgaacaccctaatgaaatgaaaaatataatcctttccccataaaatatttcagacgaattggcaaactaatatgtattaaatctcatttgatagacaactaattatacaacatttaggtacacatttttggacatataaaacttcatctaggcagcatcattgcttttaatgttctacttatacactaagtgaggaaggactatatttatgtttggggatttacaagttaacaatagacagtagttctctgaaagtaaagctacacttgtattttcatcctataattttctcaaaaattctccctacttctacatctgccctgtacataaggtacctcaacaaagtacgccttttaacatccacgatccacatgaaagcattggctgttcttataatttctacctccagttattaacatgccacattttagagaaaacataaagtagccaaaagtacttagattacaaatttgcaatcaccaaccttcagctgatgtacaagatggtaatgctgtaaaactcagacaagaaccacatgactcgcaagcaattttgtctacaccattattcatccagcctttctgagcacaagccaatgaactgatgatctggaagaaattaaagaggacatgtgatccctggagactgcatcatattatctacttagaagatttggagtggcaagtgccaattcctcggacaactacttcatgcgaatgtgacagatcccagattaaaattaatttcagtagacaaataagtagaaaattcacatcaccaaacacattcagctggatcacttagtgtcaaagcttagagtgttactatccacacaaatgtaccaaagacataaataactgcacaatgcaacccaaattcagctgtcactattagattacaggctgtaagtagaacctagttttctatttatggtaaaaaagtgatacatgataatgattttgtttacattgtataacaatttaggttcctatcataatctataagcataaacagaaactatcacaagggtaatcattacatgtttaaaacaagcatatgcagtgttgacttcagacatacaagatacaactctttgtcatctaggcttacagaattcattattaagatattgaagtataagtgaatcagtaacatactacccacaaggaaaagatggacaaaaatgtacatatgcacattgtgacagtaatataattacggaaaaccatggtcagttcaaacctgaggcttcacaagccaatttgaaggaataaatgtagccaaacgtcttaataaatctcccctttcccaaggtctacatgaagatcttgaagaaccaaaagcagaaccaccagcacttgtgctcaaggaagtccatggtggttgtgaaccaacacatgagagagaagccgctttagagacctgcccatgacttgacccatctatgctgccaacattcactggaacagctggggatgatgccccagcagaactgataaaattatgaacaatttgtcaattgagagggtcaaataaacaacataaagaatagagaaaacaattgaatgtcttataaaaatatcacaatttacaatcaccagccatacatcacatatgcattaagttcaaatccataaaaaattaaaaaaccatctgttttacatgaatcaaggaaggaggttaattctaaaattgagctttacaaacgcacaatggaaccgaagggtattcacttcagtaggattaagacatcggatatatctattgcaattttagcaagaaaggaacaaaaagaaaatgacttggaactaaagattggagatgtcattaagtatctggatcaatattacaacatgatagagtaattaatgaatttgtcaaacactggatacaagttgagtggttaaatggagaaaggaatgagattatttgtgaccacaaagcacttaccaatcttaaagggaagttttatcatactgctatacgaccagctacatattgtggtagtgaatgttaggctttaaatggccaacaagagaaaaaggtaggaatagcataaatgagtatattaagatggaagtgtggccacacaaaaaaggtcaggatgtggaatatttgtatagggggagatattagtgtgacagctatcaaggaaaaatgacaaaattggataaggtagcttaaacacatgcaaaggtcactagaggctccgaagaggagagtagatcgcagtttttgtccctctgaaaaggggtagagggggatcaaggacattggaaaaaaatattaaaaagaatcaggtagtgaacaatatcctcgaaaatttggtttttaactgagcccaaagacatcatataatccatgtagtgacctcacctagcgagataagactattgctgttgtatctgttttacacaaaggagatatactatggtgacgatttagccctcagtgtgggtatttagtagagaaaacacgcgaggcacccgaaagaaatatttggtaggatagcttatagcctacttacttgcttaggaggttaagctccaaagctttttatccatggaacagaaaatagcataaattatctcttgtgagtctctggttataatggaggcaatagagaagggtttcaggaaaaaggagaagtgtgagatagaaaaggcttgagcaaaatggtagcgacctaagtgatcaatgaatgacacaaataagtatggaagtgtcctttatcacatttgtaattacacgaatcacgtcaaacaaaacaaacacatgcatagtaagggcataagcacaacatttcaaaagcacacaattcgcaacaaaaacagcacgagacaggattttttttttttttttgttaattagatccaattctcgaggtctaggagcagcaacagcaatagtatagcgttttactgttcgattgaagttcaatcgcaagtacaccgcgaaaccgagcagattgaaaacagcggttacagaaatccatgcgaaacgaaaccctaatttgagaagcatgcaattaaacgcttgcgaggaagtgagagagagaaggaaggtgtagttaagttacctggcagcaggtgttggatcaacggtgcctcctgagctgataacctcttccctcatttctcgaattccgaagcatatgaaaatgaaattgaggagtaagtgaagaaacaaagagtggaaatggcagcttcgagcacaagtgtcagagcgcgtggacgccactgcgaatattattttacgatgccaatgcctgcgcctgcattattatttctatgaaaaccaatataataatgttaaatctttctctaacattttttactattaacttttttacttgttaaataaaaatattaaatatatttgtattttaaaattttaaataccactactatattgttttatttaatgtttttataatgtatattatatataatacatgaatatttttaaattaaaaatataaataaatataaaaataaaatatcatctttgttgaataatgttgaaattacatattttaagtataatataaaatgtattctttattaataataaaaatttatttatcacttgaaaataaattaaagaatatgttataaagatctttataaaatgagtgtatttttgttttgggtccctataaaaaaaattatttaatattcatcatcgaaaatttggagtattattatttttttccctaaaattcattttaaggtatataatataaatataagtaatattcagggtttagaataaaaaaatagagatatcttacgttgacatggttctattagttaagcttctattaaacacatgaacagttaacactaacatgtaacaataggaaacaaaaaataattatttcataattttgaggaatgaaaatcaaatatattttttataaggattaaaatcaaaatgtactctctctatacggtgaaagtgtgaaactataaagtaatttctttgaactaaaaatattgaaatttgtgttaatttgtatagagtattgggtttaaatcttattaccttaactctcatcattgtaacgagatcttgatatttaatttaaggtcacataatcttaatatttaattatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatttgatgcacgggtaatattattaaagatttgatatttaaaagtcacataattatgattcaaatatacatatacatttaatacacatcgaccaaaaaataaaaaaattgtgagagctaaaacaaatataagatcctaccagcaaattgctttcctttttaatgtctaaaaatataatctttaactggaaattataaaaagaaaaaaggtatcaatatgcctccacaaattcaattatctacaaggaattctgatagtgtcaaaagaaatcaacctagtatatacttcgaaaaatggccatgaagcttataggccctccgtattacaaaaagtattaaaaaaaaaatagccatgacagagtgcttcaatccattgttcaatgaatcaaaaactgtccactctcagcaacatgaataggcgtatgcataaaggccaattatatgtgagaaacaaattattttgcacttgatgtactcgcacctgcatataaaattgagacatacagcatattagaagttttgttttgttttttttttttcaattatcacacacattcacactaaagttaaaatttatagcattatgcattcttctaaaacctcccatcactaagctgaccctagtccctaggatctagagcacattagaagtttaaatgaagagaaaagaatacttaccaaaaagacaaaaaccattacacagagaaaaaagtaagattcagaaaaacatattactaccaaaaggtccaaaaccatttcatttttgtgtcattatcaaaactgagtaacttaccatctttttctgcgttgacaggctcttctttccaaatgatatcttgcagcccagcagagagatccttacagaactgcaaacattaacaatccattccactcaagttaataaacaaggtaaattatttatcataagaaaaacacatggagagaaaatgattcaacatcaaaatacacccttgttcattaaggtttatagaacttacattttcaaatttcagagtatcccctccagtctttcgaatctcaaccgtgtgaaagggagggtctgcctcagagatctgaaaaacagaatttataaaagcattagaaagtaggaatctctctagaacttaaatcttcaacctgaaaaacatgaaccttagtggatattgatagacgacttttgcgtcgagctagttccccttcaatactcaactgagatgcacaataagaaatattatcataagtagaaacttgatagcaagttatgattattactgctacaaattagcactgacaaggattctggctaggttgcaagtaatattattattttgaaattcacatgcatgagtgtgttagagacaaaacttcttaccttatagtttctcttcttaatattaaaacccatagacgctgcactactttcaattcctgaaactatctcattcgcagaacatttggatatgaaacttgtttcccttttagcatgcgcctaggagtcaaaaaattgatcgagttatcttaattaaccaaatggtcaagaacaaattcagaaatagtgtcactgataaacaaagaatttttttttatgtgaattacttgaaacaaagtctcgtgaatttatagtacagttaaatccggtaattttagggattgatacggtaattttagggattgataaacaaaatacagtaaatatataatgttttgacagaaggtatcatctatttacaagaatatcaaaaggaaaatgaatatttaattaaaggggccgccatagttagagattaaatttagttttttgttcttcttagtccattctatatcaaattatccttctattataaatttaagtccttggtcttcacagaggtattctctatgtattcatcttatatagttacatatgattctcatcttgtgacatgtgttaaatgcacattttttcttgaattgttggttttaaatctttggaaaccagattaaaacttttgaaagacttataatataactaaattgaaggtttctctgtataccttcttgaaaagatttcgaacaaggctcaagtgattagaatttttgaatgcattcctagtcacagatgctgaaggccacgcctcttgcccctccccaacaacattttttgaatcctaagcacaatatcaagcacattgtcatcaaagatagaatccaaaaggtttttcagctgcttcactgaaaccagcacttacttgatcagaactaatattttcctggaaagatctaacaggttgatgctcattcttgaaccattcatcctccaagatctcatcaattgtaatccgctgttccatgccatcagaagaggtgatatatattaacatgttaatttcatgagataaaagggaattgaaataaagaatatttgctataaagtaaaaaccatattagtatatatcagggctagctcaaccaaattaaacaagaaacatgtcaagtacttactgtagcaggacttggatcaaggattctcttaattagtctcgttacacttggagaaaaaaatgaaggacaagtgaaatcagcctgccatttctgttaacagtaaatttgaaaacaggcagaattcaattaattataaatcacaagtcagcaaagaaagatacatggacaacaacttacatggcagctcttactgaaattatttgaattttatcttgagtttatgattggttgtattcacttgtactacataaagcactatattcaattgctcatgatagaattgctcagtgctcagatatcatgagttccagagtaacagataaatgtgttatgttatgcacttatgctaaccaacattagcttcagaaacatttagtgagaattaccttaaggtataaagtcttaatgtctttatcattgaagggtaaataaccggccaatagaacaaaaagaataacaccacatgaccatatatcagccggtgcaccctcatagccagtgatgattgccacctatatagtatatgataagagacagcagtaatattattaattagcaagagagagaaactgaatttgaagtttaagagatataatatatagtatacctctggggccatataatgaggggtactgcatggtgtgtgaagctaacagtaacaataggataatcaattagaaattggacataaatgccctttgaatttttgaaaaattagtcactaataactcactggaacatgttgagacagtggcgtcattccaaaatctgacactttaagcacccccttagcatccagcaacaaattctctggctgtaattaatagataattaataaaataaatgttaatgaacttgttctctcttttattttttaaaggatgggaaacaaagtaagggacaacatatatattaatgacataagccccagcacctcactactcacctttaagtttccgtgggaaatacctctactgtgacagaaagccacagcacatataagctgctgaaaatattttcttgcttccagttctgtcagtgacctgctgtttgtctggcacagcaaaataacaccaaaattgtaaagagtgaatacaaatattgtagaggatttttatcccaattgatgcgaaaaggtaaaagagtcttacgattttatcaaacagttttccaccagttacatgttccattacaataaacaactttatttcggaatgcatcacctacaccaggaataatgcatctatataagctacttgcaatgaagagagagaagtaaaaaaaaattatggcaagggaaatttgaagataagagaattaaatctcgccatacaaaggaagtaatttccctttccttctaacctcatacacatgcacgacattcgggtgtctaataattttcatgattgataaatttcgatttatctgcaaaacagtaaacataccagaaaatatcaggtgagagtacatggtatggtattcatgtcatggctaaataaaaaaaaatgcattatatatactttttttttaatgtgaatgaacgtgtgcatgtctcttgaacagttaacacattcattatatataaactctatgaaaatattaaacactttttcgtcatgatattgactttaatatttcatttaaattctttattttcttctttctcaaatttaaaagtcaacaagaatggagattaaattaggaatcacacggtttacaatcgtaacttgtaaacaaagataagatcaatcttaatttttcgtatctaatttttcggctcacctataatcttctctatcccttccatatcaacattactctacacatttatcacatttttacaaccaagatcgagagattagaagtattaattcctgatcctcataaagtacgtacgtccaaaacccgtcataattaaattaaatatatcatatcctctattgtaaaatatgccatgatatttgaaaaggatgaaaataataatgtaatttaaatctgaagtggcataaagttttgtattaataatataaaccaaaaaaaggtatagaatatagattaatgaaatgagaatagaaaagtgagcacacacaccacgcccatgatttggttgcagagaagtgtgtgtttgtggagcattttgatggctacagtgtatccgttgttaacgtcacgtgcaagcttgatcatgcagaagtttcccgcgctcagggtttgacccagttcatatcttcccaaagaaaatgaatccgtcatcttcttcaagtttctttattcggatctttcttcttgcaaccctagctagcctcgttgaaaacttaatttcttgcaaccctagcaaactttgcaggtcaagaattaaaataacaaaatcttgtttgatggaagaagcatcaaattaaaggacgctaaagttgaggtttgcactatatgcatgcagaaatgagagcacagcagaatacatatggacttgaatggttgttagctagttagttattacagactaattatcaaagaactagttattaattacgacacttcttttcttaataaagagctagagggtctttttttttgttgttgttgaagattagaatatgaagaggaaaattgaagacagagaaataaaaaaaaaatgttagtatttgtatgatacattttttagtgggggttgagacaatcaacagaagagatttatgtaatgttatgaattacaattaaggagaagtatttactttcaattattatgtattgaactgaatatattgtatttcaaggagaaaatatgtgagaataaaaaaataaaatataattttataaaaacttttacttaagagaaaaaagtgtataataaaatagtatatataataaaaataaatagaaataaatatataaaaattagtatataaattttaaaatatatatttattggtcgatgcagaaaagtgatattttgtaacagttataataagaaaaaaaaatagactctaaatcagtgacaaatccaaaaatatttcttaatggtgacaataaacagtttataatatttttataagagaaaaatatattatgaacttttatataatacatagtattatgataaaagaaattcaaaatatttaagttatgtgtggatgtccattaaagatgctagatcattaaaaaatttaaaataaaataataaaactagtatcaatttattctttcttatattttctacattcattttaacaataaaaaatatcttatgatgggaaaaaaatattatacaaatacaaataaaaaaaaaaaatctttgtgggacaattgccccacactccaatatgtggatctttcactgctcagaattgtgctaaagaaacgaatttcatgagaaattttaaaatataagttgaaaagtgtcttgaaatgtaacaatatatacgagtcttagaatttcacccatctttttgtcttattaatttacaaggactaaacaagttgtgctcaaaggagttgtgagaaaagatggtctctatcagttgccccaattgtttgcttctgtgccttagtccaagagttttacaaatgttttttttattatctttaattcttctaataaaaatgttgtaaaagttcagttgttaatacagtcacttgtaatcctatttattttgctacttggcattctaggtttggtcaccctagtgttgatgctatgaaaattgtatttcaactttgtaatattctaaatattaataaaattcctatagatttttgtagtcaatgttatattgggaagtctcatgcctctcttccttttcttctaacactgtctatgctaaaccttttgatctcgtttctacttatttgtggggccctacaccatttccttcaccacctagttacaagtattatgctacttttgtggatgctagtatcaaatttacttggttttatttgctcaataacaaatttgatactttagaaacttttaaactcttttaaactattgttttaaatcagtttaattcttctcttaatgttgtttagtttgattaggaaggaaatttcaaatcctttaccaagttcttgagtggtcatggaattcaacacaaacttatttgtctccatactcaccatcaaaatggtgtagtaaagtgcaagcacagacatatagttgaattgggtctcacattactttctcaagctgagccacctctccactattgggatcatgcctttgtttccaacatctatttaattaatagattgcctttccttagccattaatcatgaagtttcatatcaaaaattgtttaacaagtaaccatattactaatttctaagagtgtttcgttatttttgtttcccttttctcagaccttacaataagcacaaacttcaattcagaacttaggagtgtctttttgggctattctccttctctcaaaggctacaagctagtgtcttgctactgatggaagactatacatctccaaagatgtcataatatgatgagtgactcatttaatgattctatgataggttttgatatcatcttaaaatattggtttgggtctaacttaactcaaaaattagctcataggatgaaggttgcctccacttatatattttatctttatctcatgtctagtgaatgtgaaactttgattttttttctaatagtgaataatatttaatttttatataataatatttacacattagtggtttatgcttaacttgtggataacctagtaataattaaataataagattaatttgtctcctgtaatttgtaatatgtagttttggtttcttttattttattgcgctgatatagtcctttaaattttaaaattaagtcattaatttgtattgtcgttatattagttgaccctttattcatcattttttccttgatgttgattatgatttatgacattgcataattatggtgtcagggcaagtgacatgtgattttcattgtatagcttttaatgttgactatattaaagtcatttaatatatttatgttaaaaaaaataaaaaaaatgggacacattggagaatccctagtcgaagaacagaaaaacagttttctcctttatctttgagacacacaagtataggaaatgtatctaatttccaactacacttgtgtccactcccataggaaatgtatctaatgagagggttttttatgattaaaaagaaaatttgactattaaatcgaattatcaatattaaaatatataattgatgtgaatttttttatatcacataactttttttaaacaatctttttcataacattaaattttgattatttatatataattgtattttcaatatctattcatttcactcataaaaaaaatatcttgatatcttactagatatgtctcatgtaccaacaatgattattaaatgataacaacttatattattctttaattaaatggttcaaggatcaatttttagttagtcattagatatgaaattttgttaatagtaaaataactaccttatatctattcagagtttcgaacaaaaattagttattgttttcgatggagatacttcatatcaatattataattagaagaacaaaaatgtctagtggggtatacatgttacattaaactagtaattttagaatttaaaatattgatattataataagtaaaatttatttaaaatattataaattgagtgttatttataaataattaatatatggttggtaaaattataatttctgcggattcatttacacctctaaaatatggtatggtggataactctttttagagattatttttttaattttcggagattaattgagttggttataacttaataaagttatatttagacttatcatataaactaataattatttggttagacatttgctagttgatatnattcgtttactttacatctaaaatatatggtggacaactccttttagagaaattttttaattttcggagactaattgtgtagttataacttaattaagttattatataggcttatgatgtaaactaataatcatttggttagacatttgctagcaaccttaagcacgcccattgacatgttaccgatacctaatagtattggaagtacgtactcttcgttttactaatttaaaaaaaaaaacaaaatcataattattttaatagagacaaagtcatgctttttcaggataaggtaaaatcatggttgagttgtatttttaaggtaattttgagttccaaatcatgatttgaataataaaaaattactttcccttcaaatctcatgatttgttaattatgattctaatacacctttaatatgtcatccaaaaaatataagggagagctaaaacaaatataagatactaattaagcctggcaattttttttaacgtctaaaaaataaaatctttcagtaagggtatcaaatatgccctcagtaaactgcgttaggaacaggaacaggcgcaaatagtatgtgacaaacatgttatgttgcagttgatgttgatgtattagcacctgcacctaaaattgagacaaacaacacattagaattccaaataaagaaaaaaaaattgttgaatcaagtatataataggaaattaagtccttaaaaagaacttaaaagggacaccaggaaaacaaagaaacaaagctatcttaaccaaccaaaacaatttcatatgtcttctccactttctacactccatgcatatataaaggcagagtcactacattttttttttttatcaatggaaactcatctcatttcattattgataaattcaacaatacaattgggaatcatatgacagataaagggactagcattgtcaatagctactcttgccaatgtatgagcaactgtgctagcttgtcgtctaaccaactctactcggtaagatttagtatattttgagcacctaaatactgtctttaatggcaatactagtcattatcgacttacccgggcctgcaattaatgtactctcccctgcacctaaaattgagacaaacaagtgaaacaacacaatattagaattccaaatgaagaaaaaaaaaataattgttgaaatcaagtataggaaaagaacttaaaagggtcactaagaaaccaaagaaacaaagccatcttcatcttttaaccaaccaaaacaagttcacagattcagtacattttgagcacctaaaaactatctttaatggcaacacaagtcattattatattgacttaccctttataatcctccaaagtaattttgtattttgttcctttatatgattaaactttgagtatatacagtttttttattataatactaatcaaaagttttcatgcagctagctttagtaccaaagcaatttcattctaccccatctgagggcatcaacaaaggccagagtagcagaacaaaagtataagtgcatgtttatttgaacttattttgatgaaataattaccattttatataacctcaaaatacttaaatgtagaaacagttatttaactgaaaaaaataaggttcaaaacaacaaactaccacctaaaccatttcgttaaattgtaaatatcctctctgtgtcacctaaagcaccatgacttatataccaaattaagtaactaaccatctgtttctatgtccatagtttctgctctccctttccaaataaaatctggcaacgcactatatatatgcctgcagaactgtaaacataatttaaaaaaacattaattagaaaatagtttattataagaaaaatgtatccttgtccattaaggtttatatagaactcaccttatgaaattccagaacatctccttcaaccttccgaagctcaaccatgtgaaaaggttgtgctatctcataaatctgaaagacataatttaaaaatcattaattctagtaacatccctcactagtaacttaaatcttcaactgaaaaacatgtaccttagtggatattgatagatgacctttgcgtctagcatttgcccctccttcaatactcatctatgatgcaaaatataagaaattagtactggctaagttgcaagaatattattattttgaattttggatgcatgcgtgtgttagagacaagaataaacataattcttttacctgataattgcttctcttcttaacatcaaatcccataatcccagcaacacgctcaattccaacaattatctcacccacggggtttggggatatgaatcttgtttcccttttaacatgtacctaggtgtcaaaaaatcaactggtcttaagcaaatcgtcaagaacaaattcagtcacataaaatttgagagaagatttatttatgttcgatagtgtcactaataaacagagtctattacaataagatcaaaactcaaaaggaaaacttgaatgagtttttttccttttcatgcgaatgacttgaaatttattatagtatattacaacagttatatccatttcagggattgattaaactaaagatagtaaagtctataatctgttttcctgttctatttatatgaggtttaatctatttaatttaaaaagtctttaaaagatatttgaatttacttttttccattatccttaatccattcaatatcaatttatcatgctattacaaatttaagtccttgatcttactctctccattgtgattcttataatgtgacacgtgttaaattcatattttttccactctttatttagttattaatattaattaatcaaaggagatttttaatttaggttttcctttctctaatatttttagtcaatgcttaattgttttttaaaatttatattttaaaaactgtatttaactaaattgaaggtttctttgtgtaccagatggttgaaaagctttccaataataaggtagtagcccagaaatgtattcaaaatctcgaacgcgttcatgactggcactggtgctgaagaccatgcttcatccccctcatcaagaagcttttgtgaatcctgtgcaccaaataaggcacattgacatcaaggttagaatcattaatcatatccaaagctctgctaagcaatatttactcaagataaaaaattaaagcaaaagttcttacatcatcaaaactaatattttcctgggaaaatctaggaggctgataattcctcatgaaccattcattctcaaagatctcatttattgtaatccgctgtttcatgccataagaagaggcgatatagtaacatatgttaattttgtgagatgaattagggaaacaaagaatatttgctaaaagccatatattactaacatggctcaaccaaattaaaaaagaatataacatgttaagtacttactgtagcagaattgggatcaaggattcttgtaatcagtgttattaaacttctagagaaaaatgagggacagatgaagtcagcctggagaatctataagtcacagtaaatttaaaaacattatgaggaaggattcaattagttaaaaatgataagaagaattctcactgaaattgtttcaattttatcttgagtttttttatactgattgtacttgtaaatatataaattaagcactatacatgctcatggtagaattgcttagatatcaacagtagcataaaaaatatacgtgttatgccaaccaacagtagcatcaaaaatcatttattaagaatcaccttttgaattgtaacattgtggtcgttattttcatttttgaagggcaaacgtccagcaactaagaaaaaaagaataacaccacatgaccatatatcagcctttgcaccctcatagccctgattcgataacacctatatatatatatatatatatatatatatatatatatcacaagagaaattaatcagtaatcttattagagagaaactgattttgaagtttaagaaataaaaaaaagaagctaatatacatacctctggggctgtataatgtagcgtaccacatcctgtgtgaagcagcccatcttgctataatattaattaacaataagataattaattgccaacttaacatatataaacgccctttttaatttttttgaaaaattattcaccaatatgtaactcactctagcgtgttcgggcagtgtacttaatccaaaatctgccactttaagcactccattagcatccagcaacaaatttgacggctgtaatatatatagtaatcaataaaatgcatagtaaagttaataatgtcaattaacttgctgtctctagctttttgaatagtaagtggcaaacaaaggaaattaaggaacaacatatgaatgatgcacgatcactcacctttaagtctctatgagtaacacctctactatgacagtaatccacagcacatataagctgatgaaaatacctttttgcttggctttctgtcattcccgatcttccaggtaggcctgactggtcctgaaaatgttgggctgtaaagaggcaatactaatattgtagatgatattctgatattacaaattaaggtaacattaatgccttagcttacaattttatcaatcagtgttccaccaccaattacaagttccattacaatatatacccttgtcttggtagccatcacctacaacagcgaataatgcatgcatatataattaagggaaatttcgaagacagagaaattaataatcatgcaaaggtaattaacttatgcacgcaagcaatatatatataatcgatatcattccttctaacctcaattatacgcacgacattcgggtgtctaagtattgacattattgatatttctcgtcgaatctgcataacggtgaacaacagaaaatattagtatatggtattattttttttgtagtcaatattattatatggtatgtttcaaagactgaataaaaatgtattttacatggattagtttaatgtaaacgagaaatgaatgtgtctattcttctaattaatgactcttggtaccactaacaaattacatatatattatttaacagttgatacttatgatcaactttgtgaatacttggtcatatatattgacttaccatttattatactattttccaaatttcaaaagtaacaattaatatatagagacgaataaactatagagatcatacacagtttacaatcgtagtttgtaaaggaagagaaaactaatcttaatttatcatatcttccactcgttaattaattatattttttaacttaaatttctttttcttctaatcaatataatacatatatatcactttcttttcccttttttttatcatctttcccactcacttgcagtacattaattaaccttacattactggaagcatgatgaacgcacccaagatcgagaggtacgaaataggaaatagtctttatcaaaagaaaatacgtcgtcccacccgtaataatcatatacacaataacatttaaaaaatgatgaagatgaaactatgaaggtttttgtgtgtataaatgaaatgagagagaagagagaattgagaagagaccacggcttcctttcgtctcctgaaatatttgttcttctcggcgagaatggggttcttgtcgagaattttgatggccacttcgtgtccggtggcaatgtcacgtccaagactcacgatggaggtgcttccggcacccagggtccggaggattgcatattttcttcccggaataaccatagttctagcaggttgtctactactactactactcctgctaccatgctcatacactgatagaggttgctccatcttcttcttctttctctatactttctttctttcttgcagaaaacgcgcagtaaccgattttccttccaacaataacaccaagttaactcatcacaactaactaacaattaacgggctaacattaattaagattctatttttaggtgttcttttttattcttggtattaaattgtaatgaaaaataattttaaaaaaatatacttttaaatattaataaaattaatgatattaacaactttttttatgacatagagattagttaattttgtttatatttaaatccaaaatgagtattacttagcattggttaggcaagcgagcaaactctaaactacaattttctttctttatttatttattttatatttcaaaaatgcttcatttttctcttaccttcactctcattctccatttccttttatccatcacaccttttgaaaatcatttcctttctccttgtccgacatttttctactagtagtaatatatgaatatctctccattataaacactccaccaataattatttttctttatttcttttcttataacatcgtaatatttatcacttttctcttttcttagttttttttatctcttaaataacatatgagcgtccattaaatatataaagtcctgtgaatttaaaaagatcttgtaaaaacattatcacttttaagttcttttaaaaaactattatgattaagattttgtaatttaaattttgataaatttataacatataaattcataagatttagaaaaactttatacctttataaaatttgaaagaatttcataaatttacaagaatttgatgagaaagataatgaataaataataaagtttagtagaatcaatacaattttttaatataactattttatactagcttgtcttcttatgtctatgcattggaatatttttggaaaaaggtgggggagaatccacgcattagcagattgtataatgaaataatttttttaacaacttttatagtatctttaactgaaaataagagaaagaaagaagtggcaattttggatatagcttcctggctatcgcaacctaaatgaagttgcgagatgaaaacgatgacaaagtaacacaggtaaatcctattctttccgcactaataacaccaaatgagaaatatttgcctatgaaacaaatgcataaaacaacaatcttcgtataataccattatcttttttttttttttcaaaaaccaaaccaaatcaaaagaaaaggaaaattaaaaaaaatacaacgagcaatgggaaccttgaacctaaacgcagtcatgatcaaaacaccaatcagagatgaaaattgccatgctcaacctcaaattcacaatagaaaatcatataatgatatcaataattaacttaaccatagcaataatcccaaaaacaaagaaatatttttttattgtagaaaaagcttatagtgttactgccttcaagaaagagagaaataattatatgcgatatgagaaagaaaatattgggagagaatagataagtctaaggggaactctccaagcaattaagaagaacagcaacagaagcttcaagatgagcaacacactgtttgcactcactggaaagattgtaaaacaagcagaatgcaaaaaatgtggttaaagttcaggattataataaaaaggtagcagattgcacacagattccatagcaaatttgtcatctctagtcgaatataatacggcaagttgtactgtgttcagtgatttaaaagatagaaaaggaaacataccttggacgatgcaaaatagtggtacgtatacaatattttacaacacatttcaaataggctaactaagaactggtgatgtacgtgacagaaatttctgaaatcatcaatttctgaaatttcagatatgtatgcattgtcctattcaacattttgcatggatttgatcagacatgcaatatgttgatagaatagtagcaaacaatcaaatgtaatcagtctcaatttgatagaatagtctcaaattgagaatatttgaaattaaataactaaattcatatttatcaactttcattgtttaaaaaatgtaaaaatattttttttgattttttatattaaatattaaatgtgatatctaatcaaatttaacatatatgaacatgaatataatattataccgatttttaatcatttaagtaattttacctttttttcaattaattcacttaagtttattttcaatattatttaatttgaatataatgttaaattaagtttagtgttgtgaacatttgaattgattttagattttttttcaataatataaaattaaaaaataatataattttatatataattttaaaaaattctccctctaaaatcaactacaatccagactacaaaaaagatcgcatggatgaaacaggatcaacattatgattctttgctttctgctgatagctttttgcaccatctttgcaacgtatttcactgattgtaactcaatattcatttgcacaaatttgatatgtgattcctttcttaatattaataagctaagttggtgcttatatgaaacgaaaatttcattgaaaataaatattattcacacatatcaaaatctggttcatatagaataatccaacggtccgaattatctaaatgacacgttccatgttaacctaaagatatctaaatccattccatctcattcttatttggagtaaggattttgctaacttataagttactataacctatgacgccgcattcacatatatatacctcaattaaatatcactgtttattaatttaatcatttaaaaactgactaatttaatagattttctcttctactgtttcttctcacagctactcctagtcattcaataaatcaattagtgggaactgaaaaaaaaatatttatttaacttggcagtgggggtgggtgcatgtaaaatctgctattttcgacagaaatatatcaatttccatttttataatgcttgaaaatacttctagaaacaaaattgttaaacgttggtggctaaaaaaacagttgacgaaacatattgattattgaataactaattaaccacttattacaagacttgaatttcatcatttcatgaaattatacttcttgttcttaccaaagatacaacagacacaagtgaagtgaccatgaattaaaatttatcgtccatgtcttcacttttggcaacataacaaggcagttttttgagtttatttgatagaaaaatatgagcctgtacagcaaaattcaaattaagtgcaagctagaattcccaatccatgagtctctttacactcccaaactcccaagtcccaactattcatgttcatcaaacccattgaaaggatataaataattacctaaacaagaggggcaatacatgaacaaaaagatactagcttgcagctttacatgactcttaaaaaaaaaaaaacccaccaaggttgcatgttgtttcatttccctgcctcatgttctgccttcactgattcataatggagagggatctatgcacttccttcaggaagtaccttcccttaacgttggtaatagaagcagaagcagatgaagctgcaactgctactgctgatttgctttttttagggggtgacatgacagaatcattggtgctaatctccctctcatcttcagtaatagtgtccaacatctttgatgttctgtgcctcatcacagtaacatactgcggtggtgccacctccatgaagaacctagcaatgcgagaatttgccatttttgtgaaagtgctttttgtaaacaaagtaaaagctaatagagagaaaagtactaggatttcaagttgtgctgaaattggtttgattgttgatgatgggaatgaactacaaagggttcaatttataaggagggggactaagccaaagagttagtatttaactaggctaaaattgagtcaagggtcttaatccatgaaggttaaatcaagttttattggctagtgccgccacaagcttttgatattaattgcaatgcaatgctactttccttgtagataagcttctagtaggacaaactttggtatgtgtcaacacgtgggtggaaaatttgatatccatagagatatggtttttgtcgggaaccgtgcttccaaatatacactttttggggcttagtgaaggggcgtgtttgtctgccacgttgcttggacggggacattacttggacatgggtgtaattgaagaaattttaatcatacatttgtttactttagggtggttggttttgccttccatgttacagtgacactgattattgggtcttgagttgcattgatattggagaagtttggttgaacgtaaaaatggatgccaagtgtagcatcatggtgaaatggcggtgagattccagatgacaacaacattaatgggaggcaggggcaggaggaggagcaatgttcttaaaatgttgtatcagtctagatattgattcagtgttttagtttgaattttagggaacacctttagcagtatagtaagattatactagtaaaagtgttttaagagttacgttttaattaacattaatatatttttttaattctcaatattggtttttattttacaagttattaagacaatatcttaattttaattaaaaaatataattacaaatacttatttaagagtttggagtattttgtaataaagcctcttaaaagaatataaatttatccttcaatgtgaccttgttaaataggcttttaatagaaaagtcttcacttagttaattttttttttaagtgtatgtggaatgatctctcctattttgcatcttgtttttaatccacctatgtgagacttattctccaacacatattatactaacatatatgtaaatctcctttttattcaatttaagagttacttttaataatgttaaatatacatgacttttttttatactgaaaatagaacaaggctaaaaatatttctaaaaaaattaatttattctttttataagggtttgatatgacttaatataaactaagtcataagtctttgttgaatgatctctcctatttctgctcctattttgtatcttgtttctaattcatcatgagacttgttcaattttaaatatatgtgtaaatttaagttacttatagtaatgttttaaatatacatgatttttttttactaaaaacagagcaggctaaaaatatttctaaaagaaaaaaaaaaaaaaaaacttaaacgtgaccatttgtattaaacctaatagcagtgcattgagaatcttatcagaggcaatagaaaatatctcgcaaactgttcagattgtggctttaattagcacaagttttatgttgtgtatgcatagtccacgacttcaagggactaatgtcaaatataatggcaagtgaagataatggtggttcaacttgtggacacattttcttcattatacttgaacaaatacaaacgttctcaaccattttttttttcgtctctatatttgttatcctatatttatcaccgaaaaattgagtattccaaacaggtaatcttaataaagtgtttgtgtatgaatgtgtctaagtaggtgtcattaaaaagaagagataagagaagagacatatcaccaacttgtgaattgcatcttgttctgttcttttggttatatactgctgcgtaattctgatatagcatatattaacatatattttgttcagttcggatttgattatttttatccaaacctgaaaaccatgaacaagaaacaggaagcaaatctttgaaaaacaaaataagactttgtgttttatttcggtttttccttttcttatacaaatattagaaaatgtaacnnnnnnnnnnnnnnnnnnnnnnnnnnnnnnnnnnnnnnnnnnnnnnntttatttcggattctctttttttttttctatctcaaactttaagatttctagaatgcactatttaaaaataacttttaaatttaaagattatattacaaattacctttaacttaaatttaaaaatcttatttttttaatgtcaacttaagaaaattttttcaactaaaaaaataagtttttttacagaaaaaaatcaagttaaatactacttaaatcagcaaataacgaggatttgaaaatttaaattcaaataattttattgttacgcgaggtatcaattagatgagtcaactttcatttattttagactcgaacttagaaagaattttaagttttaacttttcttttgtgaacattttttttataagtttaccgttttttatacgtttttggtgaatattttatgtttagttaactaaagtattattaagtttcttttctctctctcaaattatgttaatttcaaaataaatattagcttattaattcttttttaagcctatcttaaaaaagtttatattaatcacactccttctaatatctctaattttttatttctcgacgattctcacactacgacacttcatatagtaacatttacacaatatttttgttggtcaaaaccctttactaatcagaatcctacgtaaatagtcattttcaagacctcgaaaatgagaatcgattatgtctatttctaagatcaatgattgatcccacaaatcaacatttcagtgtgttttgtgctcactcatgtttttcgaaaaactttctagaatctcacctattccataactactccaagcaaatacgtttaacaatagaattcttatgttatagactaccgaaaagtagatatatcttgttagtatagatagtaccaattaatttatttaagacattctcagttgtatagtctcatatatgcacaacctctgaatctctctcttttcggtgtgattcgtcgaggtgttatatgttcactagtttccatatggttcattctcgaaccataccctaataggagagaggtttgctttaataccacttgtaacattcttgattttcgatttttccacgactcttacattataacacttcacgctgtgacagttcactcaatatccttattgatcagaacctttcatcgatcatttgtaattcattaatataaacataatattcatatttatttgtttattttgggtaggggatgttgaatagttcctcgtgaaggacccaatatggcaatatgccacttgcatgcaagatgatgcgcaacatctaaatcactttcctcaccatcatagctaccgtccatggcttactttccgtatttattccaatggcgtgtcttccagggcagctacagttacagttactcaatcaccatcataatacattgtggtggatacacgttagtttttaaaactttttaatctaataatatatcaataataatccttcacaaaaaaatatttttatattattgtttatttattaatttatagtgaaccgcattaaaatattttgcaggatatataattttataatgtcatatcaatatattgttcctactaaaaattatacgtgcatatactatattcgagcaaactcgtaaacacttttatagaattaacctaataataatattataagaattcttcgatcccactagcttctcatatcacatggagacgaatactcagaaaaggatcgacgtgaacgtacgtggtggaccatatataactcttggttattttggaacggaagtggcactatattgtaagaaatataagtacgtccatattctggataaggatgcagaacagcccaacatgcttattctagataatattttcccgtgaacatgtgtgttttaattggctgccggcataatttcggttggaatatacatgcagtattgtatatgtaagaattgagagtgtgagatgagtgaatctctgttatataattcacatatatagatgattaattaatataaccaactgattcgacacaagttattaaaattattaatgaacttttgacgtcaattacctgtttgtcttaaaatatcttagcatttgaattcttgacttattacttataatatattcttttttactttctaaacaaataatctagctagggctttctctaacactccttaagtttaactaaaatggtgtaaatgtgatttatcttcaaacttttttcgtaaacttgtagttcaattttgggtcttagaagccataagtcatgttttgatcacatgatgttttcccaaagagttatgttatttcgtatgaatcatttttagtgcaaattatcagattaggccggaaggatttacaaaggagaaaatgcctaataagagtagctagaagcacgataattgatttatgataaaattatatgtatatatttatttataactcatgaagagtaggcaactcattcttatccaatttcgtaaataaaattttgacgagcatttcgctttctcaaatatatggtgtgcatgaatcgcgggtcttcgaagtttgaggaaaaattttatatttctttaaagtgaacaatgtcaaaagaagctttttctccataggctttcccataaatgtaaattgttcgtattcaattcagcggtgaattaaggagatgctatatgtagtcaaagtccaaagaaattcattaccacacaccatcattctacagtaccaaaacatcacatgtgccgtattaagcagggtatacaataagagagaaaaagacatcacaagttgcagaaaaattcgtattattgtaagcaatagttgcaatcagtcaggagtgtagatatggagtgatccccactaaatgtgaaatgtcgaataataagtagaaggggagaagcaaccctaggaatactgccaaacattattacatttaattcataaagcaagttcggctgtgtagccgctttatcctgtgtcatgtctccaacactgatccaatacaacaactatgcataggaaggacaaaagtctcatttatcttgcacatcaactatagtcatgcatatatataaagatataagtttgaatttgttttactagcgtttataattaaaaaaaacaaacaaactattttttgttgataaaaagaaatagtattcatgcatgtattctagttctaaatctagctaggacaaaatagtacctagaaaaaattatgaatgctttgccactttaagttgtatcattagtctttaatttgatatagtggaaaaatcccaagtttacgctgattataaataagattaaaatattatatatatatatatatataaggtgggtattatgatctattacatattcaagagttaattaggattttaactcattatatatataggatggttaactaactttatatatagctagtaattaaatagcgagtgaaattgtgtgcgaaagaatattaattcgattttattatatgaatgaaatttctaggtgttctcgagcgttcgttgtttgttttgaaagatacaagaatctctttagctcattctgtaacaatgccatcaaagtgtgagacagtgagagaaacaatttcattttattattcaaaagttaattacaacaataagtcaatgaccttttcttaacatcattcttacgtcattttttaaagaaaaacacacattctacacattcaattctgtcattatattttttttttatttccaataaaaatgttgtacgtaccaatattaatcagcatgcaaaaaatattaattgattaagatgagaattttctgtccgaattaaccttaatttgtttatacgtaggttggatatatacctctttcttgaaatttagttaaatcataatacattcatttattttgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaatttttaaaaattgacctgatgactgatttggttatgatattaaattattagatcagtgattgaatcggtgaatcattaattgatttgtattatcctgtttgtaataaaaaaatattaaaaattgtatctatcttaaaatcttttttataatacattgaaatttaaaaatcttaaaaacataaatgaaatataaagaacacaagttaaaaattattattatctttaacatttaatatcaaagggatcaatgaaaatatatatcaatattcacactaaagtgaaacaaccatatcatatcaatgtaaattaaaaaaataaaaaaccaatccaaagtttcaaagtccaaaccatatttttaaaaaatgattcgggatcacaatttcacatgcaattcaactataattgcagtcacttctaagttaatttaactcaacaaaaatgcaattgcaaccacaaaaaatatcaatacaatgaatgaaaagatcaatttaactcaaaattataaaaaaaaaattaaaataaaacaaaatgaaaaaaaactaaaataaaacaaaatgaaaaaaagatacataacccgattagagtcaattggtcaccgcggttcaaccacaaatctgatcgagttaattcggatcgctccaggtcaaaaaatttaatcaaatttatgattcgactcaatccaatcaccggattatgattcgaccattaggtcctagttttaaaactctctttataggtatccctagtatctattcttaattaaatgtttcttttgctgataaatttttttactgtgtcggaaaatattcctatatattagttgtggatgctctatttactaataagaactgaagaagatatatctgtttctctttctcgtgtcagatacacaatttagtcttaatttcctttttaattatatgaattaaggtatgttataataatataatctgtatatcagtaactacatataaacatttttatttaattaattaattaaaatgatctaatcatattattaatttaattttagttttttaacaaaataactggtattcatcttaatatttttttcaatttaatcctttaatttatttaaaatcgatattgttaatcatttataaaatatacattttcgcttcaatttttttcctttcacttcatttcctttttaattaaaaaaaattcttaaattattatcaacatcaatcttaaataaaatcaaaagattgaattaactaaacaaaataaacaaatcgtcaaaataaattttttaaaaaataaataacaaaattaaataaaaaataaacaaatgacaaaattaaaataaaaaataagataaatgataaaatacaccatttgtccctttacaccctgacgtgcaacttattcgaagtttagtctaaactatcgtaggatttacaccgcaaaagtacgtagggtcatccccttgaaataatagctaagaatcaacatcagtcggaaagttaaaagtggaaaaaggatgggagccggggactatcatcacatccactttttgggagaagtaaaacacaaaagcttatcacatgcattaacatcaacttcacaacaaaaaatcatattaaaattaacaaaattatcttcacaaacattgatttataattgatcccagattattggtgttacatgataggctaaaatggcattattgaagttaatttgaaaagaagggccattttgattatgccactgatatataaataccatgtacatatatcacctagctagggtgacccgtgaccatataatcatatatccttctctaaaagcaagagtgtgtcagctagcaatagcatggcagctgaagctgatatcaatgttctgccacccatgtgtccatcaaacacagaaacttcaccactaaaaccattttctgcagttgctccgaattgtttggtcccattttccaagatacaaatcaaaataacattggaaaccatctacgaagaaggagaagaagaagaagaagatgaggaggaggagagtgaaatggagaaaagttctgagacgcatgcgtcctcttcacccccaatattcttcccaattattcaagctgctgcagcgacatgttcgtttgaaatcacagggtattttcactttttggtgtcgttcggtcataactaccagcatgcatagataatagtacgtggtagctagtccatatatatatagattctaatgtgatccatcatgaataatatttttgaaatttcatggttcatgtagaactttaagtgtgacttccaaggtaatcaactgtacattaatttgtcttctttttggcatatggttttggtagttaggttgcattcaaagttttaaaaataaaaataagtgggaataatgtacggtcaattgtcaacgttttaaattttgacggaaaaataaatattaataaaataattaattaaaaataataataaataaaataaccaattattttaaaatttaaaatagtaacataacattaatatttttattgaaaaataaaataaattatcaaaataaaacttttaaaaatataaaaaataaaaataaaaattttaaatttagtgtatcaaaataaaattttaaaaaataaaatagaacaaaagagacatttagttataagagaaaatgaacaacaaaagactttgagtttaataactacgcaatgactgtaaaatatttttatattattatctaattataaataattacttaaattattttaagataattatttaaaatttaataaatttataatatgagttgtgatttgataaatacgtaaaactttttaacttttttctcaaaagaattttattcctttaaacaaagttactttaagtttaacttacctcggattaattgaaacgaacgagatatataagagtcaaaagtaaaaacacgtaggttttattcttctttctttttatcagatgtacacatctatgacccaataatattaaacccggattgcaagtcacagctgtaaaatcaacaaattgtacactaataatctccaattctagaacgcggttgtgtgcacgccattttgctatttttaatacagcttctagaatggaaaaaaacgcttcgctgtgaaatctattgtctatcccattattccaagcaaagactttttcaagcatgagttgtcactagttaatttccaccaataattctaacaccttggccatctcccacctccttcgttagttgactcccccaacgtatatatggtagcactacccccttcttccaaccccaaccccaaccgattttcatcattttctaaaggttgagtttctttgatcaaagaaaaaggtcaaggaaatcaaagggttaatttggttataacaattattattattattattattactgtttctcaaatttctcaaattaaagtgttgatttgaaaaaggatatggtgaaggaagtgagaggcatccaaaagtactatggagaagttgcaccggccctcctcataactcctcataaaaaatgttcccttcgttttccaaggttggagccaatcattgaagaagggtctgatattcagggcctccagatcatgcctaaaaggattctttttcttgttcctgcattgatttcttttggcacatactacttcttgttgtacagcaacgttaattaattagtgcctgaaaaaaagaaaaaacaacaaaagttgatgaaacatatgttaattaattttagtgatttgcacaccgggaggggatgtgtgtaaataatattcattttatattattatcagtttctgctaggcatcatgcaccaatattaataacaagtggttcttttatttgtattttttgtttgagattattaatccattgtcaatattccccctggcctcccccatataaaaaaggaaaattcaaggagaacaaattaattaaccctgacaataatgcaaactttatttacaaatcctctctctctctctgatcgactgtatgtttatcatcatatatatggaatattctttggagatgaattaaactttaattatgtggatccagatactcaattgaattgctaggacctaggagtcgttagtacgcctcaagtttaccaagtcaggtctcaagaagtttccaaactagagttgcaaacataagtttgtttctatcgcttcattatgcatgcacacgcattagcaacggaatttctacctttcaaaaagtaattaagtatagttttttttttttaaataatgcacactactacaaaaaaagcctttcacgacgcacatacgacgacggttatatggaaaccgtcttagtatgctacgtgtaacgacccgtatgcatccgattcattaacattatcttatggtggttaagcgcagcaattatcatagataattaaaatggaagcagtaaacaaaaatgacgtcatcatacgtcattaacaatacccactgtacatcatatatggtgaatctcataatatacaaagtatatgtctcaaaattgtatatatccctcaagtctctaaaacaaaacataggcatgaaaatcaaaagatagagctaacatgctcttcactctatgcctaaggttctctcagaaccatatccctctactcaggcctcttgccctggaatctatcagctgttccctaagcttcacctacaaaaacataatccccaaccggggtgagataacaatctcagtaaactcagggttcttggaggtctttcctccccctggttcactttcatgcatataatatcaaaattggcattacaaactagccttcacagctatcagtcatattatcacatgtacataacatacatacacaaatatcaatgcctgaggaggcttcatccatttatatgggcacatctcacatcagggcttactaatcatgcctgaggaggcttcatccatttatatgggcacatctcacatcaggactttctttctttgcctgaggaggcttcatccagctatgtgggcacatctcacatcaggacttatatatatagactattaaattcaattctactggtcagagaatctaatcaagcacataaccacactatcacagtgttcagctcatcacatacatgtttccataaacagtaacacacaatttcaatatacatgcatcaagatatacactaaccataactccctaggagtatggtggaacacaacagtgggaaacactcccaagaacaaagagcttacctgctctcaacgctataccggctctctcggcttcgtggtcacaaccaccagtaatgtcactctcacgccctacataaggcatacaaacaatcaatcaataacggtcctcaaccgttagaatgaaaggaaaccctattcttttctattaaaatctctatgttctctatcttagggttatcagagctaaccaccttataggcgattcacagaccctcaacaggatctatcttggtccaaccaagaccttagagtctccctagactctgcataagttcaattcaatgatctcctaggtcatatatcaacaatttctcaacatgactaaaacagatatatcaacacattttcaccgtttatttgtccttctgaataacttttgtaaatgcacttaggctcataaatatcataacaccgtccatttcatcaacattcttcctactcatacatatctcagggtcaaaatcaaacttcatcaaaaatcatgtttcaaagtttaatattcatcagaacaacctcctgagcatacttttctaaaagaacccaagcctaattccatccctatcacaaagtgatcactattcatcccaagaacaatttcacaaatcaaacggtaaaacttgagtttcttacctctaaatcgacaagagagactaaagaacagcttttccaagcttaacgttcttaaaacgccttcttttctcctcagaatcaaactttgtggatttcccctagagaactggatctctttgtttgatggttttcagagaaaagtgatgatggaatctagctcattgagtagttcctttcaactttcatgttgggtgtgaagggttttggtcaacggttgagtgtttaagaagctcctctagttcatcaatggcagaagcagaaaaaaaagaaaaaggatcgagagagagaaagagacactactacaaaaagcgccaacgacgacggttattttggccctacgatgacggttgttgaaccgtcatcgttgtacgtgttgttaaaaaggggcactttcgaccacggttccaaaaaccgtcatcgtttctaattttttatttattttttatttaaattaataggaaacaatgacggttatttaggaaaaccgtcatcgtatgctgtcatacgatgacggttttctcctcataaccgtcttcgtttctatttaatttaaattttaatttttttaaaaaataaaaaacctacgaagacggttatttaggaaaaccgtcatcgtaagctgccataccatgacggttttcctagataaccgtcttcgtaggtttttaatttttaaaaaaattaaaattgaaattaaaaacgtacaaagacggttattacgaaaaccgtcatcgtatggtatcatacaatgacggttttcctaaataaccgtcttcgtaggtttttaatttttaaaaaaatttaaatttaaattaaatagaaacgaagacggttattaagagaaaaccgtcatcgtatgacagcatacgatgacggttttcctaaataaccgtcttcgtaggtttttaatttttaaaaaaattaaatttgaaattaaatagaaacgaagacggttatgaggagaaaaccgtcatcgtatggcagctaacgatgacggttttcttaaataaccgtcttcgtaggttttttatttttaaaaaaattaaaattgaaattaaaaacatacgaagacggttattacgaaaatcgtcattgtatggcggcatacgatgacggttttcctaaataaccgtctttgtaggtttttaattttaattttaatttttttgtaaacgcatctcccaactttttttttctaaattggtttctatactaccacataaattttaaaaatacaccacattgaagttattttattgtataaaataaataaaaaaactaaattgttagtacactaaaatttaaaattgagcttaacgctataaatttaatttaacacaaaattaaataaaataccatgcaacaatgacatactaaagggtcaatacttaatatgcttactttagaacctttttcactggagttgagttcatcaattacaattttcacataatcccttgtgacaatatgaagcattaatgaatgattaagtaacttctcaccaaatatctacgacaacaacaacaataattggaacaagaattgctaacattcaatgtgtgcaattgtaacaagttaagaggggagataaacaaggctaaacaaaacaagttattatatgaattaaaaaaacaccccaacatgtgaataaggaatagaatatacttaaaaagttaaaatatgtcccaacattgacagcatcaacatgaagagtttaaaataatttaatccagaaactaaaatccaattgtttactaactaaaatccacattctatgagttctctctatcttagcaacttttgtttggacacacaaataaggcttgggctttatatattccacacagagaaccataagaagtaccaatctatgccagccctgtgtataaaaaatccttgaaagaaaaaccaacaaagaaaatttcataatagaaagtttgaaagaacaatcagttcaataggaagggaagttcacagaagcatagctacatggcgtgtgaaacatgccagaagagagagtgattttggaaacagaacagtttcatattttgttcattttcttcccatgctcaaaaaggacaaagaatttggtgaattatatgtatctacttgattaaattttctttctccattgaccctttattttcacttattcatccaaaccacagaaattcctctattcattaattttctcaccccctatttatttcctccctcttttctccttaaccaaattaccatatcagtctagttcagttccacaaacatcctatagattaatcatgttccatttaataacagagagcacaggaaaattcattcactaaatgcatatctcagatggtttcaattgtatgtaacagtaacaaagtttacctttggagatgcaccaaaaggaatgtgttgtaagccaacagtgaagtacaattctttccccaactaaatgtgtcatgctacataagctaaaagcccacaaccccaactgatatagggtttaaagaactcaaaccttcatacggacctcttccatgtaaatgctgccagtaggtaatggaggagcagaagctttgtccattaaggccccacaccaaccttcttaccagaggagctatcatatatagaaacatggcatgtaactggcgtggtcccatcaggaaactccaatggcaactccactgtcatagttaaaagagaaaatgttttttcatctcttgttcagaatgacagagttaaaattctaaattgacaacattgtcaaataacatcaaatcatgaaaaacaagataggtgtgcttattaccgaaggaaattactaagcatatggagttattctcctgttattctttatgataacacaagtacagtggctttggctaataaccctgttctccattcttgaactaaacatatagagttggatctgttttttgttagagagaaggtgctcactaatctgattcaagtagttcactaatctgttagttctattatgtttgttaagctgtatcccggtgcattagttcccgacattgcaactatcttaatggcccacgaggctaagactaagggtggtgaaaaataaaatgggactattacagttgttaagagaacattttgtcattagtaatagggaaagcacaaacaaaagatatgccacaataaacttaccttggacactggtgatgcatctcctgccatgataccatcaactccaatgatggagaagaaagcaaggaaaccatttctctgccccgtcgctgctgtaaatccaatgaagccattcgccgttattaccataaacctaatatagccaatcttttttgctgctacacaaattgtaacactcccatgtccaaccgtaaattttgtgatgcaatttcataacctgttgggataataaatttgaatcatttgtttcaagttagtaagtcaaaatactgattaaatcaactgctaaaaataatgtttttttttctaattcatcatctagaagaatttaaattcttctgatttacttatacaacaaattggaatcatttaatttctgcaggcctagttaaaaaattaatgatgcaccacaagagtactctagcactgctacttgttttactggaaaagagaaattagtaatagtaaaagcacataaagaaagaaattccataaacgaatccaataccctggacactagaagtgctacttattccagttgaatttgaataccaatgtatattatttttgtatgcttgaggtggaagcaatgaaaatactctctgccctgtctcacatgtggttttaatgaaaccaaagtggtttgctgctacataaattgtctatgacaatcaactatgtctaccaatctttgcttctctttaaaggatggtttcttataaggattggtgaattgaatattattcatgctattttctggtttgattacatggagtccagtttgcttgacaatcacatccttaggggttgcttcaataccaatggaaaccaccacatgattccattaattttttgtgagaggtttatctagacactcttcaaacttcatgtattttgtagaacatgattgattgttgataaatcctttgttttactaaagatggccatataaactgtaaagtatgatgtttctctctcccgccgatgaaactaaataaagacaacaggtggtacttacatatccaacccgccatcccatcattccatatgcttttgagaatgagaaaacattaacaatatgatttccctcaacacaagagtgtttcaggccatcatacataaaatacctgcagacaaaattaatttgtttaaaagcaatttttgaaatatgaaaaacttgcagctcagacaacatgattccgagatgattgtagatttgttaataggtagtcttagtgaagactacaagtaggatctcatatggatattttacaccagtggctaaccacaatataagtgaaacagattaaaaaattatctaaaatgacaaagaagggaaaaacttgtcaataaaataattaggaattttctggaacacaagctatgtaaccaatttatcaaatggtcctaagaagaatagagaaactttgtttttgtttactttaataattaaagaaataatatgattttttttcttctattagcactgcaagttaaaaggcttactcgtatgtattatcaacaacaagccaagagccagcattcttgcagagatctgaaatcctctgatcaaataagagaaaatactcagaaattttataaatatttttataacaaaaaaaaggtactgttactgttatggtcgatcagcatattcttggggaatattatccggtggccacacaagaagattaaaaaaggatcacttctaaaatcatactagctgttgataaattcagagggagagagagacctttagaagcttctctggaatgtaagttccagatggattgcctggatttacaacagtaacaagctttgcaacttacaacttaatccaatatcataaaacactcaactggttggacatgcataaatttatagcagcccaatataccttctgaaaagaggaaaggtttacatgtatacagacccaatccatccaacatttaaccaatatgtgaaccccctggatggaggaaaaaagatgctcttagcaaccaaagattgcctttgcttcccaagtccatgccagtaaaaaatggattatagtaaccagatcatgtagcttcttacctgcatcaggatggagtgtgtctgagctaccaggaccaactagaatattggtaatgccagtcatctggaaggacatgtacacattgaagtagtatggagcaaacataaccacagaatcacccggatcacagagagtgagaattagattcacaaatgcctatgtttgtaggaatacaacaagttaccacagatgattagagatgagcacaataatactgttgaaacttgaaagttcaaacttggaaagacatcaaagtaacataaaattaacagaccacaagtgatagaagctataaatgttgagctaattcagtcaattctgaaagttacagtttccacagttacaaaaaccccatgctatttgtatcagatacatgttctttcaaatgctttttgagttataggaagaagaagtgcaagactatgatggttatagataagatttcacacaagcaagcacgaaaggctataattttaaatgggcaaacataaagaaatcaaacggaagctgaaatgctgatacacttcaccatgttatctttttgagggtataacaaggcaatgaacataaaacaaaaattacatggtcaattagtattgttaacctcacctgattggcacctgatgtaaccattactgaagatttgtgcaaattattttcatcacgcaactacatgaagatgataaaagcaaataagttaattcattggtcaccaagatccaaatttcatatagcaaaataatttatcacagagcaataagatacaaaaggcttaataataaaagcaattaatttctagattcagacgtttggtattttaatcataacctctatatgcttatggtgtttattcataagattcagacgtgcaaggttatcaaatctgagatcctaagacacataaaatgcgtgataataacaacttaaaataccaaactatcttcaaacaaatatatctgcatataaaataacataaataagcaaaatagcataaaaatcagaactccatgaaattttcacaccaacaacagctccaccagatgacattttaataacagtaaaacttgagaacaattacatccaaccaaaagggtaaaaaacaccaaaacagagcacaattatatggactaaccagcaagtactgaagcaaaaacaaaccagtaagcacccaccacacagacacagaaacagattgaagaaaaaagaaaatgggagtggttgcgcgacggagcatcgcgagattaggatctgatcgctcggtctcgctaggtccgagagagagagagagagagagagagagagagagagagagaatgggagtgtttgtttgtgtgtgatgcgagtgagagactgtgaaaagggcaaaaattttgaagagaggagtggggaaggagattatttcttcttgtagtgaaggtgtggaaggtgtcaactagggcacagagaggaaaacgcaaaaagcttttgttggagctgattgtggagcttttaatttcaattttaaattgatatgcataaaacaaagacgtctttgaaatagagcaagtccacgacggttgtttatacccgtctttgttcccccctgtcaagcatggtaaacttcaaaagaattgcaaaattgccaccggctatgatacaaagacggttacgaaataaccgtcattgttgctatgtcgtaaaaagctctatttctagtagtgagaggctattatactacgcggtggcattgtcgtaaatatgaggttaaaaacgacgacgggtattacggtaaccgtcttagtatgctacgcggtggcatttttgtgattttgctataactaaacaaagtcagttattattaaaaccgtccttgtttgtaacagtagatttaaaattaaattaaggaaaatgagcgtgccctacactacaaaatagggaactcgtgggacctcgcttcctccttcctcatcttttcctgcctcttcctttccctcttcgttttcttctttgcttttctcagacacctttgagggcctcgtctccccagcaaccaccgtggtgggcccaatcggcacatccacagcggagagactcgcgggaactgacggcggaggcgaggaagagaccctcatcctgttgctgcttctgccccacaccaacccccatctgcgcgaactgctcctcaacccccaacaccttctaatcctccacgacaagaaccctaatcggtggcaagtttgtgagcaaatgcgacaataaattttgttttggatttggtttttgaaatgtatgttttgttgctgcagcgactgagaatcctttcaatagcattttgaggacgctcgagaagcccgacggcgctgactagtttggaaagtactttagcttgcccgctctcaacgatcccataatcggtgagtcactgattttcattttctgacaagagaaaatgttgaaggaagcgttgttcaatattgtcttatttgtgtgtgtgtgtgtgtgtgtgtgtgttattggttggttttaattgaatggttctatttttcaattgcatttttctatgatgctactgcttgtgtctagtgagatttgttgctgtttttgggggaatgtaatgttgcaatttcagtgatgattcgatgagctgaatttgaatctggagaggttgagaattgatggtgacatttatatatttccctcttattcgtgcagtgcaaggtggtgaagtagagacaccagagagcaagaagagtgaagggtcctctatttcttttgtgatattagtgttgttatatatcactttttagttttttaaaataatataaacttcaaacattgttctcgctgctgacatgactcctgttttaattttgtttcttttgttctgttaacaatacatttctgttggttgaagtgttgcattgctttcataggccctttctttgtttttaaattaatcatgcatgcatgcatttgcaattttgcataaccatatcttcaaactacactctaaataagctattatattatgctatatattatatatattagaaactctagttgttgtgtattatctgtctttatgatagaacaaaagaaaataccagttataacttataagctacttagaaacttgtttaagctaggccttatttatgatggaacaaaagtcttatgatttttgtttcttagatctttgtcttaatacttagaaacttgtttaatctgccaaactaggccttattggtgtgtttctcttgttaactatgtctttacttagattggtggctgaagttcatatggaaaaaaaggtgaagaaccagaaagcaaagtcaaaatcttctgaagcacggaagcaggtcagtagtgtgcgagtaattcaacggaatctagtttacatagtgggattgcctctcaatctggcagatgaagatgtaaattttttgcctcatatgctttcaaattcaatagttgtcgtcttctgtatctgttttgttttcaggccaccatccccttccttgtcttctcattttttcttattctcggtgtaaatttactaatatttattttatctctgtgcagttcctccagtgtcgagaatattttggtcaatgtgggaaggtcttaaaagtgtcaatgtctcggactacagctggtgttgttcagcagtttccaaacaatacatgtagtgtgtaagtttatgttgtctttaatgcaacttggctttttttcttagtggtattgtgtagggtgattagcctgtggtaatccaattctagcttatcagttctcattgtttttggttgatgcatttgcagggcttgttttggaaccactaaatattgtcatgcatggctcagagaaacatggtttgaaaattactaattccttatgaattataacttgttctttcactagttaaagcttgattggggatagatcttgatgaccagccttgcagcaatccagattgtctatatctgcatgagattggctctcaagaggatagtttcacaaaagatgaaaaaatttcagcatacactaggtatttttctaatcttaaatgaactttcatgcaaggcttgttatggttctgttgaaagatagaatctattgtttatatgatccagccatgattggataaagtaaagaagattacttgacctttatcttgttaagaagaatgtttcttgtcctggtcatgttagcattacatattagctttcagttttaaattaacattgatggatctatcatctgttatgatactaagctatatgagttgcagagctgaaacttttatttgcttaatcatgttgactctgttaaatatttataagaacatgaaaccttatgcctcaacgctcttagaaaatcgaggaagtaataaatgataaaaccattccttgaaataattgaaactccccaagcattatctttttcaagggcaattgacaaacttttttttttcctgcaattagttaaaggctggatgtattttttaaattgattcagatgggttttgcttggcagttgatacatgattggaccattcattcccccccccccatattatatattgtttttatttgatcttttgttatcaaaatcaaatgatggtgtttaaagggatgaatccgttcataggaatcattaaannnnnnnnnntaagcttatggtagacggtagaatgcttaaaatataatgatgttgaacaaatttcaaattaaatatgaattgttttggtgtagttttttattttatttttcattcctctaaaatatatttgtctattttcgtattatttattttctactaaattcgctcttgcagaactgtttgagtcgcaaacccattcgaacttgaagtctgcaacgcccggacaccatcgacgaccatcggatgtcgacatcgtcgcggtcctgtgtttgagcattcaattccacaccgttttttcttggtatctcctccctcatccaaactgttttttttttttttttttgcttctctcacaattcaatttcagatttcttgtttccccatgcattcatatgaattgtgttgtgcttctgtcatttactttatgttggtgtgcgtatgccagtgcaatttacttcaattatttatcacatttcaagctatgctgcgtagatttttttgctatcgtgcaaaaatcagccctgttgtcaaataaatctggcacatcatatctgaatttctaactcatctataagattttactaactttatgagtattttaacattaaaaaaatgtaaaatcagtccttagatttttagtgccacctgcaaacccaaaaagttatatcgtgagaaaattatgatgttttagaatttttttttttttatgttcacgatttatttctcttttatattttacattgcagaaacaatttttcatgcttattatataaaattttattacttagtttaaaaattacgtgagttcaatttgtccaagatcnnnnnnnnnntttgtgcaggatatttatttgtttttatataattataattcataattgaatggttctatttttaattgcatccttctcttaggttgggattttaaggaaagctgagtaaacaactggaaggctcttttttctctgaaagcatatatatatatatatatatatatatatatatatatatatatatatatatatatatatatatatatatatatatatatatatatatatatacgatgacgtgtttcatattgcatcacattgcaatgtcaaaaggtaaccaatttctattaagctatgaacctatcatcactgctacaattcaaagtataattgaaccaagtaaaatgctattagattttttttactgctttatcacttaaattgtttttattttactgcttcccaccacctctcagtcccttgtgtgtctgtcccctagtaaacaaaggtacttttctgaaaactgctatttttctttcctttttttatctgtatcaatatcttaagcaaaatctatttactagaccaattattgtttaggattttctgtaggatgacgggtgtctctgaagtctaattattgttgcttatgtttcaggaagttcctttgtgtttcatgaaagcacaaaatgatacttgttaagaaattcttttatattgtataaattctttttcaggaagttctaggtttccagcattacacccgtcaatatgaacctgtgtacctcctaatggtcttctggcgcctacacccgtcaaccttccaattgctgcagttgcaaaagtctgctacttatactccatctctgattcatggtgtatgataccttgcatttcaaacaactggttactttgatttttaattgattgataatatatataatgctgcctatttttttcaatggaatttacatgccaggcgcactctacatttttacactcatttaaaaaggcttattatcattagtgtcttcatagttgcaattgtgtttactagcctaagtgaacaggaaaatatcttgtttgatgaaatttatttatataatttaaggaaaatatcttgtctctaataaaatttctagttctatatgaaaatttaatgggttatatgccttgcagagttaaatttgtaacctcctttatttttcaggtcttaagcaaggacaatcctccttagaaaacatatatctataaactggatgttccagttgttgcaaggtggataactttggctgttgccccatttgaaattcttcctgatcaccaatttagccttatatcacatatgtgttcgctgcctaatctatcaaagatgcggaatacagtggattccattaaatccttcaggtttgacatgtgatagctgtaatttaactagcttgaaactggtagtttttttcagcataaaattgtataatgattaaatagttggatttttattggtgagcagctgctataaggattatctttctgtagacttcccatttgactcttatacaaaagtttgcatagagccaaagatggcagtgtcatcattgagtttaagagcctctatgagtgtatttagttctcaagttttgtttgatgagaaggttattgaccaggtcagttcactacttgaattcttttatttgatttttgattttttctaattaatctttttctgaatgaatataattaatcttccagcaattttctagtaaaatatgtcaacttccagccacatcaaatctccggctaatgtgaagagtgttccacgaatggtataatttttgccttataatataagtttttccttttcatctgagtttattcgatttaatatttaaaaattgggtttatttatgacaagcttgaagcttaattagtaatgtgtagttcatgtatcttgtgcgaaatgttttcatgcctcacatggttaacactgttagttttgtaggcattagtatttacaaagtagcaccctgtactcatttttattctatgcgcaagaaatagtcatccactcagggctttgaggaatgggagcagctagtccaacttcggtgaactacttattgaccaaaaggtcagccagccccgccagaatcaatccattccatcctatctcttcctctctctatttctctgtcaccctctaacttaagcaggtctgatccaatcaactagtataaaagagctcatagcccatcctttgccaatttctctcagccttcatcttaagacccatttatttgcctcacctcattgggtcccattagtgttggtggaaggtaagtgtaaatacactgaattactttgtaaaatcagttttaggctattgatttatgactatttatgatgataaaaacataatccattttcctttaaatgatatgaaagtacttacagtttggtgtttataccagtatgaaatgggttggaggagaggttctgcaagcactgccttatgatgtgccaattccaggttacctacccatgaacaccatcattccttatttgtttttgatatatatatatatatatatatatatatatatatatatatatatatatatatatatatatatttgtgataactactgcatatttagtatgattgtactagtctttcttgtgcagtgcccactggcaggtaaatcattagagcctttggtgttaatcttgaagaatctatttatgtcttataaattgaaaaaaaatgtgatnnnnnnnnnngaaataaaaacaaacaatgacggttatttaggaagaccgtcatcgtaggtggacatacgatgatgattttcgtaaatagccatcttcgtaggtttttaatttcaattttattttttttaaaaaaattaaaaacctacgaagacggttattaaggaaaaccgtcatcgtaggtcagtatacgatgacggctttctcttaataaccgtcttcgtttctatttaattttagttttaattttttttgaaattaaaaacctacgacgacggttattaaggaaaaccgtcatcgtatgttcacctacgatgacggtttttgtaaataaccgtcttcataggtttttaatttcaattttatttttttaaaaaaattaagaacctaccaagacgattattaaggaaaaccgtaatcgtaggtggacatacgatgacgnnnnnnnnnnaaacataatccattttcctttaaatgatatgaaagtacttacagtttggtgtttataccagtatgaaatgggttggaggagaggttctgcaagcactgccttatgatgtgccaattccaggttacctacccatgaacaccatcattccttatttgtttttgatatatatatatatatatatatatatatatatatatatatatatatatatatatatatttgtgataactactgcatatttagtatgattgtactagtctttcttgtgcagtgcccactggcaggtaaatcattagagcctttggtgttaatcttgaagaatctatttatgtcttataaattgaaaaaaaatgtgattacgataaaagattccatataaattgtaaataaattcctcgataaaaattactttaatggtattttaacctataaatatattatttttcacttttagtgttattatataattttattattttgttgtcccgtttgttcactattttatcaagagttcaatctgcttagttacttaagttgaagggccgaaaacttgaaacatgattgtttaacagttgtctcatataataatctttgcagcttctttatatgaagatttttttcttaaaaaagtggaagtacataaagatgcctgatcttccattccaagttggggatttggcagagcaacctcttttcatagttgaaaaggtgacaaattaaagcattatcactttaacctttttcgttttgttttattttcattatatatgtggaaagagaaattgcagtgaagttatctagaaatgataaaatttttttactgtaaatttacttttatgactgatttttattacttagctaacatttgaatgagttttatcaaagaaatattgaattatatgatcttgtaaacaaaccatccaaaattataagttgttagcaaaatatacataaatgatttttatattatatttcttacatcacccctcatgcaacaatccgttgtgcttgaagtatggacaatgcactggcctgtcaagcaacagtgatgattttttgggaacttttgggataaaaactgaaaccacactgttttctttatttatagcagggatatgcctatttttctccttataatttgggaaagaaaaactcattggtgaatctaaatcctgttacaagatgaaaaagttctgaacacatccatgatattatgttatactttcagaattgtttttctgaacatctggttagggaggttataaacatagcagtcaccttaaatactttgcagttatagttttccaagtattggcaccactcaatgttaaaatggctctagatttctatatatctttacagttaaatagaaggtataaacaaggattaccttcagaaggccaagcaactgtgagatcttcggctattgaaatagaacaagaaaaggtacaattaagatcaatttataacatggcacacacaactttatagatgttattgatcattgagtacctatctactttagaatttcattgagctcattgataacttttagtgttcaatctttggttcacctgttcaatcttgtattttggtaaaatatatacttaacttttagtgttcactctttggttcacctgttcatcacaacatcatgaatcctttgctcttgttcttctctaacaaaacataactattgcatacattcttttgctcttgttcttctctaacactctttctttataaactaattgctgttgtatcgattcatcgatatgttgcttcatagacaatgttttagcttatgttttctcccatccttcaaaggaatctttagtgagaaattggtaaaattattcttaagaaaaataaataattgatgattattattgtccaaactcacgaactgaagggaaatgagaaacaaacacacagagcaatgcatgaataattgaatattacctgccactgcttcttgtccagcggattctgaagtagccatattaaatattgacccattagtatgtcatattgttgcatggtattttatttaattttgtattaaattaaatttacagtgttaagctgaattttaaattttagtatactaacaatttagttttttttttattttatagaataaaatcccttcaatgtggtgtatttttttaattcatttggtagtatagaaaccaatttcgaaaaaaaagttaggtgatgcgtttacaaaaaaaaagtaattaacaaattgaaataaaaacaaacaatgacggttatttaggaagaccgtcatcgtaggtggacatacgatgatgattttcgtaaatagccatcttcgtaggtttttaatttcaattttattttttttaaaaaaattaaaaacctacgaagacggttattaaggaaaaccgtcatcgtaggtcagtatacgatgacggctttctcttaataaccgtcttcgtttctatttaattttagttttaattttttttgaaattaaaaacctacgacgacggttattaaggaaaaccgtcatcgtatgttcacctacgatgacggtttttgtaaataaccgtcttcataggtttttaatttcaattttatttttttaaaaaaattaagaacctaccaagacgattattaaggaaaaccgtaatcgtaggtggacatacgatgacggttttctcttaataaccgtcttcgtaggtttttagtttcaattttaatttttttaaaaaattaaaaacccacgaagacggttattaaggaaaatcgtcgtcgtaggtggacatacgatgacgggtttttgtaaataaccgtcttcgtaggtttttaatttcaaaaaaaattaaaattaaaattaaatagaaacgaagacggttattaagagaaaaccgtcatcgtatactgacctacgatgacgattttcctaaataaccgtcgtcgtttccatttaattttaaaagttaaataaaaaaaattagaaacgatgacggtttttcgaaccgtcgtcgaaagtgtccctttttaacgacacgcgcaacaatgacggttcaacaaccatcgtcgtagggataaaataaccgtcgttaaaagtctcctgtgtagtagtggcaactgcatagattaagcgaaaaatgtaaattaaaatcttaatatatatatatatatatatacatatatttgagttattttatatataacttaagtcattaaactttactcataaaatgtgacacaagtgacaaataacatgaatcatttaagcatatgttagagattcaatatctgattatgtgaatagagcaacacatgtgagtgcatcagccgtgcgagtgtttacatgaattgcttgtttctgatttgtttgttcgatatcaggtttaggagtcaatgaaattgctagtattttccattggctatgttgtgtgaattttttttttattagatttttgttcttctcggtcgatattgttgaactaggttttatgcttcccttttgattaggggtgtaaatgaatcgtgttagaatataagtgtgaaataaagtcgtatattagataaaaatagaaaagttgaacataagacttatatgcatgagtcttaagattttggttaaagtgtggtgtctagattaaatttgattttaatttaataaaattgattatagttggtattttgaattgtaaaacaatgttatgtttatgatttttgattatatatatacttctgaagattatgtatgttaattttgggaaaagaagtgtttggtgggcacattaacaaaccgaaagtgagaggagaagaagtgatggaggatggaaagatattgtaatcgtaacggtactagttaactatttcatccctgatctattgttgcgttggaaattttcaatcatcttttccctatgttcatcatgctagatttgggttctattatgtaatgttaactattatgttacgtgcttggtttggaagtttggctaggggggctggtatatggatgttaaataattctgtgtttggcgagggggttgaaattgtatggagattggtggccgaagattcgtttaagacagattttttacatatataagtggggtaaaaattcattgttacgtttgagtatgtttttttgtggctggaaatgatttgtctcctattgcagtgttttagtttgtgattgatttttttcttcttctttatgaagtaatttttcacggctaaaatcgtgagaaaatgatttaatacctgcttaatatttttatcaaataatttttgacggttttaactttcagagaaaaaaattatcaaaaaatgactgtcatatcaaaatataacggaggtatttaacgttataatctaaaaataaaaaaaaaattattaagagattcaaaattggtcaaatattaaaaaatatttaaaacaaaattataaaaatttaggaattaaaaatattttttatctttaaaatgaggatgtttttaattttagcattttaacataactcatttgttaattttctcattaaatatcgacaaaaattatcatgatcaattgacattgcaacttatcttataaaattatcctattactcacacattccctcctttctcgatcgttcagttttcatcaccaatccctacttatcttagtaaacctattaatactaatctcctgatacttcattatcgtcttcattaatttttcacttaatcctaaatgagtaaatgttggcagccttgagcctacagcaaacactgcgcattttgcagaaatgtcaccattgtcaacaaacacttaagcttcagagtgctaatctataactttaatttctaccaatatcgtttaagtattttaaatttgcacgttttcataataaactaaactaatgtaaaatgtttgagttaatactttattatagatatccacttgtcatttgtttagttttgaaaatttattatctctatatttacactagatttattgtccatattatttatatttatattttacttaatactttatccttatttattgacttagtgcatatgtataatttctaattacatactttatttttatattcaataaatgaattagaaaatgtcaagacgtttatctgaaatttaaagagaatatataactacatggagtatttataacatgtttggtatcacatcatttaactcaagacacacatccaattctcatgtaaacataaaagtttttatttttattcacaatgttaatttttttgttagtagaagagaataaatttatgatattttcctttttcttctctttcttctctttcttacttatttaatcaattttgtatatttatataaaagctactttgcatagctttcggttttcacgttttctatccagggttttcttctttctataactgaactaaacacatttaatcgattgatgtgtggaaattttcatgtgttgaattggttcaagtttgcaggctaggattgaacatggacactgatagttcttattatgagtttcccctctgttgttcattacaacttttagctaatgtctcaagggtttatttcccccgttgtcatgcttaggactatgttttgttttggccattaattcataataaaaagaaatagttcaggttcagggtatttcacccctaaaatgtaatcaatgaaaaacatatttaattgtgacgaagtatttttgtctatgaatcttagttgatgtaccgtgcacgtgtctctcttaaatacattctgagagaagacaaaccaatgtgctaattagaccaagttaggagtaaatgaagtaatgtaatgaacactggttctaactccttgaccaccccttcgcagagcctgccccccccttgatgacagatgatgctggaactttataaaaaaatcgattatcataattttttattccattttaaagaattaaaaaaaaaaaacgatttcaaatttccacttaaagtaatttcaagttttcacttttctaattctaaaagttttaagtaaaaaagtaaaattgtttctggttatcttaatagaaaaagcaagacgaattaataaaagtattattaaaaggattctagttctaatgaaaataaaataatttttcaattttttatttattaaatttaaattcaaaaaatagaagagttgagtgaaacaaaaaaaaatacaacaatttataagaataatccaataatttttgaaagaatcatttcggttcaagagtttaaaagtgcttcttatttttggttttatttttgtccaactataattttattaaatatttaaaaataagttttttttcaatatgtatatttaatattttactttttaatatattatgttttcaattccttagcaagtaagttcaatataaagaccattattttggaaaatgatctatgaaatttactagttatatttaaaatattttttatttatacctaataacccttttttgttatttaacaatatgcgaaaaattatacgttccttaaccaatattttgcttggctctaagtggaattttaacaatttcctcttattgatgtgttattaaatattaattatatatttaaataatattgggcttttacatataaataacttgcaacgtaaaagggcagagtagagtgatgacaaccagatcaatactaaaacgggaccccttcccatttctaaaaagaatactagttaatatttgtatgaaatattttgttttggttgaagtaatgaagttcactgacatatacgcttgagaaaggaaatttaattattgtacgtacacataaagtaagcaaaatttccacataacttgccaaatcaaaataatcctctgtacaagaagccagaaagtaacaaagggaaagaaacaacacccttgttgtacaataataacttggacccttgtggctcttcttcgatgatagtttctaatctgaatgaatttgaggatcttcgactccgagaatgagaaatgaggagggctggtgcaacttcaccacaattgtggacagatttcatttctctcaccatttgaaaataatgaaactcaagcaagcaaaccctttgttttttggcagaatgagaaaacttgaatcatttatagattgttacaaagaatttaacgaggtttcaaacccgaaataggacaggacagaaagtccaacaatgttagttaggaaccttgataatctaatctagtttgcatatattttcctcgacaactagaatttggtggcaattttgtttttggtacatatttggtggcaatttttttttccttttacttatttgggattcctttttacacattggtgaataaattctgttatagttgctatatttttttctggttgaattactctatataggtttttatattttttagaaaacttattgagtttatctcttttaacatggagaaacatgtaaagtaagaaagtaaaaagtatatcgagcattcgttatagttaattaagcttatgaaatactttattaaaataattaataaatattctttatgcatttccacaattgaaaagactaaaatgcaaaattcttacaatatgctcttttgtctatatatttaaatatcaatttagatattaactaaattcaagtcttaggcaaacacttaaaagaaaaaagtttccaaaacacttttttttttatagttacttaatgataaaataatttttatgtattgttagtataaaaaaatttcatactattatttaattacaattcattatgaatgacagtgtaaaattaatgataatactttaagaaaaacttaaaatatacaaatttataattaagtctctaatttaataataatttttaaattatgtttcaataagcttatggtagacggtagaatgcttaaaatataatgatgttgaacaaatttcaaattaaatatgaattgttttggtgtagttttttattttatttttcattcctctaaaatatatttgtctattttcgtattatttattttctactaaattcgctcttgcagaactgtttgagtcgcaaacccattcgaacttgaagtctgcaacgcccggacaccatcgacgaccatcggatgtcgacatcgtcgcggtcctgtgtttgagcattcaattccacaccgttttttcttggtatctcctccctcatccaaactgttttttttttttttttttgcttctctcacaattcaatttcagatttcttgtttccccatgcattcatatgaattgtgttgtgcttctgtcatttactttatgttggtgtgcgtatgccagtgcaatttacttcaattatttatcacatttcaagctatgctgcgtagatttttttgctatcgtgcaaaaatcagccctgttgtcaaataaatctggcacatcatatctgaatttctaactcatctataagattttactaactttatgagtattttaacattaaaaaaatgtaaaatcagtccttagatttttagtgccacctgcaaacccaaaaagttatatcgtgagaaaattatgatgttttagaatttttttttttttatgttcacgatttatttctcttttatattttacattgcagaaacaatttttcatgcttattatataaaattttattacttagtttaaaaattacgtgagttcaatttgtccaagatccgcaagcccaaacatcagtcatctccttcacatgaaccctaaatctgaactaccttgattccgctctgcaacggctgagaaaatagcgacgccgaaacacgctcgtcttcacgatcctgcgatccagcgcggcatttccagcgattccgctctccgaccagtctgcgcagggtgaagaattgcgcgattcgtctggaaatcgcgattcaagcacgtttcatccccgatacagagattcaaccacgattcaggaacaaaaacgagacaacctccgattcgtatcggtagcagctgtaatcgtatcgaatcgtgcgatacgtatcgtgaatcgtacgatactaactaccattgatgacaattatccaagtttcatatgatttaaggatggagacactgcttctaggtttttgcattgagtaacaataggtaggagcctaggaggtataaaaatcttttgaaagagtttgtgtcggaatgcttcctgccacgtcttcccatgggctctggtatgtgctatgcgtggagctagttcagaaatagttgccaatttactttttatgctttcatacacttacttatggaataatttgtttgctagtcttggtgaactttgggtggttgtgccactttgtaacagtttcttttaacttggttcttttaaggataaggaagctaaaattacatatttcaagttttacagttctatggtgaatttggtttgaccggattccctcactttcaagggagcctctttgccccttagtctactgttggacaggattattttatttgcttctatttggtgccttgctcatggatttttgtggagatgtcttcacctccaatatgcggagagctacgtatttaacagccttgctgcactcttgagtcttgaactttattgttatttcagtttttaaatttgtttttcctgttctggaggatttcttatccttcctactaattctttatcttaatagttcttattttacgaaagaatcaaaacttgtcatggattgcatatttgttaccattccttcttcaaatgttttatcttccataaatgctacaaacctaatcatcagtctgtattctgtacctgttactagaagatatgtgcatgaagttgactatagattcctaactgttttatgcaaataatccatttgcagctttcacatattggctgtcaaggatactcagataaactttcttggtaactatgctgacttttatgcaggaagttcaaaagggcatgatttccatcaatacagcctccatattggttgaaaattgagcaaattctgtttgagtatacaaaaacagccttgttgggtttcagcattaaatacaacatctccattccttttatttcttctatcactcccaacttctgtcatgggaaaagagaaacaaagcttcaaagaagttcaccattctcataatcctaaaacaactctccagtggttctttcttgtagctacctgcataaaagttcttcttttcccatcctaccgtagtacagattttgaggtgcaccgcaactggctagctttgactcactccctccctctttcccagtggtactttgatgagacaagtccatggactcttgattacccaccattctttgcttattttgaacgatttctatccagttttgctcacttcattgatccccaaatagtgcatctccaggatggcctgaattatagctccaacaaggtggtttattttcaaagagttactgtaattctttcagatttgtctcttctttatggggtttacagacttactcggaatctggattcaagaaagcagcagttgatctggtcattggttatttggtcaccgatgcttttcatagtggaccatgtgcattttcagtacaatggatttctcatcgggattttgttgatctcactttcatatttggaggaaggaagggatttgttaggtggttttgtctttgctgttctcttgtgctttaagcatttatttgctgtggcagcacccgtatattttgtttatttgttgagacactattgttggggtggaatagtaagaggcttcagtcgacttttgattatgggaggagtggttacagcagtgtttgcatctgcatttggaccatttttccacctagggcaggtaaatattatttttgtatcttgaattcatatttggtcatcatttttcccatatgtcttgctgttttcccctttttctgataaatcattgcattaaccaatttgaaattgattactatttgttgaaaagattaggaatttcaggtgtcttgttgattttcagaaatgtggaatgataaagtgatatgttttgtttccaacttattgaataatggagaatacaattggatgcttggtataaccatgaaaattgtatgagaaggagagttcttttatatgtcaaggttgtgccctgcatagtttctaatctaatgtcgatgtccagatgtactgagttttgatcaggttttataagaaaacaatttattttttatttattataatccttccacagaactaaaacaagaaagaagcaataaattaaatccaaagtaagtaaccacctgaactatctagtatccaaatgaggctaccgcaggaatagagcaatgctaccaaattacaaatgatcaactttgcatgctcaagtgaaagggaacaacttaaatcaccctttactaaattcttgtattcattttcctgtgtaaaagtgaagatatttcatatgcactctttgcattattgatttgcttattgattattcaaattataaattgcagatacaacaagtcattcaacggttgtttccatttggcagggggctttgccatgcatactgggccccaaatttttgggtattctatatcatgtcagacaaagtgcttgctttcatattcagaaaacttgggtttaatgtccagacaccaacaggttcattcaccgctggtctagtaggggattcctcaccattttctgtactacctcaggtaagatttacttttgtatttttattctctgaataacttgtttgttgttaaaccaaaaaaaacaaagtggatgttatgaccctggttaagctgatcacatgcttttgtgattatgtcaaaacagatgactgaagtaccttattttgctgtatacatttcattagtatgaggagatggaggaggatgttatattatttcttcaaactagttgtcatgcaccatgacctagccactgatagattggaaatttacttttaatcttgctgaaaatatatagctgattcactggatgatccttatcccattttctaagaataaaaatatagattataaatgtaatgttcacatggaaaccacaacttggtaactcaaaatcagcacctgtttgacatcaagaaatgatacttgtgaaactctataattggtgagagaatcataatattagcttttacatttcacacctcaggctagctatttcaacttcgaaggtgctacttttcaattgacatctacaattgagcttgataactagttatttgaaatctatgactacgatataacatcaacattagttatacaactttactttttattattcaaaagtttcatcaaagcattcatttttctatgtactaataatatgcagatcacaccatttgtgaccttcataatggttcttatacaactttacttttcactattcaaaagtttcatcaaagcattcatttttctatttactaatatgcagatcacaccatttgtgaccttcataatggttcttcttgccttatctccttgccttttcaaggcttggaagaatccacaaccacagatgattagtagatggatagcctatgcttatacatgtggctttctttttgggtggcatgtacatgagaaggcatcactccattttgtaataccacttgctattgtcgcaccacaaactctggaggatgcaaggcattactttttgctgtcaataggtatgcatttaatgctaattcatttgtttgcgagcttctaatgctttttttttcctttcatttttctaatgatataaaagttgaaggaaaaaaaacttgatatataagtaaaatgaaataaaatattatgaaaaatgtgtgcatgcttaattacatgtgatctttatataactagtggaaaacacacgtgatgcatatacccctttgaagacaatattttactaaatgtgataatgatttttttcaataatagtttgtcaattgctagtagtcttgcaaatatggtccttcctatcctattgttataggtttctgtgaataatgctccggctattgtaatctatgccctagatgtatatagatttgtcagatgtaggttcgtatattttatttccctttaaactgagtgaagccttttccattccgttatgtgtaagactgaacgaacacatgaagttacttgagcatacttaaggtttttggttagttttcaagacaaaggggggaaatgtaaagataagcagatttttcgttcatatcatagaaccttgtataatattcctctcccttaccttcgcatagcgaggaacctcttgataatggaatacgtagtttttttattttatttttatcatagaaccttgaacaatattatataaattaggatatatgagtatgtgatatttaagaaagtgagagaacgttatagaaaatacagagtgaaaaaagagtagtttctctgaaaatgacattctaaccggtaatcaaacttgtgatgggctctggtgcatataggatatgtgacaaatagggtatgatacaatacaagtttacatgaattttgcacaacggaataaaccatgaaaaaattctacatcagctttgtctttttctggtaatattgcttttttgtatatcatctacaatccaccaaacaaaactttgttttgaaacctttgtaagctggtaattaacgcataaatcttcaaacaccctttgtaagctggtaattcttcaccttgcttctgtttgttagtgtgtgttttggtgccttctattatttgagtaccctctgttactacagctgggttgcagctgtcagtttgttagttttggtgctgctggggttacaaggttgtgttaactcttgtctgtgtatataaagaactcggggttctctctttgcaagtaataataatagttcgcattcagtttctctcaggtttctttctctactctgtgctacagttttctttatactgtttttatattttcatagcccaactacagctaatattaagtatacttgtgagacaagcaactattccaatgttgcacaacattaatcaagcagcaaaaaagacaagcaaatctatagcaacagttattctatccagttcctcctttaacttggctatatgtttggattaaaaaatttgcttttaatgacctagaatacttttggatgccaaagaaacaagtttcaggtctcaccattttggtatcagtgctattcttttcatatttttgtttctttgaatttacccacgttacttgtgtgtgcagtatcttgctattctatttttccgctactatttgaggcacaagagtatttgatcaaagtattgttgctgcttctgcactccattttgatgtggtcaggattttcagcacaattttatgatggtgctgaagctacaagagcgccaactgctaattcaaagaaaaaaaatgatctatttggatctgaaggtaattcgggtgcaactgtgaagaaaggttttgctattggctggatggagaggatttatctgacaggtctcgtagttgtagagatatggggccaaattttacaccctttacttttgggtgataaatttgcatttgcacccctcatgttgatctccatatactgtgcttttgggatcatgtactcttggatttggcagttgatatccatagttaaatctcgttaaattttggactgtgcagttgatattggattttctttttgtgaattttatatgcgaaatttcaagagttaacatttgatttaacttttttaatcaaagcaagtcactgttttacatgagtattattaaaccatagttaaacaattatttgatcttgcctttgctgccccagattcatcttttccttttgtagggtggcttaactggctagagggatcagataaggctttgcatgcgggtgaatcctctagtgacgtgtcactagttttgtttgggagatccccctgcaagattgtggattatatatatatatatatatatatatatatatatatagccttatataagtagtttctgtgaagaaaaatatcttaaaaagtgacccttttactagattgtggattacatagccttggaataacttattcatactattgtatttttcttttaaaaaaaacataattggataaggatcgaagaataaagattgagaagggggtgtgtcccaagaaactgtgccaagagtgaagataaacagaatgaaactccaagataaagtcaatagcagtgacactagattaggatcatgcatgtacgttaacaacaaatgtgacagcttctattacacactttagaggcactgggctttgtgaggtgaaacaagaaaaaatgggaatattttaccattgcattattattgcgcaacctggacatctagtaaccctactttttgctttgctttagctatagctataactagtttttctggtgatgtatagtataactagtttaaatttatggcgcaaacttgttatctagtaaccctactttttgctacaactataactaggttagtccttatttttttgtggaactaggttagttgaatttggcggatctacggattatactattgttctctttacaaatatgaaaaaaaaaagattttattgtactaagtttagggataagatgacagtgatattttgtgcccaagacaaaattcaactaagttgtgctacatcccttttccattttcttttttgttatctataatctaaacatataaaaaatattaataacattccagtaacactgtcatgtagaacgaaacgatcacaatttttaataaagaaaagattgtgaaaaagaaaatttataaatataaatgatgatgtggccattgcttgtggaataataaatgctggatagtaacattttattcaatatacttttattgagtaaaatttatgtgagttctactaaatatgtcagttccgtttttcttttggtgatcagttcattcctaaagtagtgaggcttacatcaatttcaaccaataaaaaaatgtgttgctaacccccaccccaatctcgtgtaatatgatggaaatttaatgagggcaatcagcagtgtttgttcaaatcaagtcacatgagagaagagcttatgtgaaaatttagcttatacaaagggtattaagcaaatttaaatggtgaacaggactagttgtagttatatatgataatatagactattgaacattttttttattttggtaaaaaaaaaaggaatatttttatcctaattgtaacatttcccattataccgttctctctaatttcaaaaactatccaattagcttacatcatagaggatatatgcatttatcaccaaaaaaaaaaatagtggatatatgcatgaatgtagtgaaagaagaatgaaataactttttttatcaacgcgaaataattgtagttattaggtaagtttttgcaaactatttttaatgatcttaattttataacattgattttgtttagaattaaattcaaatgattttttttcaagaacaaatttaaagtaaaattgagtcgaaaattgccctctaaatgcataaaaacttagcataaagttatcatataaatgctgaaatatcacttctaaaaaaaatgaaaatgtggaaaattgaaataaatgttttagctgaaaatgtaaccatgcgtgactgtatttctagattaagaattcttcagaaaaaaattggcgaaacaagactatggtacaaaaagacaacagacaactaattggaatggggcaaattaaactgcagaagaaaattgttgggacttgagttgtgtagagtaaagtgaggactagaaaatggtcaaatggaaagagaaaatgtcttcaaatggcgatgctttaatttgaagggcagtcagttgttcacgtcacatgcatgtctttggttgtgtttccttccatttcctgaaaaagaaaacaagagtcaccagtcaaatttcatatcccactcatggctcatgatttaccaccaaaaaatagaataaaaaaatacaatattatttgaattgataatttcgtcatgggtaaataataaacaacgggaaatgaagttagtaacgattttctctcactgtcctggtgagtgtatgattatgtaactcctacatgcataacatgttatatccctctcatcaatagaaaaataatatttcttttttctaaattttaatttatcatttttaatttctttaggacttaatcactttttattcataaaaatacaatatttttttatgaggaacaaatatttttaatttatataattaagtaaatatataaaaatgatatttactccatatatttataggaattgaaataacaataaaaaaaaggaataaaggtggcattagaattaggaggaataactaagtaggtagccaaacaatttactgtacagtgaaacatataacaatttgtattgttttttgtcaagaaattgtattatgtataaacattttttgtatttttaaattaaataataaagagtttaaatttcatatattattagacagatacaaattatctcaaatatgattattataaaaaatatttatattcttattatatatgataatcaatgattaacttatgatgtatgattaaattaaaatgataattgtataattctgtagataatgatgattttaggtaataactgtcagctagtcatgattctgttttgccatcaacaggcaatgcgatcaatcctggtagtcttccaacagattttatctttccaaagtttactggtcaaacttatcagaatcaatctctacccgatcgattttcatttaatttattcacggtttgtttaaaacattgtcaataattttcttaaggcaaatttgttggtacttattttaaaataagtttctctaaattctctgtatggtaaataatagtaaagaaacgaagttttaccactataatatacgaaggtagttaaacattgagtatatatattatagggagattataatatttgcctattttcaattttaactatgaagttagaaacgttttacttttttgttgttttgaatagacgatgaggtcatttgcagtatgcaacagataacagagactgaagaacaaacaagatacccccaaacaaacacagtcgcggagcttgaattaaaatttagggggactcgataaattttaatgcatatctttaatctataatatcatattaaattgtaatataaatttaaaagttgagaaaaaaataatcaattacataaaaaatgataatttgtttacataattattacaaataaaaattgataaattttataatgagtgttaagataggaaaaaacattatatgtcaagcattacatattttagaaggaaattaaatgattattttatgaaaacataggttgcaaaactataacatcaaaatggaaaatgggagtaataacagtgcttaaaaaagtaaatggatcactgcatttatatcaaaacagaaaaataagtcaataatacaattgagataattatatattcaaaaaataactaaagttttaaaaagaaaacaaatatatacttatgaagataaatcatataaatatgaaaaacaaatctattaatattgttgaaactaagctacactttacatgttcagaagtatatatttgttttcttttgttttaagaaaaaagtataaaattttttaaataagtatttgaaataattatttgaaacaattatttgaaactaagctacacgttacatgttcagaaattttttttgtcctaaattacaagttaattgagttaaggtaaaaaaaaaactaagtatttgaaataattaatatttttattaatcatattattataaacatatatatttataattttgaaaaactttagtatcatggctcccctagcatagtccgcatgacatgatgtgtgaatacaggaaacacacatgacacatgcaatcacattattatgcatccatcacaaacactaatcatttcgtacggatattatatcatatgtatgacgtgctttctctctccctttccctctcaaaaacaaaaacccaaaattatctgcatgcatatcaatatcatcaattattatcatccttactagtatttagtagcaccccactttccctcaaaatccatactcaccggcgccggaaagagaccatcgacccaactaacttttctcatttaattattttaacatcacacgtttaaaaagaaacaaactttacaataacataccttattcaatcggcatggtcgtcgataggatttgattctttaaaaaaaaaaacaaagattaaattaagtaatgaatgaaaaagttaaatccatagcttgtgcatcttgtaacagctgaaattatctgctaattaaatacattctaaaatgagtaatacttgttttttttcattgggtagagcggactacataataatcaatacttaaaacaaaggaaaataatatgcactatgcatgcagccatattgttagccattaattaaacattctttgaatcaagtttgatggagaaaagtatgtatctattctgtaaggaagtacataatcaacataatagagaaccctcggaatacacggaaatacatcttcggtcagtctctagtagtaaacttaattactatcacttctcttctcactactcgagtatctatctatcactataataattgagttcaactccaaaaatttaatgcacttagaccgtaaaatttgtaaataacaatagtaaatattttttcatctctaattatagaattttttttctaatttttacatgtatcaattatttttttcttattcatatttttatttaattattcactctttaaatattaatgagaaataattaagtgaatagtaagataggaaaataacaatttttaaataataatacaaataattaaattaattacttttattaaataacataaattaattgaaagaattttatgactaggaaggaaggaaaacattttccggaactaattaactaactccaagtctagcacgataaacattgatatatatatatatatatatatatatatatatatatatatatatatatatcaccannnnnnnnnnnnnnnnnnnnnnnnnnnnnnnnnnnnnnnnnnnnnnnnnnnnnnnnnnnnttccatctaaaatgattaacattgatcgatcagtttcaccattaagtacgtacacacatcttaatcctatgaacataaaatattaattgttgcaaatatatatatatatatatatatatatatatatataatctggcaatattaagtaactatatattaactgattatatattgaaatttgaggcaatagaaataggaagatgaattagttaaagccaaagggctccggcttgcttgaggagaggaacgagagtgccgttgatgtgggcagccatgagggtctggacaccgccgaggaactttccgccgacgaagacggcggggaggggctggtggtgggtgccggcggcgagctggaagaggagggcgtggatggcggggccggcggcgtggcggtcaagctccaccaccgtgggacccaccccgaggctgaagagaaggcgcttggccacagtggacatgcagcactcgctggagctgaataccaccacggccttgcacgacgtcaggcggtgcaccacctcataagggctcatcatcgatgtcgctgcttctgatgctactacctccatttctgagttaattacttgctatattgccttggagagagagagagagctagcatacatatgaaatgaaatgaagaaggtgtgtgaatatgtgagtttatataatgtatcgaggaagctaagagagtaggttggtaagtgattaaccaaggctttttagcagttaaaagtgatattggactcgtgagtccaaggtaaaaacaaaaaggataagtttttaccatctttggaattcatcttactcactatagggtatattttcagagagcatgcataatggataatggattattaattgttgccatttacagagaaataattaaggaaatagatttttttttccttcttctttcttttctgaatccttaatgatcttgttgtttatatatataaatgggaaaaaatcaatttgatattggaaagatacgaagtgcattagtcattatattatatgttaatatgtaaagctaaattactccaaaaattaacaagtgtcagttagcgtgaggtactgaggtatgtttataagtaatgttggatttacatagtaacatatggtcaagaatttcatcttcttcctcttttatgatcatctctattttgcacatgtgagttctcccatttttttccttatgaaaataacctaaatccggcccctcactaaaatctgcttagtacttgaagcaaaatggcaacaaaagtccaaaagttatttaccccacccatttgtaagtgtcgttaatcttctcaactcattcactggcgactacaaaatcacactactaacgttcatgtcacatgtactaaaactagtaggaacttgtgtgcccccatcgccattacacaaagatgatgggtacgtttggtgattagacatgtgggcaacagaagcaagtggagagaagtattctagagacaaaagccaagtttttaaagaggtacgtattaaagagatgtgacttttaataagtgattgagaagtcaaataacaaaaactgattaactctcctttcaaatgaagatagtttagcgtaaatcacttggcaaccttagaattcttgtaatattcacagcttcactgtggttatagtgctatatatatatatatatatatatntaatattgtattttacttttgaaagtacgtacgcctgtgtttactcttttagaattgtacacaagtttaattaaggtagtgtaaagttcatgaataatgaacacaattattgttgttggtgactaaagtctaccgcgtataataactcattgtacagaaaaaagaaaaaaaaaacgagtataataaatatgacagataatcaatttcaaactctttcaaaaataaaaatagtgtgaactcacttgattcaaaataaaaatattgtgaacttgattcaagaatttgatttcgtcaattttacaaaaatgattgaatttgttttgatttcgaattaaatattttttttttcacttcaaaactatcttttagcggtgcttcaaaatggttcattactgtataaaaaatataaaagatgttaattattttcttcattaagtgaaatctgataaccttaatagtttaatctaatgattcttaattaacatgggtatccgatatcgttaatgtgttaagctgcaaagtaaaaagaaaaagatttaaaaaaaagaaagaaagtagtaaaagtgtaagggagaagaatgagctgaaaaaggaaggtggctagctagggcgaatgggaattggtgttttgtttccttgtgttgcgtttgatgattgatgatagagagacgacggcgttttcaggatgtgatgtcgggctgtcgggttcaatacgaataaaaataaattcaaagacagatatgtaagaaattaagtaaccgtacgaaaggagggtcacgcgtcttatggtgttggagaagagaaagaagaaagcgaatcacgattcagatttcacgactgtgactgtcacacatacaatatcaactgctgcatgcagctctgctgaggactgagtaaaactaaaataggcaaagcaaaagctggcacacttgcatgccacattatatgctatcatatcccaataatgcctagagaaattcctatctcttaaatgttacgtgtccatgtgcccctctctcagtccaacataattacttaccacttaattatagacttgtgtgcaataaagacttcaagtgcctggacatcgctttgactgctatctgccgtttccaatatcttgcataaacgagtatcattatcaacaataaatattgatcagatatacatcatactgaccatttattctttaaataaatggtttaaggtttaaattttaattttgaatatgaaatatatatcttaaacatattcatgattccaaaaacgattaattaagtttcttgactggaattactccatatctagattcaagaccatggtaaaaaaatgccacataaatgagcatcataaataataatttaataggacgacaggctattttagaggtgaaaagtggcatattttggagatttggtacagatgacataggctagaaaattttgaaaacataagtgggcgacaggctaatttagaggttccacattaaaatcagaagaaaagaaggaaattggttactagctatcaccaaactttatcaatgttaccttagcttgtcactctttatgtttgagtcgctgccagaacgaaaaaaattaagtatggtatgttgatattagtcgtgaaaaccaattgtgcagtgaacataatcgagtatgttatcaaagcataacaatcgattatgcaaataagcataatcgactatatatagtccaacagttgtttttaatttattgcaattttctcattcttttacatcaacaattttgacccaacaactcactatacaccggttacttattttttaagcataaatttttgctaaagatgctcttaacaaattgcaacgtacactcccctcgttccagcatctttttggcttttgcttcaggggcactcttcgtactggaaagtggaaatcaatgcttcttcaatttgtggtatagcttgaagccattcaagaccctcggggtagatggatcacaccctggattctttcagaaatattagggtttattttttggtgtgaagaaatgctaggttttaacaaatcacataaacacaaaaaatgaggtctttataattaaggccattttggtccaaataatgtgaaaatttcgaaatatattaaatttttcactcccatttttttcaactcttaagagtaaaattgttgtattatacgagaacataaaatggttcatggacgctcacaaccctataaacactcaaaaagagaaagagatagaagagagagaattataaatgtaataggtattatgacttgaaaaatgagataaagaaaaaataaaagatgataatttaattagtagtgactagtaaatactgtgtgtccataacttctgaaaaaattctaagctgcacattaacgcttttaatccgcagggtataacacgtgatggataaatttgcagttacttagggttataacgacaattatatttttgaaatattggaaactgcaatgcttccaatccacactatcagtatggcgcttgcatatcgatatattgtagataaagcaaagttgccgcaaattcagaacaatcaaaactagaagcaggagcattttagaattattctccaaactatatatatggtccccagctacattctactacgttccccaagtagcaaaatacacaagccattgacataaaaccaaatatggattgcagcagtggttaaagatttaggtttaacttcaagtctcgattctatcactaaaattttgcttaggggataacttttttcatagagatctcttgtcgtccaaagcctaatcaagtagcgacgaggtgataaaatcgtttacaattaaacctatatatgcattaatcttcttacgtagatctctctgccaatagcaccacaatatatgtatacacatgctaggtaatatttggattttttctttgttctatcgtttttatgagtaaaaaaagactaaaatatgttttatgttcttataaaattaaaaaaaaattcaattcttgttgctataactttttatatatatacttttagtctttataaaattaaaatgtcataatttaactcaaaattagagtaagttaaaatcaaacttatgtgtttaatgaatataggttggtctaattttacacttatctcgtatttaagtggacattcattatacatatagatttgattttaattgatctaactttgaattaaactataatatattttaatttaacaaaaacaaaaaacataaaaaagttttgtgggaatgaaaatattcttttaaaaattttataaggacgaaaaaatatttgaaaaaaaaaaaaaaaaaannnnnnnnnnaaaaaaaaaaaaaaaaaaaaagaggcagtgggcggagaaccagccaaggaggggggaggaggtggggagggatgaggggaggacaatgcggtggagttcatgcgtttggacgtcgacagagtagttcatgcgtttgaacatctgacgtggtttcatacatgtatcgctgacgtatccaactaacggacacattatcacgttttggatggagactagttacaggaatctcctacaaaacttttaaagttttagggatccaataagaaacaaaaaaatttcagggattaattataaaattcgaatatatttcagaaatatcaaacatattaaagcctaaaatatatcattaaattgaatataaaaagtacttaaagctactgagaaagaacgaatcaattttcttaatgtgaacttaaaataagtaccgaattgacatgaaataaatgtgagactacaaaataacactaatattaagtaaataattttcttaattttggtatagaaaaattataagacttagtcaaaataaatatcccttctattgaaaacataggattactatatttctctcttaatctaacaagatctctcaatatgtcttcttctagatgatcaacaatatctttcaattctcataaagtacagaaaaaattacaatttactctcttttatctcttttccttgaagagttatgtaagaactgtcacttattactattcttgtctaagatggatgggttgttaatgattcaactcctcacaagtctttatatacgtgtcttctttcaagatcaagggagtaatgaatgataattaatggtaacttgtaattttttacaattgttgatatcctaaannnnnnnnnnagatttgattttaattgatctaactttgaattaaactataatatattttaatttaacaaaaactaaaacataaaaaggttttgtgggaatgaaaatattttttaaaaaattttataaggacaaaaaaatatttgaaaaaaaaaatcaaacgaatccgggttactagcaaaaattcccggttggaaaatttagctttaaccaatatatatcaagataaaaatgcaaaatataactacttaaaacgcgtcaatatatctcatacgtactagatatatatacaaacaggaaaagaaaacaaaaagaaagaaaaaaagaagtgatcaatcacatacaccaaaacttaaaaggagcaatgacgtaaagtcctaaaatatgtagtacttccttcatggcaatgaacgaatactccccaacatgtgattcaaaaactggtaaattgggtcaagacaagccctgaatgggtttgcatgatctaaaaccctccatcttgaataggaagcagccctgttctttagcctttcccagaaagacacaaagcagttttggtttctggtcaccaacaacgccgcagattgtaggtaaaccgaagctgcacgcttcaccaactcgtttctgatagcaatggttgagtcaaagtcatttccctcatacaaggttaaataataccttgttggtgtgttacatataatgtccttcaggctcgtgtattgtatattttcaatgatttctgagtctctagcaactgaagagattctaggaattctcaatgaacgtgtgctctgaatctctcctgtttgtgtttccattgttaacaaaagccatgtgacgttgaattgcatgcaaatgaggccatgctgaagagtacaaattggttcctgcaaatattggaagtttttactttggtatgttgttgggggaaaggacaaaagggatgttcatgcattattaatttttatattaggtgcgataagatcacctttgaggcttggaaaggtatatagaaagagagacagagagagtttggtggaattactgattatatatgggtttcctttgatatagggaaatatttcccaaatagagggtcaaattgtacgcttatacgaacaagtcattattttaagtggtatcagatttgatgttcctttaaataagatctgggatttgaattttgtgaatgataaaaatgtgattaagaggatataatcacactaatgatgatcaactaaattttcaatggatcaacaaagccaataaatactctgaactaataattaacatcataaaaaaaattataaacttattagcattcactttatgaaaagaaaacagccatatttctgtcactaccttattgnnnnnnnnnnnatatatatatatatatatatatatatatatatatatatattgttgatatcatgtgaagccgtgaaggattcgataagacaatctgatgctactatggtcatgtccttttggactggacattaattaattgataccttgtctttcacaacaaaatttgagcaaaatgaaaggcatctcataggctaaatctggtttattgatcatattgggctgaaagagtgctgtttcatagcaacttggcccactttcctattatattgggctgaacatggccctcaaagacgttagtatatgaaattccaatgtgggaggcctaggaattttgagctggaaggtaggccgtaggactaggattgaagcctaatgattttccaacccatggactaattttaattagtttcattaaatctgagactattgtttcttgtactttcattattacttcctgtatattatggaaaactcattttaaaatgtaaattgttgttccttctgataaagttttcaaaattaaaattaaaaaaattaacttaagattaataatgtcttatgaaagattaaattaattaacttcattactgattaaaaaatattatgtatcatatcccataccaaaaacaatttaaatataattataacaatttcagtaaattatattagaaataatgtctaaaacgcactttaaccttcacaacatatatatgcagggaaactcaattcctcctgatgtctcattaataaaaaaaattatgggataatccccttgaaattgaatttccaatgtaatagctaattcaataaactcaagtaaaaaaaaaaaaaaaagcactaggcttcaaagtcatggctccacgacacacatgccagccaatttttctttttctaaaggatttcctttcctttatttctgcttcggtaggatccacaattccacatgcttgctcttgcatttgaactttacataaaatgggacctgtgagagtgtctaattggactctagtcactattaaactaaaaattctaaaaagtctaagaatgacgttagtgatgtaatttatcatttaaatatttgatttatcaaattgtgttccatacgttggacttttgtgatttcatctttctttccaagttggcaacttccgctttataagttccttcacttcatttttatatacacattttactctaatacacactgctttagtcagctaacttatctattgcgactcttttgttgacctatacagatatgtttaagccattaatttggataaggcatttttttaaggaattttggatgaggcattggatatattatatagtattaaacaaataactcgatctactatcgtattagtgcaaatgagacacaggtcagacaataatatttcaataatttcattaatttaatcaatttacgcttattattcatacacgttttcctcttccctcaagcaatataatcattcttgaagactaactgaagttttgaaatctccattaaaaaacaaattatcttcttttactattgacacttaagttatccttaaatgcgatttattcaaaatcgtttgtctaaactatttatttgacgatttgagtgttcatatatagtaagtagctagtgtttatttaccatgttttcatgtaatagaattattcgagttcaaacttaaagaaagaaaaaaaaaagaatataatgatcaaaatgttagatcacgtggacggttttttgtatctgtcactttttattggaccatttctcgggctattgttcaattttcattaaaaagatatttctatttgcttataagaaagataattaaaatgtatggaagagaaaagaatgaaaaaaattataaagaaatatttaaattaaataaagaaaaaaaaatacaagatccacacataattttgaaaatttatctttctttcttttttatttattcacaaccaaacatacactaaaaaaataagatccacgtgtttaatttactttgccgagtagtatattttttgcgaagttaattgacagtttcactttattatggttttacaggcattcatattgtttactcataaaacaaaagtaaacacaaattggaatatgatgatttgctataggatgtagatatggatgagacaggtatcaaaagggaaattttcttactttgaccgaatctgtcaactgtgtttcacatggaaatcgtaagcaacatgcttcatttctttcttggggttgagtttcgtgtaaacatttccttgtcggatgcctttcacccaaattgtagtcatcgcggagaatcttacttttgaaagcgaagcataaacgtgtacgttcttttgaatcacaaatgagcatttgtgtttgaatattaatttgatgcaatatatagaacacaaaacagattagaattttccaagacatatagatcgaaagttctttggcccatttgtataattatagctagagtgccatatatttgtaacacgcttaatgttggtagtttcttaaagatagttcatttttaaagtaaaatatatgtttaaatatgttggacatctctgcaatatacttgaattttataactgatatttgaaattttgttttttttttcgttggtttcttcaaacttcaaaagttttgtagaagatttttgtcattagtcctagtctaaaacatgatgatgtgtctattatttagacatgtcagctatacacatatatatagtcacgtcagacgttcaaatacgtgaactacatcgtcgacattcaaacgcgtgaactacaccatctcctcctcctctaccaccgtccctgacttcctcacctccccctccttccacgacttcgttggaaccatcctcccctcctcctccctcttcctcgaccagttctccacccctccatttttttatttattttctttactttttttctttctccatttgtcatattctcttcatcttctttgtgtgctggtgacatcggcatcgttcatggttaggtgtggcatcccgcaaggttttttctcttcacgacaacaaacatgaacacattgacttagatcatttccttctatctcttgctccgtgtcttgtattctcatcaacgaaaaagattgaacatcacagcgcatctacatcgacattgattcttcccacgtgtgagatgttactggacattggagtttttttaaaagaggttttgcctgaggatttggctttccgaaacaactagatcgacaatagggaggtagagtagaactttggagtctgaacaaccagatcaggtgagcacaatgtcgtttcgtcgtcaccatgtgcactctaaagcctctacccccaaccgaagcacctgccaaagaatgatatggcaaatcgcaaatgtgaagaggaaatgactcttttcatacctctagttaaaaacatgttattttcacccaaacaaatattttatagatctaagaacacaccggtaatgaagctgtaggaattggtgaaatgaaggggataacaacaaatggagaaagaaaaaagtaaaaaaaaaaaaaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatgataattaatggtaacttgtaattttttacaattgttgatatcctaaaactcctaaatttcactgttgaatcaatgtgacagtccattaattgtggagaaattttaatataaatcgaccaatttgatataataagcatcccaacatttcaaatgaaaattataagattaatttagtgattaaaaataagaatttaagagttaaaaataaggaaaagaaattgtgaatttgaatatctcgttaatattttaataaaaactcgtaactaaccaaacttataggaatgatgactgataaaataaaaataatgtcatcatgatgagttgttgaaatgtccattctatgactatgactatagtcgttaccattagtaaaaaatgttttgataaagtatataaataatattatattatcatctaataataatttattatttataatatatttattaatttatataataattattttaaaaattatataaatgtgatttatgattacataatattttaaacttactttacactcatattattagactttataataaagccaaatcaatataaaagaaagattaatacatgtaattatgtataatctttaggcttagctttctatgagggatcacttttggcgcagaagactattaaaataaataaatggtataccatttgaataaacaacaaaagaaaacaattatcgtagtcaaattttttgtttaagaagaatgggattatcttcataaagaaagcaacaaaaggaggattataatattttataaaaaataagacaaaaataaaagaaactgttatctcaacaaaagatatttatgttctagaaagaaaaaaacttatcgatatattttattgttaaatctatacatccttcaaaaaataaaaatataactccaacctggatgtagtattgtccgttgttatacagggaaaacactccaacctggtgccctgttgtcaaattcttgcattacgaatctcaatactatattacccatttcaaaccatctgaacacctaagtttgtcagcattcaaatgcacaatccatagtatattattatagtctttcgtccacgcttcaataaatcagtagtctttgttttcggagaatatcataatttttttctctatgctgatgagtgatgacaaacccatatcatatctcttgaagagctaaaaggtccagagcttcagtagtgagttgacgaaatgagattaaaattgtcaagataacatgtcatgttttcttttaaggaatacctaaaataacttgaaatatacaatacagcaaagtgatacaatgaaaataggaagaaaaaaaagtgtattagtaatctgacatttggataattagttatcgaggggaattaagttactactttactctacatctctactctttattttcaattttaatataacacttaaaattgatgtcttagatcttacaaatcattcatttttataccaataaatttatctattcttatgatatatcatatttttagcatataaattagacaaaaatatttaaaataatatataattattaattttactgagaatatttttttcatatttttgtattaagaatattttctggtcgaccgtcggagattaagtcctttgagaaataaataagtattatgcctcaaatttacaaacaaatatcatatattattattatataaataaatatcgtttatacatataaaaaatacttaacaactttttttaaaatgcctcaaacccagaagatgcacccaaagcagtaccttgatcaatcttaagtattgtaagagcaatatatttgaaggttattgccaagccagaaattatatttgttttaagagttgtactatcacaaatttgaagctccgataaacactctatatatgtaaaatattgaattttatagcatttagatttatactttttattttattttaaatgataaatatcttttcttggaatgtagagtttgtataaatccgaatttaacttttttaatggtcaaaaattagtaatacgacgaatttttttaaaaatcctttcaagaaaatatgtggtgtcaatgcccggtgcaagcttaagtccccgccgtctacgagagtcttctccagtcgtcagcccggcaagataagaatgcataagatagtagtgatggactttgacttatcactactaatttccacataaattattctaattttttttattctctttttaactcaattttcatttcccttttgtaacttctttttgatttattagtgcattgttaagaatattttagaaaataggttaaaaatatttttaaaaattgaaaagcatttaaattcttaaataaatgataatcaatacattgaataataaataataaatacattttgttgaatgtttgtaaaatgattgaatatttctctttttggatcaaaactagacttgaaattcttaagtaagagtttaaggtttggggattaaaaaaatttaaaaatatgattagaaaaaaattaatttatcaaagaaaactaattattaataaaatcgagaaataatctgtattaacgttataataaatcacaaaaaattaattatcatgtatttacatctaatttgagagtttgtataaagataaaaactcagtttttattctaaccaatgatttattatgagattttgtgtaaaagataaaaactcaattttcattcaaatcaatgatttattaggaaggattaagtagttttatattgtgagtggcataagcgttttcttattaaatattttaaatacttttatttttcggtaaaagaatctaaataatacaatttaaataaaaaattacgaatatgagacttttgacaaattatttacgaatctggggcagtgggtcgcgcccaaaactgggcgtgatcggtcacgcccaattttgggcacgacccaccagatggcgacacgtgtcatgacagatggagcgatgcgtatataaatttcggacggtcataacttttgattgggatgtccaattgagatgaaaccggtggcgacgcgctcgaaattgagaggagaagccctaggcactaaagaagctaaatggtattttttccaaattatttacgaatttagggctgttaaaaaaactatttacgaatctggggcttttgacaaactatttacgaatctggggcagtgggtcgcgcccaaaactaataccagccaaaattaatactttgagggaatcagttgaaatagaaatcaaggaagcagaggccacagataaggtcagcatagtcaaaatgctgaaaactaaaactgtgagaagaggtttgtatgcaggaatgggccttcaaattttccaacagtttgtggggatcaacactgtgatgtactacagtcctaccatagttcagttagctagttttgcatccaaccgaacaacacttcttctgtcactagtcacatctggtctcaatgcatttggttctattttgagtatatacttcatacacagaacagggaggaaaaagcttgtgttgttcagtttgtgtggtgttgtgttctcccttgttgttctaaccgttgtgttccatcagagtacaactcactccccaattgttagtgcacttgaaacctctcacttcaataacacttgcccggattaccattcagctgtgaaccctggtggatgggattgcatgaagtgcctgaaggcttctccagattgtggcttttgtgcttctggagccaataaggtaaacttgtcctattattatatgaatttgtttaggtttaatgttattttgattcattttatttcttgttttgttttggtatattaagttttaaaaattttattttaattctttatattttcaaaatgtatcattttagtcatttttttaatttttcattaaaaacattaatgttatgttaagtttaaattttaagacagtttaatgtcatatttttaccgattatgttttatatttgtttcactttgagataaaatatgatatctaatttattgctttttattgattgaatgaatgtctattaaatagacttaaactaaaatagaagataaaatcacaacaactaactctatttagagaaaataaaggaatactagaaaataaaggtaacaacatagcaaatatcctataacatcttatacaattagaactatacaactatacaacaaatgcataagcgtctctaactctttgatacattatgttttaaaaatttcattctagttctttatttttcaaaatgtatcgttttgatcatttttttatttttttgttagaaactttgtgtttgtccgcgtttaaaattttagaaaagttaaattaacatagtgacaaccaaaaatcatcattgtctttttatattttaaaaattaaaaatcactaaataaataaagaaaagatagatctaaaatcacaaacaataatcacattcactctcatattattattagtataattgtcttcattcaatttaatcagttaataaagataataatattattcactaattattctcaatcacaacaggtaagggactcttctcctttagccacttcgcctctagtcgtcaacccaaaaagatgtcaacgagattatgtgttgatgttattccatttatgtggtattttattttttaccttttcatatctaaaagagattggaaatgatgataatttttttatttatttatttttttaaaataaaagaaagataataatagtttttagttgtcactaagtaaagttcattatttaaaaaaatttaatatcatttttggttcattatgttttgcagttggttcgttttggtacattaagttttaaattattcattataatcttttatgttttcaaaatgtattattttagtcatttttaaaaatttagaaattaacataacactaatatttctaatgaaatactaaaaaaagaatcaaaacgatacatttttaaaatataaaagattagaatgaaaattttaaaatttaatgtactaaaacaaaataattaccgaccataataaattaaaagtaatattaagccatttgtttattatattggcgaataagctaattagaccatgaaaatattccatcttgcaacttgttgcttgagtttaattattacaagttagtctccaatattacaaacttcgtattaactacactcactagtatcagcctaatggtagaggtttgaacagtataaatgagatcataaattctaacttctgtgtgatcattgtactctaaaaaaacttacaccaaattagtcattttctttatcacattttaactcctttgattgagaaggattaagtttaaattttggtaaattcatgaactaaactcttatattgatcaactctaggaactaagttgtttatttatccaaaaaatgatataatcttatcattgagttgtaacacttgtacaaattgtgtgcagctcttacctggggcatgtttgatctccaatgacacgacaaaagatcagtgccataaagaagatagactatggtacaccaggggatgtcctagtaaatttggatggcttgcaatagtagggcttgcactttacatcatattcttctcacctgggatgggaactgtgccatgggttgtcaactccgagatttatcccctaagatatcgaggaatatgtggaggaatggcatctacatccaattgggtctcaaatcttattgttgctcagtccttcctatcattgacacaagctattgggacctcatggacatttatgatatttatattcatcaccatagctgccattatctttgttattattttcgtgcccgaaaccaaaggacttccaatggaagaagtggagaagatgttggaaggaagagatctcaacttcaagttttggcagagaagttctcactatggagaagaagtaccaacaccgaagactcaatcaacttaagtctattgtgttgtatcatttgtaatattggagtattaactagggaagtataggtaataaaatcgtagaatgtagctattagattctaagtatatacaatacttgtttgtgtgaattttttttcttatcaacaaatattattttattagttttattagaaatatcgttcaagaaaatttgaacttctaatctttttcctccttccttcatccttctccgatcaatgagccaaaaccttatattatatcttctaccttggttgtctgaatgttacaaattgttatctgggactcttttcgaaggaccaaagagttttattttatgaaagaacagatgaaaattcatcagggaaaacaattggctactgttattacatctggcataagcaggggagataaggaaaggtgaaagctcctcaacacacagaatctgacttagtaaaaaaagataaaatcaattcggtcctaaattattttaaacagtttaatatgatctttaaattttaaaaaaattaattttatctttaaattcttaaaaatgaatcaatttgattttcaaattttttaaaaattcaatttaatccttaaattcttaaaaataatcaatttggttttcaaatttttaagaatttgagaatcaaagtgaacaatttaaaataatttgagagatcaaattgattcatttttaaaaacttgaggataaatttaatcttttaaaaatttagaaactaaattgaaccttttaaaatctatgaaccaaattaaatcattttgaagaacaaattgataattaagcataaaagaaaaaaaaaattggttactagtacaaaataagttttaatttttctataatcctctacttgtcttccctattaaatttgacatatttcccttattagattcgtgaaacattattacataaatctactgatctgaacatgatggtatttgaaaaaatacatttctctaacatcatgttgaagcagtattgaatacacacattacatattctcacctcatttctctctagaaaaaaaataaaaaataacttcctctttttgtttgttttcacggacaatctgtatgatggattgctagttttttcttctttttttccccctatttaatgccacgttcgaaccgacattccaatggttgagttattggcaaaccacaaaactacaactaacatggttgattacaacttaacttcgtgactactcgttaatattagtataatttatttgatactgatagtagaagttattatatttaggacatgctttgtaattataatgaataacaacaaaaagaaaaaggggtcatgtaacctttgacgatatatcaattttaaaacgtgtgtctaatatttcactattcaaaacattcttatgttaaaaatcttcaatccagccacatgtattaaatgcttttagaagttaaagaagtcacatgtgtcaataagtgagtaaaagattataatttatcagaagaattggaaagaagatataccaacaactcaacaagatagtcaaaagaagtaagattttttattctttttgtcaaaagaaactagatttgggagtagtatagtaggacacaggaaaacaagattcggtacccaactgcatatttggttgcgctaaaaaataattaaatattatttttggtttattatgttttaatattttttattttcgtatattaaattttaaaagttatattttgattttttatatttttcaaaattttattttcatcttttatatttttaaatgttttaaattttgattttttcttttgatttttattactaaatgttagtgttatgttaatttttaaataattaatttgaaattgcatgatttaaaatcgaaacaagattcaaagtcactaccacaacatcaaatttgaagcttttcatcatcattgagacccaatattttaaatctatattggtgttgagtcatagtatagctaaagggtgcatgatgatattgtttagtagatggatgttgtaaattgttgatgatgattgtagtgttgaggaggttgtagatatgagtaaacatggttgcataatttatgttgtggtggctatagattttgcagaagaatatgactgaggttaaaaaagtaagtggtggaatgcattttaaaaagacagttgtgctatttagctaccacaattttaaattaatttttcaaaatctaaagttaacactttttttgtaacaaatacaaacgttagaataatttcaattaactagattcaacgaatatttttaaatacaaaaagaaatacgaatataaatttaatatataatctaatatagtataatatttctttaggatatttacattatatctatatatctatctatatatagatagatatatatcgatatatatttctaatagattctaagggaattctttaaaattcttttatttaatgtttagtaaacaaatattagattttaattgattctttgaatctcgacaatcgactaaaaatttgttattatgatttcgagtaagccgctatggtgaaattggtagacacgctgctcttaggaagcagtgctagagcatctcggttcgagtccgaatagcggcatgacatcttatcttctaaaaaataggtcctataatgaactccattcttatttctannnnnnnnnnaggacaatttaataattccaaagaaaatagacatattatttcattaaaaatgatatgttttgttacattaaacaaatgacatatttaataatttcaaagaaaatattataattttttattcaatttactcttatgttaccatctattattcaatttattctcaaaaaattatataatataaatatctatatgtaagataagcatttctcaaaaaattatataatataaatatctatatgtaagataagcatgacaacaagattaattggagataggtttgactacccacgttatcatccgtgcatatatgtccaagtttaaaagagatgggttaatattttttaaaccaaatacatcctaattgagtttcatcaaatttagataaaactgtgaggaacccatcattttttttataattttaatttacttatatatttaaaaataataattttataatgataattttattttatattttttctcttaaaaatgatataattttattactatcatccattattgacaaaataacatttaatattaaaatttacatatatttttgttgtttattaatatactaacatttagtttcatttcctttctaatttgnnnnnnnnnnattcctagtatttagattttttcattatatatggtattttcaagtttagaacatatattaactcatatatcgttttcggtcgtatctattttaatttcaattcatttgataaccttattatttgtcaatgaaatcataggattatctgattcgtccaaaaaaggcatgataatcacttttttttgtataacaggattgttagttactcgttgggttttttcaggccatttaccatttagtgatttatatgaatcattaatatttctttcatggactttttccattttttatatggttccttgcttcaaaaaacctaaaaacgactatttaaatacaataataacacatactaatgtttgctaacatttttaagtgttttttgttttcactttcaaataaaacataaaataagagtgaaaatatgtatagaatttagaaaatattttatctaaaaatattttcaaaagtataccaaaaattaaaaataacaaatcaacattttcaaccttttctaaagaagtgaacacatgatgataccttagagtactttcttttttatacatgttttttaaatcttgaaaatttgaaaatgaaaattattttcaaaaattaaaaatagaaaatgaaaataaaaaataaaaaataaacactcaaatgaagcgtcatctaggtaaatgatcaaaaattgaaatgaaattttcaaaaacataagagactaaaataaaacttttgaaaacataaaaatcaaaatgaaacaacactaaaatataatggaccaaaataaatcttttaaaatttaatgtatcaaaatgaaataatattaaaatataatagaccaaaaataacatttaacattaaaaaatacattatatgtaaattcaatttgcaccaatgtataagttttaaaaattaaaccaatgatcaatccaaccaaaatattaaatcattagattaatggtcaaattagtaagtctgtattaaaaaaaattaaaaatttccgacaatgaagattgttttgacagagttgtccaaccacttaaccagggtcacacggttcctaccgattcgatagcatgttcgatccaaagaaaactcggctcagttatccctcctattctcgtttcgaccagctaggccgatcctattttaaaactatgcgcaccaaaacgtgaggtcatggacgaaattatggttcaaagatattaaaatgctttgcacacggtggtgatataactaggaatctttatttaaattttattcgcaataataaaaaataaagtaaattgaagattaataaagcattccaatcgtttagttagtagtggaggaaaaatgcatacaataagaataataagcattgaaaaacattgagtcttcaattatatgattctactccagatagtcctctaccacatttcattctgctttgaatatggctataaaatagaggtttatattgacatgtctgtacttgattattctctttcattaacttaatgatatttcaaatcaattaaatttgtcactttgtcaccttaaggcagaattagtgtttggctttattatgatatatcactgatctgtgaatcgtattatgatgaattatccaaagttacctctgtgatgagaccccagtatcattcagaaagaaacagaaaagaataataaagtcaaaagtattgttcacttgaaagaatcatttccgaaattgaactttgtctcttattcaaaacaatggtataatgcttttcaccctatactcactcccgtgaacacattaccaaaatggatcgtttaggatgccaattcatgcatagaaaattcaaactttaatagttcgagccacctaccaaataattagaagaaaagagaatatagctcacggcttgaagctcacctatacacacacacacacacacacgttatatatatatatatatatatatatatatatatatatatatatatatatatatatatatantgatgagtactcacctacatatatgcctgcaaccaataacaacactctatgctcaaaacaaagatcctctcttttattgttttttatttatctattctttaaaggataatatataaattaaaaatataattaatatcttatttaatattaattttttaaaaaactcaattataatatactgatagagtaaatatttagtaaaaaataaaagtgtatagaatattttaaaaataaactagagataaaggtatataacaatatagaaagataataattaatatttctctttatatacaatttagaatagttaatagtgttttttgttgttattctttaccgatagcatttttaattatttttctttgacaagagtattatttttagatatttttcttatcctgttaactcttttaatatatcatttttaatatttttaattataacatgaatttcaatattttaaggctgactttttaagaggaccttacgacatcaatttccttatagtaaggttgatttgaaaaaaaatatataataccttaagaaatcaattcgtgatatatgaacagtaaattatatcacgtatgtaaataattgttaacctgtattatcatttaggtaagtttttattttatttgtattatttgggtcaaaaattcgcctatacgtcttccgtttggactgcattgatcatcgttttcgcattaaataacaatttattgcgttttgataaagctggatatcactttccttgatttgattcttcttcttctttcttgctcgatatatatcatctatatcagagtaaggacaaagggaatcaacctagatgggggactgggggagtacctagacccatatatagtttttgttagggtattattcaaagtccagatcatgtttgttctttgcctaaaaatttcacccacttcacagttttacaatcaaacaaaaattttactttttggagcccaatggtttaatagggggtttgcaataataggtccattagggctataactcccactgtaccatctctgtctcctcttccatatcttactaattttcagaccattatttatctgtcttttaggcatagtcacagttttttctttaaaaaaatgaaaaatgctaaccaatgttctatataagaatacgggttaaagaagtgaaagtaaaaaaatatatattgagatttgtaaaaatacgttttcttatgatatttaaattaatgtactcttgtatgcacacacacacacaaattaaactaaaaattgaaaatctattttaaaaaattcaaaatatatttgttattgtattttttgtttttgaatcttgtgtgtcaatttgataaggtttaatttcttcgattaataactaactgtcacaaattaatctacaactcaccttactataatattatagattagtacatggtgtaactttcccagctgcaaactaaagaaacaactaaaaaaactttaggcaatataataaagaaatacttttgatattttaaaataatagtaaaatagttatttactagttctcttagagtttaaattaatgattacaagttaaaccctagccaagtttaggaaattacaaaaatatctttaatatatagaagaaaaaaaaaggacgtaagataatgttttgtgaaagaaattgaaaccaaatataaaataacaattttagagaattgaagcaaaacagatcgatcttaattttagttgataaaccatctcaagttaagatcaaaataatcaaatatgaatggtcatattttgaatgtaaaacatctcaaataaatacaaagaattttaattacttggatgtagtttataaaaatgagaacatatgcttttttccctacttttttttttttttttgcaaaatattcacttttaatcactaaacagnnnnnnctcttcaatgtctctataaaaaagctaaaattaaaggagtgtacataatacatggccctctatttctcctttctttcctcttcaactcccaaggattatacatacttttccattagcctcacagtggaaacactccatggttcttaatgcttttctgaccaagtgcttctcgttggcctttgttaacccactaaaaggacatacataattgtaagtgtaataattatatatatgcaaatagttgtaatattgctattatttcacttatatgatcatgcatgaaagggaccaaactctatctaaggggcacaacacatggaggagcaaaaccttcggaataagcatacaatgcattcttcaaaccaccggagacgtcgcgaaattgtggccactatgggaacacatgtttccctctctgaatgtggctggcacagtacaaatatatatatatatagcaccaccgcattactttctgtcagtattgtatcacactatcagtaaataaattgtccttgcgatacatcttatcattttgttaacaaaaattattagaggatatatttcttcaatgttggagttttgtagattaacattgtttaattatttgattaatttttcaattattaatattaattatgtaaataaaaatatataacatatcaattaatgaatattagctagttatttggtcttattatatatgtgagcatgcttatatatcatgggttggaccatcgagttaatgctctcgtttagtgtttgtaaaattgttatttcattagataattttagtgtgacacaacattttgcatgtgtgaaaaacttagctgctagttagagagtagtatttcctcatttggtgattcaattgagctaatagaagatgaatttcatcttcacttaaggtactttaactaaattgttattatttgtcgtgagcatgctagaatatcatttgttattaatttgtcatcattttttaattgtactagtttatatgataaaaaaaagaatgaacttagctctgcaagcattaactgtcaggaggaattttaggtctctagcttgtagctacatagcaaataaaaataagattagaatagtttttttcctctattttatttttaacttttgatttggtattttattttttattggatttagtttgattctctaattttaaaaattagttttctttattcttctaattttttataggttcaacatgattctctaatttttaaaattgattctactatctaaattaattgaatgatcatattatttaaatttcatcctatcatctaattggatattttgtgactatttaaacagtcataaaatataattttttaacacagttaatccattttagatgataagatcgaattgaatgattttaaaaattaaaagatcaaattgatcccaaagaaattataaaactatattaaatctaaaaaataaattaatttaatctaaacataacaagatattgttaacctgcaattccctcatggttagtttcataaaaactgcaggttagatgcataaatattaaatacaagtggggcgcactacacagaagcaaatacgttataatatactataccctagcttagaaatacctacgtacaagaaatggtatatagcaaactaacagcttaataatactgttcctacttattaataacaaaccaaacagcagttacaactaataacaaacagaaatatttgaatttgaaaataatataaaaacataacacagaataactataacagcagtgcgctatcttagctgatcctaacaacccttatcactccaagaacgaaaaactaaatttgcatgatttatattataccctagcttgtatcttctaatttacttctgttttctgatttctcacgttctttgttcctttcctctttttcaaccttaatttactgcgtaattacatttttattagtcacgtgtctctgagaggacgatgttaagaaatttttagccaacatgagtcttctccaagaatttggtcctaagaaatgggatcttcctcctgcggccgttatgagttgttgagtgctacctacgtgacctgaatatattttcagtgaattttcaaatatcattatagggtgataaaattttcctggaaatacctatagctaggccagttatttcttaacttaaaatccgagaaaggaaaaactaaaaccaaattttaaaaaatgaaattcacggaccgaccgtggtaaatttgtaatttgcaaaagtgcatctaatcaattaatgctcgcgaaagaactactgttaatttctctttcgaacatgggaaacaccatcttaaattaattattacttgaacttgaagttatgaatcttgtgcacgacaacctattcaccggagtattggataagaatggagaaatatagacaaattaatctacatgagggatacaaataggagggagaaccccgcaagtatacatatattccttaaagagaaaagagaataaagaggttcataaatgataagaaaacaatataaagtggtcatacttcatatatatatatataataataataataataaaatagagtttgtaagtaaataggtcgcatttaaaaagcttgcataacattatatatttttcaaaatatttttaaaattttgttaatctatgtgtaaaaaattatccaacagtagtatattgtagtatagaactttagttgatctggaattaaaaaaaaaaaatgcatatgggagtcatattataattaagaatgttcaaacttagagtattaccgctagttttatataaaaaataaacagaatataatattcttttgttttagttatatgaaatagacttattttctaatnnnnnnnnnnatatttttcaaaatattttttttgcatataataaaattttattaatctatgtgtaaaaaattatccaacagtatataatagtatagaactttaattgatctggaatttaaaaaaaatgcgtatgagagtcatattataattaagaatgttcaaacttagagtattacctctagttttatacaaaaaataaacagaatataatattcttttgttttagttatatgaaatagacttattttctaattgttatgaagtatgctcaagatacactcacacatttttatataagtggatgtcgttttgtttaaattaaattttagtgaattttttttatttgtaacaattttgacatttcaaaactcatcatattcaatagcagaaaaaattatttaataaattaggaataatataattacatatagtccttagttaaaatatttaattctctgagtatttttaaaataaaatatgttataattaaaattaactaatttgactattttatatgttaatattcatatatgggttttgatgaatctgttatttatttcttatataatggatgaaagatagtatatttctcactaaaaaaaagtgtaacactgactcctagtaaattcggcatcattgtttggataagaaaagggtatgtaacattgactcgtgatacaattcaatttataattttgaaagcttgatacgaacctcttaatatgagaaaataggtatttactcgtttatcattatatgcaaaacaaccaaattgtagttatccacttttctatagcatacaacaaaaagtatcgtcattattgaatggtgccccttacaagatcctttcgaacaggaaaaattgggccaaagccaaagaaattcgctctcccttttctttttcccgtctttctctttaatgaatacattcgctctcttttgtaaaggcgttaacttatgaggcaaagaacttgtgatgaaccttcttatggacctaaagttcttaatggtcacacacaatcaaccccacaactttgcaccaagctttatggaaataatacaagcctttacctcattcctctaccactaatgtagcactttcttgtcttcattgtcataaaactttgcctgcgttcttagcacttcgccatgaggtctctttcttgccctatcaattcttcatgtgaaaaaattcaagacattcccttatccttctatttttattaaccaaaaccatcaaagatgattggttgctgtcattttcttttcgtctttacctagtatatagttaaaaatgtagaagacaagtcgatttttttgctacaacgaaaccaacacacgtggttaattaatttcttgtcattttgatatgacaaattacaggatatatatagtgaaaattgtacgtatgtatgtaacaactgaacaatcaattaacagtgtgtattagaaatccacttagtccaataagtaacaactgaaaatagacaatcaacagcataaatatataaaacaaatgaaccaatttttttattaaaaagaaaaaaaatagttctaacccaactactttctattataactttataaaaatgaagattgtcactttgttgtcaatttgttgactttacctttaagaaagtttgaagaaatcaaattgtaccattgtccggggggtctacatggagagcaatgtgagcaattacggtgataacttagactttggagttactacgagtctaaaaaaattatatataattcgacaatatttttatattatttttataaataaattagaatcattgtctcctttcatatctcatttttcatatatcttatattaaaatatgacgcgtgattaaaaagtactactctttaagttgttagtttcttttatgtattattactacattttataaactatacgttaaatgaatttatagcttattatgacatcaaaatataagaaacctatgataatgagcaaatttaaagtgtttattttttttttccaacaagatgagaaataaaaactaaaactcaaactataaaaaaattactcaatatgttataaattaaaatttcaaacttggataataaagctttcactctcctctcctatcaactagagattttcaacattctatcttccctttataatatgtgtattttctttttaaaagtttataatatgtgtatgttacgtacgcactttcattacaactacgcagaaaatatatcccagtcatctcagattccctccatttatctttttattacgtatatttgactttcttaaccacatgtcgatttcaacttaaaataatcttatattacaatttatttaattgaattacttatctcaaattaaaatatagttaatatattcaagaatatttgtttattataaatattaattataaattatttataaacnnnnnnnnnnnnnnnnnnnnnnnnnnnnnnnnnnnnnnnnnnnnnnnnnnnnnnnttgttatggcagatttaaaaaaaaaaaaaaaacttcagtttaattcagcttgcacggagtgaaattagaagtcacattttagctcattcaatttcattttaaatattttattttatatttaatataaatacagttcaatatattcgatgagtaactcagctcgatgaatattgaaccgatgatgcttcagtaactcaatatccttggctcgttgccaaaatgattattgggaaagttgaacgcaatgcttcatacatacgatagacatgtaaaaaattggtttttatgtacgtgtttgatattgattttaagtatattttcacatatttgatttaaagttaaaaagaattcaaaattgattctaaatacaaaattgattttaggttgaaacaattttaaatatcatccaaaattttatattaaattttaatgctaacttaattttataatcaaaatccaaacataaatcatgttacttcaaaattaattttaatcaaaatcaattttcaaaatcaattttattgatgtttatccaaataaacacttaatgtcacaattcacaagaaatgagcttaggtaacgtgcaacaagatttccaaaaatggcacacatatatattaaatggaagaagttgagaactccttttgttgtttcggtgaagtgaacaattgcagctttcttgagcgtattacagttccggaacatcttcatttgacaatgaaattgcacaaatatttctgcccccccataatcaaatgtaaggaaaatttatttgtggatgctattgacgtaatcgtgagttccagttcttcattgattgcgacgtgacacaaatcaagcatatcaattctactgttgtaattatggttttaaaaacaggatcgaagtgatcagtttgatcgaaatcaatctaatgatattaaatcttaaaaaataataaatccataattggttaattgaatgttaataactaatatctcattatactaagattcatttaaggactaatatttattaatgcatatttccctctaaatgaagactcaaattataataattcggtgtatattatgaaaggacaattctttgtgctaaattcttaaatataacttataactactttataacttataattcttttttatttatatcttcattaatttacttgaaattccttttttacttttttttattattttagaaatcctttttaccgatagtcatagagaaaaatcatcaaatcttttttataaaatataaattttgaataatattactatcctaataatttttaaaatgacatgctattataaataaatttaaggctaaaatagaatttcggtaccttatttatattctaagtttcaatttagtatcttatgtttaaaaattttactttcatctcttatagtatttctatcagaacaaatgtcattttgttagttttttttactaacagtatcaaatttaactagtgtgtaatttctcatagtttggtaagtgtcaccaaattgatcaaattagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacaatttaataattccaaagaaaatagacatattatttcattaaaaatgatatgttttgttacattaaacaaatgacatatttaataatttcaaagaaaatattataattttttattcaatttactcttatgttaccatctattattcaatttattctcaaaaaattatataatataaatatctatatgtaagataagcatttctcaaaaaattatataatataaatatctatatgtaagataagcatgacaacaagattaattggagataggtttgactacccacgttatcatccgtgcatatatgtccaagtttaaaagagatgggttaatattttttaaaccaaatacatcctaattgagtttcatcaaatttagataaaactgtgaggaacccatcattttttttataattttaatttacttatatatttaaaaataataattttataatgataattttattttatattttttctcttaaaaatgatataattttattactatcatccattattgacaaaataacatttaatattaaaatttacatatatttttgttgtttattaatatactaacatttagtttcatttcctttctaatttgagtttttggttatgtttcttcttttgttaattttttttaaatctgtttttaaagaatatttttaatctattgttatatatctaatacatgtttataagttgaaaagacactcagtatggtctgatgaagataatacataataaaaactaacaaccagtatgataatacctattaatcatatgtcatatcttaatttgaacaaaaagatatatgtaaaataaaataataacttcaatctagttattaaaataacatcaaataatattgaaaaattattatacaaccattttaaaaaaaatttaaggtcttttttagtcattgatcttgtgtcgtcacacctccaaatagggcccaagatcggcattggacccaatttgatgtagatgacattcttcaacatattcatcgatatctcatgagataaaccttagagttggcaacccatggcacatttcccatcctaggcgagaagataatataacatagaatgcacatgaatttgtcaatgtccaatagttttaaaaaccctttgcaattaatgaaagactaaatgataggagcaggagctaatcaaagcaaaaaggtttttcaaagctaaatcatggaagataaattcaacaaacttatatggtcaagatgtagctatggattggagtttatttgaatgaattactaagatagtgtttaatttatgtgttttctattttcatttttaaagaaaataaaaaataagagtgaaaatatgtttgcttgaatatattttcaaaaacatatccaaaactaaaaacaacaaatcaatcttttctaatgaagtgaaaatgcgatagcaccttagagtattttcttcttgatacatattttctaaatcttaaaaatttgaaaaggaaaattatttttagaaaataaaaaagaaaataaacattcaaaccaagcatcacctaagttttttggactaaagaatcaattaaggcttattttctaattttacatgaattttcatattnnnnnnnnnntttagaaaataaaaaagaaaataaacattcaaaccaagcatcaccttagttttttggactaaagaatcaattaaggcttattttctaattttacatgaattttcatatttaattttgatgtaataagtttagacgacttttaagatgtttttggccaacttttatgaattttaggcttcctaatcaattatgaaggttagtgagaagtaaatgcttagtgaaaatgcatttcctaatgggaagtaaagatttagtggactcttagtggaaatcaatttttcctagtaagaattaattatttagtggaaatgtgaaatttttagagagaaatttaacctataaatagagattattttataactatgaaacaagttgagttggaataaaatctgaatttttttcctttaattaattttaattgtattaacaaaatttatgatgatcaaacatatgactttcatttttttttctctctttatgtggcgccaatatccttcctttaaaaaaactaaaattaattcctaaatccaaagtctttaaaggcaatctatgttgtttccatgtttgtggaagctcttttttgcaagtcatccaaatttacaaggtgacattgagttagttaataggatgagggttgcccccacttatatataatatcgtaccattatttatagacgatgtaggacttagatttcttccaatatacccctcacatctaacaatttttttagcttggtgcgtggataaaatagtgagtaatcctttaataaattaggataaactttgatattatcttagaatgtagattttggtctaacttaatcccaaaagataattcataagatggtgattgtctcctagatatgtatataatttaccttgattttatctctatttaatatgatacttgaatttttttaatatgtcttctcacttccaacataagatatataagtagggataaccataaccttatgaactaatttttgaaattaaattaaacctcaacttacattctaagaacataaactataaattaaccaaaaaaacttatataaactaaaataaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtaataacaattttggtggatatcatattcctttaatcgaagatgatattaaatttttatggcatacatattgatgaatacaaaaattaaattaaaagaagatgatattagaattgtcttgcactttttatcccatattttattttattttattagaattgtcttgcatatattttgttgtatatatattcatcaaaatctataaggacaattttaataaaaatttaaaaaatgtgagtaaattaattaaagtattgatgaattttttttgtgtgttcttttttgggaattgaacccagtccattatggactaattgtaaaacaattaccgtacaaaatatgtattttttaaaaagatataatgtgatatttttaaaatatttttctaatatcacataatgatccacaactttaacctatgattattaatttgtttctcatctttgttgcgtaaataactaattattattttttagcctttttgttaattcattttattctttatttttctattcaagaggttttccatttaacttttgcacaatcagttttaaggtagttgtttgtaacgagtattgtagagtaccaatacccttctatatacataaatacattaatcaacttccaaataaaaattttggtttcctaataaataaacaaagacattttttttaaaaaaatatgattttttatgaatatttaattttatttttaattttttattcctttcaaatattttttattttattttgactaataactagtccagagattttctttatctagcgtttgaagtctagattgtaaatagagaaatttatttgagaaaagtaatttattatggaatttaaaattatttaatttaaaatttattttttggatatttttatacgaggaatttaaattttgaaattttaaaatataattttaaataactaaaaatataaaatttaaatttccttcaaaaaaataagaaattgaaattctcttattctctaaaaattctaactgcatcactttttgcttcatttcaatcttaaaagaatactccggccttcgacctccaacctcctgttactctcacagcactcatctcacctgtgcatgagattcaaaattttaaaaattaagaaatttaattttttttatctaaatacaaaattttgaaaatgaaaaaatttaattttttaataaaatataaaattttgaaaataaaagaattttaattaatatattttaatttttctgaattttaaatttattaaaattttaaaatattccatccaaaagcaaaatgattttagttatatttataatagaaacatattcgtgttagatctaaattgcagttaaaaaaagttagatctaaattatttccttattagtaattagcacggagagttataggcttatagcagatagtagctgtgtcagtcctccacgggatatgatcaagcagttagcaggagatgctagtctcttgaggctgtagttgactagttaatgtatttacagaataagaaaggtaaagaattatattctaattggattatgaattattatatatcataaatttatgaattttttataatattataaaactataatagttatatagtttatgagtttaaattgaattcaaatttgtgttaaaaatgttaagtttaaatttgagtccatcttaattaagttggacaaaatgtaaacaatttttgcacaaaagatatatacttctttgtgtcaaaataagtgtatttgaaaaaaaatcaaaacaaatgatgcatgtcactttttaatataattttatttatttacaaatatatattaatgagtgtttataaaaaaacaaatactattttgtgtcagaataatcattgtgttggaaaaaattattattttaattaatcttatgaaataaaatattatatttttttattttcaacaggtagattcgtcaatggactgacaaaacatattgtcattcctaattataagcaataaaaataaaaaaataattaatgtcatattggaaagttaaaataataattttttcatcttaattataagagatatattaataaaaaatgagttaatgatcataacgttaattttgttatattattatttttttcatctatttattaaattttttatttgtgtaaaacaatataatgagatgaagtattaaataaatgcttataaaaatcattaataggcgctatataaataatagtcaataaatcaatgaatattcattatattaaaataaaatatataatttttattgaagcattaattactattattaataaatgaatgaatatatttattatttattgtagtaaaaataaaaatatttaatactacatcgaaaaaagaacaccattaaatgaaattgattgttatttgttaacactttatcgtgtagcgagtgaagtgcgggcgcggcggggactgactaacgtctaacgtcgaaaccgtggtttcccactataaatttggcacctccttagtccttagtccttactcatttccatacttcctctcattttctcacccttttcttttttttctttcttcctctttctcttctctgttcataacaacgactattgttatttgtatatggaaggagcagtacctgaggctgatgtctctgccttcagagaatgcctctccctctcatggaagaatccctatgtccttcgcctcgctttctctgcaggaatcggtggccttctttttggctatgacaccggtaaatcaaatcaaaccattcaattcttttttttatctatcggattaattaggtttagcagaaggaattattttctcgccatccgacaaccactgatgtttaaatctcaaagagaataggtgtcaatattttaatattcaactgtgtctcaaacaaaattgacttttgtcaccaaaagacaatacttttgagaaaacgccatttttttttcatttctatgttttgctcttatttgtgtgtgtatttggcgattgattggtgggtgtgtatttttgcaggggtgatatctggagctcttttgtatataagggatgatttcaccgctgtagagaggaagacctggcttcaggtaaattaatgcatgcttatcactcctaataactcccaagagtagaaaaaatgaaacctttgtccttcatacaattaaattattaattattttcccactcctttctttaatgaaattttatctcctcgtacattgttttcagttacaacttcacaggttgcacgcaaaaataaacgcatggttttgtgcattcatactactttgtagacgatcatcttgagcaaaatttgcatgcttttagtggataagactttgtgaaatatctccgaattaagagaagaaaaaaggaaggcattaagaggtcctcctgcctttcattcatatagctaacttttaaacccgattatataaatttatttatttttactatctcgatcatatagctatcttttcaacaaaagtatttatcttatcttaatttcttatgaattattgtaaagatttgaggtatttacaccattactcttttacgaaaaagtttaattttttatttaccctttttctgatgccagtcatgaattttgtttgatcgtctattaaattggcgaatattggattagtttctcttcttcatttttgttcggtcgtcacgataaatgcgttattgaaacttttagttggtaattaattatgtcatgtgaccctctcacttttttattttattttgagattctgttttatttaataattatttggacttaatatatctcaagatccggtttgatctgtttcaatttaaatattttcatttttatttgtttttacgtttttacacatgtctttttgtttgtttgttattctcttctttttcggatttgaaaacagcccacaaaaattgacaaatgttttttttcttccaaaccatgacatattctcaaactgcatcatcatcaatcaattcataaaaaagcaaaggcagcaacttagcatataaaatagatgggacccagtgatcactgaaagtaaacaagaaacattaatgttaaaaccaaaaggtgttgataaattatttcttaaattgaaaatattacttttatctaaaaatagacggacttggtgagaagaatattgcacctcctggttataaaaagtaaattaatgttaaaaatttgcaattttattttggaaagaataattgtccaattaatgatttagatctcatgttttttcatataaagaaattatttattgttatatttgagaagaaggtttttntcaaataaatcttaaaattattagggacaacgttttaccttattttacaaaaagatagtttcttaaaaaaataaaacttttattttcagtacactacagtgtgatgaattaaattttattccttaaactatacggtaagtgcacgcgtcactaaaatcttaaaattatgaaaaggttaaacaaaagaagaaaatacgagagaaataagagagaaggaaaaaattctctttaataggaaaaaagcctcaccactttttcttttctcactttaggagaaacagggttgagaagaataatgttttacgtttttcttagaattcctttgcctgcattttcaattcattattattaaaaaggcataatttttttactcaagagaatctctcttttttccgcagatttttttcaccactttcttttacgaagattattttttatttcaaacgaaacaaattatataaggatttggttcttctaaaatgtgctataatgctaaattaactggtaatattttgataaacgatacgtcagataaactcctaaggtggttaaaattagattttagtcaatggttcctataattaattatcatggatataatacagaacatttttccctccatgttctgagtttaaagcacaagttcctcaaattatcatgtgttaacgaactacttgtagaaatttgtgaaaccgtgcagggttttctttcaatgttgatttgaaatataagcatttatgttcatattgtgcaagtcaaattgttatggcttgattttgacacaacttgtgttcaaatgaaagatcttttatttaataaaatgtgtactgtgttgtgcctttaaaaaatttcaggaagctatagtgagtacagcaattgcaggagcaatagtaggtgctgcagtgggtggatggatgaacgatcgatttggaagaagaacatcaatccttgtagctgatatcctctttttaattgggtcagttataatggctgctgcacctggccctgctgtcctcctcctgggtcgagtatttgttggccttggtgttggaatggcttcaatggcatctcctttgtatatttctgaggcttcccctaccaaagttcggggagcccttgtagctctcaacagtttcctcatcaccggtggacaatttctctcctacctcatcaacttggctttcactaaggtcagcacaatcttctcttttactttgtgtccataaaagatactatattgcaaatggaattggcatggcttattaagtatgtgctcaggttcgtatgtactgatggatctaagatctgaggtcaatcagagtaaactattttaaaaaataaatctaatatataaaaatgaaaaatgatttaaacacataaaaataagagatcttaaatatgaaattttaaaataaataaatataattttattaaaaatagagaacaacagtgaaaaaacaaaatagtaaagagaaataaagaaagtgtttgagagagagaaaaatggacctcattacatctgtaattgatacttggtaaaacaaattggtggctggatagttttaataatatattgataaggggtgtatttgtttattctcaataataataagaagtttaataataagaagttaggagatccaaatacacaaaattaagaatataaaatataaaattttaagaaaaaaacatgaatttattaaaatgagggatgcatttatccacactctaacaagcataggtccgccactgtatatctggctatcggctaggataccttaggcaaaaaaaattggaatttgcattacaaatttgcaatccatgcttgtgtgttgttgaatttcattataaaaggcattgttttcttgtgagatggtcatagaaatttgttaatttttatttattcaggcgccgggtacatggaggtggatgcttggagtggctgcggcacctgctatagtacaaatggtgttaatgttcacgctcccagaatcgccacgttggctgttccgaaaggtaattcatgatacatcttacatttgttgttatctttgtaagaattagacctttatgtgtttataaaatctgtctttctattatgtaacagggaaaggaggaggaagcaaaagcaatattaaggaaaatttatccacccagtgatgttgacgaagaaatccaagctttgcatgattcagttgctatggaactgaagcaggcagaatcctcagaaaaaatcagcataatcaaactgttgaaaactaaggcagtgaggagaggtttggtggcaggaatgggccttcaaatcttccagcaattcacgggcatcaacactgtcatgtactacagtcccacaattgttcagttagctggtgttgcatccaaccagacggcaatgctcctctccctgatcacttctgggcttaacgcgttcggttcgatcttgagcatatacttcattgacaaaactgggagaaagaaacttgctttgtttagtttgtgtggctgtgttgtagccttgacccttttaacattcactttccgccaaaccgaaactcattctccaatgattagcgcagttgagaccgctcatttcaacaacacctgccctggtttcagccacgctgtgaatgctaatgaatgggattgcatgaagtgtctaaaggcagaatgtggtttttgtgcatccggcgtctctagcaaggtaagtcaaatacaatgtttcgataataaaggaatttaggtcagttgattgagtgtgtgagttgttgtattcctgatacttatctttgattattagagataaataaaaaaatgaatttctccatgcacagtagtaattattgaattcattgatatgcttgttcttacattagtgtccattacatgtgcatgcagcgcttacctggggcatgtttgatttctaatgacgctacaaagggtatgtgtcagaaagaacatagagcatggtacacacaaggttgtcctagcaaaactgggtggcttgcaatagtgggacttgcactgtacatcatattcttctcaccagggatgggaactgttccatgggttgtcaattctgaaatctatcctctgaggtaccgtggagtatgtggaggaattgcttctacaacatgttgggtttcaaacctcattgtttcgcagtccttcttgactttaactgtggctattgggacagcatggacattcatgttatttgggtttgttgctctcattggcatcttattcgttctcatcttcgtgccagaaactaagggagttccaattgaagaagttgagcaaatgctggaggaaagaagtgtgcacttgaagttttgggagaagagaagtcctccccagaagggttgattaactttgaattagatctttgtctaaagaataatatttcacaccacttgactcttatccgtgatatgagataattatggtttcttctaaggttaagtagtgaagaggaatatgtttaaatgttttctagcttttgtttgtagttttttttttctctcttgagatttgctgtttttattgtagttagtgtttggctagtatgttttatgaaatcctaaaggatgaacaatgaataatatataatgatgatatattatatataacgagtgttcagtcatcatcatcattatgtgttttatttcataatgcaaaactaaccgtagcgttcaatttaggtattaacaaattgacattttccagatatcagtgaaagttctaaattttgacattttgagaattaataaataaaatagaaaaagtttaatgagtgactcttctctccatgcccttaaaatatgaacaagtgagtaaataaaatggaatttttctaaattttttaaaacaagaagatgttgagaaatcgggttggctatgtaacactaacacccaacctaattaactaatctagcttcaacactaacactaatatgtacacactttaaaataaatttccccgattactattttatgaattgccgaatggtatacagatatactactatatgtttgtccaaaacaattttcacaaccgtaatgaaaataaatttcccccattatagcttcacaaaacattccatattagagtggagcaattcttacttggtcacaatgtgtttgtcttctcttcttcttcttctcctaaattcactctgattcgctgcccttgctttcactttccaaggacttcttacacgtgttggtggagtccattttccacatatggctctgtgcattgaagcagtaacaactataaacgaccccgctttgatcagattgaacaaaacgagacaaaagcatcaagtatggagggatgagtccctgaagctgatggctctgctttcaaagagtttctttctctttcaaagaacaacccttatgtcttcgccttgctttttctgctggaatgggaggccttctctttggctatgacactagtaatactacaaagtatatcatcatatcataatggtttatgtctctttgctaattatttttactttctaacttattgagacgatacccatttcactactcatgtgtccgttttggaagaaaaataacaatcctttatgcagatgcactcttctttgctggttctatcatcatggctgttgctcctaactcggccgttctcgtctttggtcgagttttcgtaggccttggtgttggaatggcatcaatgatatcccccctttacatttcagaggcttctccaactagagttcgaggagcccttgtaagtctcaatagtttcctcatcactgggggacaattcctttcctaccttgtcaacttgggcttcaccagggtaagaacctatgctatacttgttcaacagcttttctttctactattttgatgtacattcacataaaaaatgccttaggacaatgtttaaactttatactatatacttcacatgttttgtacattagacagatgctaaccaatattcttagaaaaatgattaaagaattgaaaatagaaatatttttattggaatgtgtaaaattgtgttgttcattatcttttttgtactttcttatgattttttcattttttttcttttaattccttaaccaatatcttaataatcaggtgaaaggaattttttagcaagaccatttacattatctaatttattaatctaatccaggattttattcgtgagataattgatgatatgctaacagaatttgtggtaccattttcttttttcaggggaaaggaacatggaggtggatattaggaatagcagcaatacctgctgcactacaacttatgctatttcttccagaatcaccccgttggctattccgaaaggtcagtgatttaaacaaaccctaaatacagtataaaaagtactatgcaactgctattagtactattatccaatcaaaattggtaattcatttcagtaattgctgtcaattttagccaccaaaataaaagcaatttgaagtgtggattttgattggagagcaaaaaaccaacagaacgcatgattatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgcatgattatatatatatatatatatatatatatatatatatatatatatatatatatagattagttttgtcatagtggtcatccaccataatcatttctaagatacacactattagtggtatttcttttctttttaattatttcaacgtgtaaaagggaaagtaagaagaaggtatacaagttgaggaagatttacccagaaggggaagttgaggctgagattcaaaatttgagggaatcaactgaaatggaaattaaggaagtagaagctggtggaggttgggtgagccttgtaaaaatgcttaaaatcacaagtgtgaggagaggtttatattctgggatgggcatagtcattttccaacagtttgtgggtatcatcacagtcatgtactacagccccactatagttcagttagcgattttgcctctaatcaggtagcaacgcttctgtcactcatccattgttcttcttactgtcgttttccaccagaccaagatttcctccccattgattgacccaactgaaacaactcacttcaatggcacttgctctggttgcactgcagctaactaccgtgatcaatgggattgcaagacttccttaaaggttctaaaaaatgtggcttctatgctgcctgggataaggtgaataaaagaatgttaatcattattaaacatttcaataatcctgtaacattattaatcacttctgaaacatatttataagcattagtgccgcaagtacatatttataatccatggaaatcgaagagacagtgaggagtttacagcaactcacgcacgcacctttctcaaccaactaatctagatctctttgacatttattttctcttagtccagaataaaaaaaattactcttaatcacttgtgaggtaaaattgaccaatagtaaacatttcaattacttcacaacactgttagtatcagtatacaaccacatttatttgactgtgaagtaaaattaaccacatttaccgagaggtggagaattcacagctatacaaatttcattacttgataaaaaaaaatggtttttcatatcattttttaaatattagaaaatgttaatgatattgattcatgttggttcttactctggtatcaactgttccacagctaaaacctggtgcatgttgggactacgacaacaactaggagaatcattgtacttcacaacacagggattagtattccgaaggatgtcctagcaaaactggatttgttgcaatagttgaaataataggcctagcactctacatcttgttcttctcacctggaatgggaactgttccatatgttatcaactatgagatataccctttgaggtttagaggagtatgtggaggaatggcatccacagcagtttgggtgtctaaccttattgtttcccagtccttcttatccgtaactgaagctatttagactgcatacacattcatggttttttgaataattagtttagtagccatcatctttgtccttgttttcgtgccagaaaccaagggagttccaatggaggatatagagagggttctggaaaaaagatctctccacttgaagttttggcagaaatctacctcgtgatcaactcttttggtcctgaattagctggttttttccatatatattagtccttttctttattactaattttcatcttcgtttgcgtctcttatttttgcatcacatgaatgttacatcattttgtaatataatccattaatttatgcagatataaatataaatggggtgtacgtgaactaatagaatatgaaatattcatttctcttttcgcataggagcattgtttgaacttcaacaatgacagtgttcatgagataacaattagtttatattattttttattttatttataagaaataatttagagtgtaaaaataatgtatttttttataatttaatttaattttataaatagaatcaagataataatatattttacatgtagaagtttatttatttgtaatacattctttgtttaaggaaaaaagttatataggactggtgtagataaaaacggtttcattattgttttggtacttttcttattttttcaaaattaaaaggagataatattttagtactcaagattaggggtgaaaatctgatatgtcatgttagatcaggtttggttagatttgactttgacctgatttaaaaacataaaatttgacttggactaattacttgttataggttttttttttttaagtttagcctggttttttattttattttctaaattattttatattaataaaataatataaaaatgtcactaataaaagaaaaaattataaaagaagttaaatcatgttaggctaagataacgtattgtatgcttggcttggaagtcaagcatgctaggttttactacaagttcaatcgaaaactctaagcatgttaggttttactacaagttcaatcgaaaacaattgtccctagcttagcatgtttggaaccaaagcatgtgaagttttgctactaagattaaaacttgattaggaatcaagggtgtttttgtatgaagtattgttacaatcatgtcctttcatatctcggtaaatttgtagttttcttttcttaatcttccggttcaacaaggagaaaaggacattgattgatctggagttcaattaggagataaataaagtctgtataaaatttgtttctgggtactacacaaatgattcgatcttaacttcaacgcattaattatttgtacccaatcacttggttaaactagtgaatttgaagtaatgaaacacatgccatatagatgtaattgttggaccttagtcctatataggattgagtatactggcgagccagacacatttaaggctgctgacaaattgaacaaactctatgcgaattaaatggacttaaatttttggtttgcgttcatctcttgtagccaatagttaaataggatgacccacatgccttagctaaaattgtgagaactcatatcatagatagttgaaatatagtgattgagagtaacattacattgatgcagatcaagagctagtaataatcataatgtaattaaaattaaaaaggacatttttaacgataaaattcacatttcaatgttattttaagaaatctgcacttaaggtgaatctaataaagtttcttaatctcattctgagagtgatattcttaagctccttgtcaatctatgaaacttactacttgttttcaatatttgcttcctcaaatacatggtgaacaattagataaaaatataatctacaaatcaaagactactaaacttaagatgaatttaaaaattacttgaaaagaagtgaatgttctttttactaaaaaagacatgtggcaatctcagaaaataaagttttatcaaaattcaaattaaaactaaaatatgttttattttttgaattttaaaaatgtggttcaattaaactaaaaggtaaaattatctgaagaaatttttaaaattgaaagttttttcattatttatagatttaaatatttttttttatctcttgtaatatatcacttttttttatatatttcagtccttataaaatttatttatttcttttaatttgttccttggttttttgtttctttccttaaaatatgttattttttatttctatttttataatatattaataatttgttttagtctttataatttttaaaaaaattcaaaatagacaaaatattattaggatgaccaaaataaaataaataaattttacaaaaatcattttttttaaaacttcacataaaaagtactagtaaattataagaactgaaaatatattttagatatatttatattataataaaaaaattagaataaacaaaaaagtgtgagaaaaaaaagtttagtctaatgtcagtttgaggtttatttctgatctcttaaaccctattgtcttaattggctgctacatacatcactccctccgctctctctcccaatcccatggctctgctttccaattccaagcttctccgatggagactctctctccatccaaaccctatgtccgccttctccaccgtcgaagctctctccgaccacgaccagcctcctcacccctccccgcagccccaacccccacccattgttccccctcgcgagcacaatctcgaactcaccatctgcaagatgatgtccaaccgtgcgtggaccacgcgcctccaaaactggatccgctccctcgtccctgagttcgacccttccctcgtctacaacgtcctccacggcgccgcctcgccggagcacgcgctccagttctatcgctgggtcgagcgcgccggcctcttcacccacaccccggaaaccaccctcaagatcgtccaaatcctcggccgatactccaagctcaaccacgcgcgctgtatcctcttcgacgacacgcgcggcggcgtctcacgcgctgccgtcaccgaggacgcctttgtctccctcatcgacagctatggccgcgccgggatcgtccaggagtccgtcaaactttttaagaaaatgaaggagctcggcgtggaccgcaccgtgaaatcctacgacgcgctcttcaaggtcattctccgccgcggacgctacatgatggcgaagaggtactacaatgccatgcttcgcgagggcgtggagcccacgcgccatacttttaatattctgctttggggtatgtttttgtcgttgagaatagacaccgctgttaggttttacgaggatatgaagagtaggggtattttgcctgatgttgtgacttataacactttgattaatgggtattttcggtttaagaaagtggatgaggctgagaagttgtttgtggagatgaaggggagggatattgttcctaatgtgattagtttcaccaccatgttgaaggggtatgttgcggcagggcggattgatgatgctttgaaggttttcgaggagatgaagggctgtggggttaagccgaatgtggtgactttctccacactgttgccgcggctgtgtgacgcggagaagatggcggaggcaagggatgtgttgggggagatggtggagaggtacattgcgccaaaggataatgctgtgtttatgaagttgatgagttgtcagtgtaaggctggggacttggatgcggctgcagatgtgctgaaggcgatggtcaggttgagcattccgacggaggctgggcattatggtgtgttaattgagagtttttgcaaggcaaatgtgtatgacaaggcggagaagttgttggacaagttgattgagaaggagattgtgttgcgtccgcataatgactccgagatggagcctagtgcttataatttgatgattgggtatttgtgtgagcatgggcggactggtaaggcggaaacttttttccgccagttgttgaaaaagggggtgcaggattcggttgcttttaataatttgattcgcgggcattcaaaggaaggcaaccctgattctgcctttgagattataaagatcatggggaggagaggggttgctagagatgcggattcctacaggttgcttattgagagttacttgagaaaaggggagccagctgatgctaaaacagctttggatggcatgcttgagagtgggcatttaccggaatcgtcgctttataggtcggttatggagagtttgtttgatgatggcagggtccaaactgctagcagagtaatgaagagtatggtggagaagggggtgaaggagaatatggacttggtttcgaagatattggaggcccttctcatgaggggtcatgtggaagaagctctgggacgaattgatttgcttatgcttaatgggtgtgagcctgattttgaccatcttttatctgttctttgtgagaaagaaaagacaattgctgctctcaaactgttagattttgctcttgaaagagactgtattgtagatttttcaatctatgataaggttttagatgctctcttagcagcagggaagacactcaatgcttattccattttatgtaaaattctggagaaaggaggatcaacagattggagcagccgtgatgagctgatcaagagccttaatcaggaggggaacacaaaacaagcggatgttttgtcaagaatgatcaagggaacagatggaggtcttgtaaagaaaggaggaaagagaaaagctaatgtatccacatagtttgttctctcttcattttcttttttgtgttttagaggtgagagaggtattattcctttttcttttggttgtaataagttaccatatgaggaagtgaattcatgaattgttctttatttcaaatccaaatttgcaactcctgtgttctgagtcttctgactgactccaacattcttttttttttnnnnnnnnnnnnnnnnnnnnnnnnnnnnnnnnncttttctttataatgttaccagtatactcctatcatggtctccatttatgtttaattatatttagctcaattctttcaaataatgtaactgtgagaagttggaactgaactgtagttttcaatcaaacttttctcgattttacaggattttgaatctttggatttctcttttatgttgctttccaaatcctgttttgccatgttgaatcaacatgatgttgaatccatcttgttctaagaactgccgtcatcaacatatcctgctgtgctgacaatacaaccaccagccacctcgcgggattcattttttagtccttttttctacagctactggacttctgttttgcaggttctataaactcagaagttgttctactcacaagctaagaaaatctgggtgcagagataattgcatcttccataatttttgagaaattaggtaatatttgtgaactaagcaggatgacatcagacttccatttgatttctaatttcttcccttctcagttgttctgatgttttttctgcaataattcctcatatgactttaatttattttctgattactgttgttccaatttctatatgatggtatacctagaatgtcttacttccagatttggttggtttggactgattcaccttgcgtaggttgtctgaatcacacatgtttagtgtttacttgtaggtatgtctgatcccacaagtttcacgatgccttctgatcctgtgtgggactatcggggaaactcggtagaaatgctggaattggtaccacaggttgggctcctgcaacgctcactggttgaactgtgcaaccaaacaagtattttacgtaatttgtgcttattgtcttccattaatttcaatcctctcagtttgtctatctctgttctttgttgtctctcacacaggtggtccaaacctctctgttctttgttgttctcagttgaaacttacatcgatcccttacttaaaaccacatgccaaaccaaagtcactaaactggaagggaacttccatcgcggatcaaaaagaaggaaacttacatcaatcctgttctgaaaaccacatgtggaacaatttagttaaccaaactagaagcttccaatggtttactgcaaaatagtcccgtaacttcgggagaaggggtgcctcctcacaaaggggatcgcagtgactaggcccgggcaattgtttaccaaaaacacatgtctccgcaaagtcgtaagatcatgtatgggggctgttgtctgcccagtgcaatggcttaccaattgtcatcatggaagaataattttgcagctaagagccaactaatagcatgtcagcatacaataatttccggtaattgcattctcagtagatgtctaaaatccaaagcaagggattcaattcatcttatgctattcgtattgagaggttgcagaatatttgacggttgtgaagataataatggcatgttaaatatcctttgcggatgcttttactgtgccagttcactcattgacttggggttagagtaccttttactagcaatttttcatctccgtcaacagaatcagttagatctcatgggcctctggacaaatattcaatcggatcagtgtcataataaataatgtagacgaagtggctaaaggagttgcataattgctggtcttggctttctttagaattagatatatctgtgaacttatctaatttctcattttagttgtacaaccacgtaggactcttgtttctgcggaatgcggatatgttcgttttttcacaaagttacaatatttcttttttcttttttcctttttcacaatcgacaattagacaattgaacttatgacacagagcaagctttataatgaacatggaaactcctaatgtcccctctaaagacaagtttgcaatgttgactacccgtgtcctgtaagcaaggtatattaaaatatttgggattagtgttttatttgcaaagaatgctccgttttatcgcagttagtgctaatgatacaagttcagtattagatcacatgagatgagtcaaggatgcattagagaacgtgataaacatcacgtttcaaatccaaaatccaatttctttaaaaaaaatccaaaaatttaatttttttaaaaaattaaaaaaaaaaaagagaataaaacctgtcgagtcagatcggtccaaccaggatccagtaacctacccggtcgagtttgttcgggtcatcccgagtcaattgcatgaccgatccaacagtggaaccaacccagttaagccaccaagtctctgtccgactgatccaactgatcgggtcaaaacaagttcaataacactgggtctaacacatttaagtgtgtttggactagaatgcaagagcaagatagtaagatcataaatgaagtgagattaacctacattagttgattctcgatggtatactaacttaaccatgtgtttgaacatgtcattttgaggatcaattcatttattaatgaaattaaaatactatgtggttaaattatgcatttaggtaaagaatttaaacgaagatggaatttgcaacattttaataagcaactttatttaattaacaaaatgagagaattaaaattctactaaaagtaaagaattttaattattttttagtgactcattcctttctttctattaaagctcgatttgtctcgtctcactctcactttctagaaactttgaaactctcactctcgctcttccacgatggcaaacacattttttctttcttgattcagagcaatcactctcttaacgcttcatacaaggttggtcttttatcttcattattgagggtttcattttatattttgttaatttgtgttatgttttttatttggttgtttaatttcattgattttgtttttgatttgatagggttttattggcttctttctcattatgcttttttgttgttgaatttcaatttctttagctactcactcatttctctctacacattcacgagtcacccttgtcttttcattttttacccttctcaactcaatttcttcttgtatagaaaaatctttaagcactttcctaaattggttcacattcagaaacaattggtcgacttcaagctttatgcttccatccttctccttcccatacggtttccttaaaactcctctctcaaacataaatatcactcatatcatcgtcagaatgcggattcccaatcacatcttgggtttactcaaaatcgctaacacaatcactttgattttcattactccaatctccatactcaccaatgggatcatactcactcttagaagactgattatcactttcatccatttcgtaacttttgtcatcatcacttgcatacatgtcatcctcatggaattatccattaacattcacaggttcatcacaaatgcattcacaagttcatccacatgttcattcacaaattcatttacattttcactcacaggttcattcacatattcattcacattttctatcacaggtaggtttcaaaactcatcatttgttctactaacatacatatgaatataaattgaatttgattcttgacaaacattttcagcacatcatgatcagtcttaagaattttaccactaccagtagaacaaaatcacaaaataaaagggtgacatggtgtcaagtctaagtcattaacaatgttgttcacatagtcatgtgcgtcaaatgttccaaacttatcataatcaacattgcatatttcacttggttcgtcccgttggtcagtaaagtggaccaaaatatccatgatacctgattcaagacctatgtattccagttcatctattgtgttcttgtggtcccaaacatcaacactattttaatcaacaataataaacaaatgattttcagttcatccattgtgtttcctgtggtctcaaacatcaaaactattttaatcaacaataataaacaaataattttaaaaattataagtggtcctaaaccgatcccccattgaaaccccattcaaaaagagacaacaataatcaatcaaaattaaataaataatcttaaaaagtaacatatatacaaggtccagtggtcacttacaagcagaaccatagcgtgaacaaaaatcttggaataggaagagaaacagagacactcgtgaacgtcgaagaggaagacaaactaaggcactcatgaacgtcgcgaactagaagaggaacagtggagaacttacaaactggaagaggaacaatgaataactcctcactaacgataaagaggaataaaatgtgaacatcatgagaggaacaagaaaactcactaacaagaggaagaggaacagtacgtgaatcttaatttatgaaactaattgggagtggataatttgggttttacaattaaagtgtaagggtaatttcgtctactcacatatttcgttgactttagttaattgcattaacatatggggtaaacgtaatatgcaaaaaatgaagggtatcaggtgaaatttgagcaaaacatagggagtgcgagtgtactttactctaaagcattttaatggttaaatactattaaaaataaaaattatattatatgtagagtttactcataaataatagaaaagttgatcctttttcttgactattgatactcttgtaagctagaaacagaattgttaggaaattaaattttttaacgttattatgtgttacatattgtattaataattatattatgctatttaatatatattagataaattaaagtgattaattaaatatgcccaaatagatttccaagtaaatatgagataaataggtggataccaatgatagactaattagatttaacgggagcagtttattgacccaacaataaagaaaaacactatatagtattatggtattcaatatgtcaaattaaatttttgttaaatatagagaataacatctaaggagtgatttgacagactaaaactcataaataaaggctaaaaggctacaaaaacaaaaggataaattcatgctacaataaaacatacatgtatgttttatttatttaaatttttttgatgatccaatatgatacttctaaattttattagataatgattttcaccgtatccatttagaattaattttctcatagtaacaatcgtgattgggtttcacagttgtagagagaaggaaaaagatggtgcttctacaggatttaataactgaaatcctgttaaggttgccggtgaagtctatagttcgttttaaaagcgtgtgcaaagcatggctttgtctcatatctaatccctactttgcaaagtcacattttgaactagttgcagcacgtgtgtctagacttttgttcattgcatcttctgctcctgaactccggtccatagacttcaatgcatcgcttcatgatgactctgcctctgtggtcccaaccctattatcactttgatgaaatcataggttcctgcagaggatttatgcttttgcaccgtttatcccatctctgtgtatggaatccaaccacaagtgtccacaaaattgtacctttctcacctgtttctttcaacaaggatgtcgtgtttttcacacttcttggtggttttggatatgacccatcaacagatgattacttggtagttcatgcatgctacaacccaatatatcaagcaaaccgcgcagagattttctcactcagagctaatgagtggaaagaaatcgagggaatccattttccttatattcatttttattataccaacaaaaaccctggcagtttatataaccaatttgggtcattcttgaatggtgctattcattggttggcttttcgcagtgatgcatcaatgaatgttattgttgcccttgatttggtagaaagaagtttttcagagatgcgtctcccaattgaaattgattatgacaaccttaatttttgtcatttgagggtacttggagaatcgccccatctatgcgctgttgtggggtgcaaccattcagtagaaatatgggtgatgaaagaatacaaagtgcagtcatcttggactaagtattgttattgatgactttgctattcggttcttctttccactatggtatacaaaaagtgatgatattgttggaacaaatgtcagagctggattgatgaatgcaatgacaaaggacaactgcaagaacatcgaatctactgcgatagtctatatcgatccgaggtggctgtgtatacggagtctattttcactcccttgtgacagtaagtgagcaagttgaagaagaagatgattggcaccagcgaacaagaagaattagattgtaaaatattttctgacacctttattatacttttggtactcatcgtatattattatttgtttgatttcttttggtatttttttagcttgaaaaagtattaggcagaatgatgaaattgctatttcatcgttttgttttttgttttatgattattccaacatgatgttattactgttttactgtttgcaatttatatccttccattcttccacatgtttttttttcttagccataacagtgaatttattgcattgctagcatgatatgtagccaaattttaaattggggcaatcagttgatagttgtcgatactattgatatgaactgaatacgacttcaacattaatagtgatgtctaagttagcctaagctacatgacatgttgtgaagtcaatattatcaatcttggtttccatgccaaattaaagatgtttattttaatattcgtgtcttgaatcatgcataaattacattacttttatgaagaatattttatcaatatcagcttgaatatataaagtagccaaatagtgcaccctagaggcaggaattactttaccaattttagcatgttgaaatgctacactaaatacttactaataaagttaaagtaattatatttgtaatggctaatttattaaagaatacgaattttctagtctgaatgtggttctttaggcttagggaaggcatactatgttggttctaaaaatataaatcttagattaatgcctgtgataccaatagggaggttatgcataacgggttggtgttttttttcaatttaaagcttaccaatttatgaactcagttttctctcatttggatttaatgcattggttactacagggggatcttggcagagctatttctcactttgctttaagatttagtggatgtgattagtgcatctatggttatttagattcagcttattatatgatttctgtattcggttgcaggggcaacacacatctgtggttattatcaattaagtttaggggctggagtgatttgtggggagtctagcatttttttcaaattcaaaacacatatggtgtggttgcatggaattcaccctgtcacaaacatgctaaagtcggtttgggcatgtgcagctacatccaaattttgatcgatcagaataagcccaataaagcttttcatatattatttcttggttgtggaagtggtgaggttttgaagattggaacttgtgtatcttttagaatatagtgtatttagagtttgtttgaatgtaaggttaaaagtgtttttgaaagtttttttaatgaaaaaaattctatatgtttaataaaaaagatcttaaaagcatttgtgacttgtatccacacaagtccttatattacattgacttggaagtcaaatcattttttgttaggtgggttgatcatatcaatacctttagtttaggtttaggtggcctcttaactcttaaggctgatttgcacgcatatttttagctttgcgaaactttgggtttttgtattatatgcataacttcttacattaaaacacgtttaaattgatgcatgacagccacagcataattatagcttttttttccttagaagatactatgggaaccctaaacaaagaaaatgtaatttaagaactagtttaaacattctcacttccttgcaaacattggagtttgccaatcccaggatttttgccctttcaatgtcccctcttaggccctggatgcccttttgcttgtggataatttatagtagattttgttgtttatgttttccctagcattaaaaaaatctaaacactgacaattcatacaacggatgatataagttagaatataatttcacataaatatatagataagtctctatttcccaagctcatatacggtcttaagagaatgttatagtgtattcttagcattcttctttgaaaaatgtctgacactgtaaattcattccctacgattcatacaacggattatataagttggaatgtaatttcacataagcatatggataagtctgtatttctcaatctcatatatgatcttaagagaatgttatagtgtattcttagcactcctttgaaaaatgttcgacacagtaaattcattccctacaatttatacaacggatgatataaagttggaatgtaatttcatataagcatatgactaagtctgtattttccaagctcaaatacagtcttaagagaatgttatagtgtattcttagcactcttttttgaaaaatatccgacactaaaatttattccctacaattcatacaacaaatgatataagccggaatgtaatttcacataagcatatggataaatctatattttccaagctcagacacaatcttgaaagtatgttatagtgtattcttcgcactcttctttaaaaaatatccagcattcctataattttgtgtttaacctaccaatatgaaaattgttttctaacacatttgattaacaggaagtgtgttcacaaaagtataattacgtcaatcagaaggttactatttttgtgataccctctccattgttgtcttatgatttttcaattttacattcaaattttcagttacatccttgagttttcgaaatatatcttcaaattcccaacttctttaggttacaattattgagaagagaatgccgaaaaagagaaggagagggggagaagtccttaataaagttacattgtttgtaatgttttgatttttaaaaagaaaaattataccaatcgatatttactcaactacacgtgccacagccctacaagtacatattaaaagagacatacttcttcttttaggcccaacacacaaattatgtattagtcaggctgggcccacatctatccactatgaccacaaattagaagtacactttggttatggtctactggggggtaatatttcttaatccaactttttcccttcttttcttttgtgcactacattagaaacataaattcatgatgaacatatgcttacaattgtttcacatctcacaagggtattttattatataaaaaaaaactaagtgttcattttccaattttaccactgtgtcaggataagtcctcacaaatataatttataattttcaaaaaatatattttttattttctgaatgtaaagtgtttgaatgtatagtagagagagaaattattgtatgattccacagtccagaccattacatatttatgattctaataagtattcatgtaacaagatgtaatcaacaaatttcatgtaacatgtggagatggttatgattatagatacattgggtattcgaatatacaataattttttctttataggatctgaccgaatttttttcattttacaattagatactcactactcagtgggatctgaccaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaacaatatagaaagcataacgtgaagctatcgaaacgtctctttattcagtctgcacctatggtttaggtcaattgcgggtgaatttcctttagcagttataatttggaccctagaaaatgcctctaagctacctaatacctattcccccatgccaagcgttgaatactaataagtaataacagtttgtgcatgtattttcctccataatttgaaaatgacctatcaatcgtgaaattaatttgtatgatatttttcctcattaggtctatccagacacttcttttcttatagtaaaattaatgttcttaattaaatttattaaatatatactaaatctcactcaaactttttaacttttcttaaagtaagttttaaactaaatttttataaaattattttttttagacatgtaatacaccattgttcttttgatttgattttttccatttcgcatgtgtaatattttttatttttaaattttcagcaactttcatattataatatttcacgcggtgacattttacttaatatctttattagtcagaattctccatcaattacaactcttcataggtaatcatttctaagatctcaaaaatcagttctatatgctttcaggatcaatgattgaccccacaaactaacataagatttttcggtgtattttgttctcattctcgcacttttcaggaaactttccaagagattatccatcctataactacttcaagtcaaacacgcttaattatgaagttcttaagagatgaactaccaaaaagtagatgcatcttgttggtataggtattaccaattaattcttttaggtcatcctcaattgtatagtttcataattacacaacatctggatctctcattctggtgtgattcgatcgaagtgttacatgtctatcagtttttgcttggtttgtcctcgaaccacatcgtactgggagaaagatttgctctgatatcatttataacatttctaatttttttacttctcgataactctcatattatgacatttcatgcagtgacactttactcaatatttttgttagtcagaatcttccacatgtcaaaatcttccacctccgtagttagttcattctaaaacctaaaaatttaggaatcttacatgatacaacaaacatatagaatttctattttattaatgattaattattaataaaattaaatgaatatttcatattaatgtcttggtcataataaaaaaaaaatagagtttcttggtggaggagacgttccaaaagtcaagtggcatttaacctgcataagacctacttgcctgctaaagttgccatctatcatctatctaacttcttttgccttccaagtttggcaaaaatctaaggttgcttatagcttcttcattctcaagtcaactatcatactcaatttggaattttctctgtgcaatttaatttgtggacacacacacaaaaaagggtaagctagcaacttgtccctaacttatgactttcttctttgcataatattgtagactattgtgattagaaaatgacagttttattgattgtttgatttagagttcactttttaattctttcccgccaccccctattgtaaactcttgttgattggagagttgtcttgccagctcactttaaaaatgataagcaataaaccatccatgaataagaactagtactcaagtcaatctttcattctcatacctttttttattgtattgtttatttaaattattttgcaaatttcctaaccctgggcccacctgtgttttattgtatgcaaacttttgaggtaattaagcatttattattaagtaatgtagaacattgtttcgcttctgataagattagcgtatcataaatcagaataattaacatgttcaagacaactgttatcatacttacataataaaatataaaaaaaataaatgacatcaaaatataaaccaaacagtttatcatagtgcattccactaaggtggacatgaattagatttttaaaaattcaatttatatctatttaaatggattagattttaaatttatatttatatttttttaaaaaacaatttagatgcaagatccaatccatttaaatggatataaatttagttatatccaatctatatctacttaaatgttatagttttttttttaattttaattattaaatgttaaaaagtgaaaacttagtacatgcttatttaaaagttattttcaaccgaccttggttaagactatttttgatcgatcgatcttggttagtatattttttgcctaccttaactaggacaatttcgacatatatcggtctagatatttttaaaccgacatcaaccataactattttttgactgacattagttaatgcattttttggcatattgactaaggatttttcgatcaacaccgatcgtgactaattttttgtcgacattggttaggattttttagctaacatcgataagatttttttttttgctaatgctagtcgttgatatttttttgccaacattcttcgagactattttttggttgacattagctaggttattttgccgacgctggtttaaactatatttttgttggccaacattaaccatgactatttcttttggttgacgttagctagggatattttttgttgacatcaactaggttttttcgatcggcgtcaattgggggaatattttggccgatgtcaactaagtttttttggctgatgtcgatcgatgatgtttttcaaccaatgtcggccaaaaaatagtctcatctaatgtcgacaaaaaaaatcctagccaacgtcaagcgaaaacctacctgacatcgataaaaaataatctcgatagacatcgacaaaaagacgtagctgacgtcgacaaaaaaatagtctcgactaatgtcggccaaaaaataatctcaatcaatgttaacaaaaaaaccttaccaacattaaccgaaaaatagactcaaccgatgacggcttaaaatcatcattagttgacgtcaaccaaaagaactctagacaacatcgacaaaaaaatggctcttaacaaagttggtcaaaaaaatctagtcgtcattatcaaaaaaattgtattgaatttttataaattcaaacaaatatccaatccatatccattctatatccaattaattagattagatttaaaattcaaaaaactggatttggatatgaaactaatctatttaaatgaatttaaagtgaattaaattggatcagatataaattattttatgaatatttatttttttcacaactctacattccacccttaaataaatggttttttttaattattaagaagttacaatcttaacaattagattgcttgtatacctttcaatcagtttcttttgcaatatttagcgtaatgaatattcagtaactaagatttaatatttaaagagtccaatgtaatatcacttgacaaggataacttattagacttaataattgccgctgtcaatttttttaaagtgacttgtgaatattattataaacttctgttaatgttgggtggcacgtaatggccttaaaatagattaattctttccgccctctaaacttataatacaatttgtatttacatcaatcctttttatatacatatttattttagttttctatagttatactacataagtacttcgattcaagacacacacagtcattcaaacactaaggtggatgtatctttactatgctgcttataagtatttcatatnnnnnnnnnnnnnnnnnnnnnnnnnnnnnnnnnnnnnnnnnnnnnnntatatatatatatatatatagagagagagagagagagagagagagaaattcatttattttaaaattaactaagtattaaatacttcttctgcttaacaatttattcataaatctaactattaaattatatgatacgatattaatggttatataatatatatatatatagatatgaaattttattgttgatatttaactaggtttatctttgaaagtatattaattctgtaaaaaatatatatattaattgataaaatatcaaatagttttttttctttctaaaattaatttattgaatgataattcaatggttgaaatgaaacttaacgtgcttgaatttaaattctctcttttcaatcatgcaggcatggccctttaattccacctaatgagactgatgaggattcctcctacactctagctataggttacaatatatatatatatatatattagacattaatgtttgaagattctacgcgagcatggcaaggcgaggatatgtaattaaataaccaaactcatgtgatttgtcttgtacacggctaaataaataaaggtttggagagaaaaaaaatcaagggttaattaaaacagcttttattaagacatgatgtgtgatacccgtaaagggaagcatattgtgccagaatcagagccattattagaaggaatacatgtattaatcatatcagttgattctgttggaatcacttgagcaaatgctatattctgttggccatcatatatatatatatatatatataacaaaacccatcaaagattttaagagttgtggaggaatctacctgtgtgattttgaacctaaattagtagtttctataaagattaaaagatataacaagttaaacagatggagataataattctagtcttttccagaacaacactttcttttatgacacggaatatttgggcagtcgatcagttgagattaatttaggtggttatagaatgaaataaaatagtacaccaacaatttcaaacatatttgatagatagttaaatttttttagcatgttgtcaataatttaatttgtgataatgtaattaaatgtaaaatattttattagaaaaaataaaacctattttagtaatttttatgtctcaaaagtaannnnnnnnnnnnnnnnnnnnnnnnnnnnnnnnnnnnnnnnnnnnnnnnnnnnnnnnnnnnnnnnnnnnnnnnnnnnnnnnnnnnnnnntattctttacggcctaatagttcatagatatttttagtgaaaaaaagagagtctccattgctattaaagttgcaaatcaattttgaatgttgtaaacaaacaaccccaaaaaatgtaatttagtgactttttatttatttattattatttttaagcgtgaatacgacctatttttctgttcaaataggtttatataaagttaaaaaaaaaatcagaataaatatattttgacgaaacatgatatctgcaaaatgacaattagtcattattgaattattgaggataactgctgcatgaatgannnnnnnnnnnnnnnnnnnnnnnnnnnnnnnnnnnnnnnnnnnnnnnnnnnnnnnnnnnnnnnnnnnnnnnnnnaataattagtttcttcttattcataaaaactcaaacttatatacactaaactttggttaaaatcttaaagcagtttctaaattgaaactgtgtaaaaaataaaaatattatttataaatattaaagtctaaggagaataaatcaagagaaaatagattaagcattaaacgtataaaataatattataatatcgtcaaattacattttatgattaatttattgaattttataataattattttaaaaattatatcatcaatcatttatgattaaataatagtgaaaaattttgtcgttaaactcataaatcaataggagatatttatgtaaaggaatatagtttgatcctaacaatttactttccttattcatatttcccacgcctccaccagacaatatcaatgtccaaacaataaatcaatttctaattctgcctgggtcatatatgccaaccaagaccatccatgaggattcaacatggtactccaataatcatataactttatggttccacaatcatattgatcacatggagactttcagactttgaaaaacttcaattcgatccatcaaaatcaaattagcttgaagttgaaagtgctgtttaagataacttgttatacatcaacctcctttttatttgtatgatatgttcaaagaaaaatatagaacaaaataaattataatatttagttttttataatttttaatccataattttgatctcataattttttctctcataatctaattttcaattattttgtgttttttttcttttattttgatttaaatgaactctagatttaacatatccatctaagttattataaaaaaataatttaattgattagaatatgaaaaagtgtatataaaattgtaaattttttagaataaaaggacaagaaaaaagaataagggaaccaaaaattactattaaaaattaaaggagaccaaaattataatttagtctaatatattaatttatgggatattgtataatttaactaataaataattttatatatttttaataagtaatcttgtataatttataaatttatatagtttaaataaaatatttaataaataatattctatcattttaacttttaatattttcatacaatagacataatattcacttgaaaaatcaaaagtgtaattaataaacacaataatattatatattaaatatacgttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtataaccaacttattcaattttaaggactagtgattcactcaataattaattatggcaattgcctaagaggaaacagttttcctttgtgtgattgtgtttgaattttcattaagataaatctgaacataattaattattgcaatagcctaaaaggaaaccaacaaatacataaattaattggtctaagattgttctaatttaactactaatttaatgtttgagtcttggatttgtaattatattaatattaactataattattttttatcatcacctttcatttatatgaaatttaataattaaaattggtgatgcattataattaaattttttaaaaaaataatgataaaaacgtgaaattatttaaaaaaacattactcttacaataactttaatccctcctccaaaatcaatgttactaattttagctttttacatttgtttacatcaaaaacataatttgttggctattgaacgcgtttttaaacacgttcctagccaatagctttagtggtgcttaaaaaataaaagtataaaaagtaagatgtgataaatataaattataaagttaaaaacaacagcaatttagtcacatattttttagtaaattagatatcatagatgttattcaattcattaaatcagagaaactaaactcatttatgggtgttactcacttaaaaaattgaatacaaaattttcacagtaaataaatcatcttttaacatgtgaactaagcaaatcttaaatcctatgtcaagtcgagcagcaatatagtaacatatgaaaagttatacatgtaattatctaaaatactccgtgacatgaaaggtgcacgaagaccgtgacacgtgcaatgctggtttaaggtcataactggtatcacactcactccctgatcgagaaacgagccacagcagagcacagtcacagagccagaaagcaaagcactctctctctatggatctctaacattgacacgtgcccatgcctccttatcactgtaccttctctctcgagcgtgtcacccaacaatttcacctctcactctcttcataatcacatagaataactcaatacgaacacaacactttttcacttattttgcaccctaccctcctttattattattattacaagccagatactaactgtaagacattgactaaaatttaaaaaaaaatattgagatggataaaattatatttttataatttttataataaatatttttcttttagtctttaattaatcataaaaatactaattaataagattattattattattatttcttgcatagcccattggtggtactacaattcaaggtgcagatccttgtgttcatttttggcttataataataaaaggctaatgtgacttgttaagctttaattttatatttttaaagtgagtttatgggttggattagtaatttaataatggaaagtgggttttatggggttgtactaaaataatgttggcttctttttacccggcaagtgattgagcatggaattgcgagaacagggcaacacgccctcttggttgtgtgtattattattgctgctgagtgcaaccccatttgatttggttgtacttttgaggccaattcagtggtaaacatggccatgatttgtataagaatttaagaatcatagtatgacaacacccaacccaacgtgttcccctttttctctttttactattatcaacctcaattctttccagatttggatctcctgcggttaagattaacggtagacaatcccaaccgtttaaatcttattactctatattttaatcataagacactccactccatattttttttcaagaatgaaaataaaatttaattacacattttacccttttcttttatattttgtaaattttaccacttattttttatatatactttgttatcatacctaatattaaacattttgtcccaacgttagttaaccattggttatcgttagttgattgttgacttcacaatgttaattattgatgtaatattatgtccgctaacttggttaatagggttgacatggtcgtttgacacaaacatggtagtgcataagagaatgactttataatggatatttttttttcgtttctaattataagattttttcagaaatttgtttactgttttttataatattttaaaaaaaatttaaatgtattaattattttttccttttgcacccttacttaattattttatcttcaaacattaataaaaaataattaaatagatagagatataagaaaaaattaattttaaaatgatattataaataattaacatatttaatatatttgattaaattaactatttttcttaaataatatgaattaattgaaagtattttataattagagacaaagaaaatacaacctaatactttagataaaaagagattttaaggtgatgatgataacaaatataataacagtaataatgatgataaaagaaaaaagagagaataattattctattttgttgctttttaacttaactatgttctcaacataagaaacatattacaccaacaatataaggaagaacaaccctaacccaacaatattccctttcaaacaactagatacttacaactatcactaaatgacaaacaattgatcctaagggcaaagcctcccaaatgcaatgaggagcaacctaaaagaggatagcaaccaatattttctgacacgtatactttctgcctcgtgactcttatattggagtatccactcattttagtgttaagagtactttttacaaatacatatttaccttcttacttactatagttttggaaatttggagactagaatcaacttacatcaaaggaataagaggaatcatctatatgttaaaataatttagatcataaaaaacattaactaattttttgtacaaatttaatttatacatatgtacaccgatgtcaccgagtataagaatcatttggtgtttaactattatcacttctcataccatgggagaaaaaactaatcgtcaaggcgtcaactagagtgataatattttaacattcatttattttaaatattctatcaaaaactcttatttcattttttctttcacattatataatctattatacttatatttttctttttctttttcactctctagatttcaaatagcatttaggagtaaaaaaaatatttttttcccgccaactatttgtcttttggttaaaaggtaaaaaagaaaactgtcatgcaaaatatttcctaggtatggtgcgtggccatttttattaatagattactctatgaaagtgttttcgccttgctgcttatatttgacagttaatttgactacaatactaattagcgcaaaaaatctgtgttattgatatgctggaaggattttaaagagtaaaaacttttgtcaaaattaatcattgaatgcgtaaattaacttatacatgattattttaatttaaattttaaatatacaattacattaaatattttaaataataatcctaccagagctttgcaataattatattgattcttatacatgctgttggttaaaaaagagtaaaaaagttgtcaaaatctaagttagtattagttaacttatctccaataatataataatcacaaaagatgttccatttgtactacaaattgatcatggagtgtgaccgaatggttggtctctccccaattgccattctggttgccagcaaagggatcttagtgggtttttgctgcatccatgacccatcaaatgctgttcctgcagctgcatataccttccacatgacacttgaaagagagagggtaggaagctaagacgcacatcattggtcgtacggacagctacaacctttgcccattaattaaatcataaataccctcaatttttgctttataaaatttaaattaaaacatgatgtacatttaaaaccccaaacaacttttcgaaaaataaagttgtctttaattggaggagccagttagttctgaactcgacatttgggtggtggtgaagaaattttttacactactttcagggtagtgctatccttttcatcttcattcgaattaaccctcttttctaattacaattactactctgccatgcattcacaatcggatttaatttcgattagtatatttaatttgttcttgaggataaattttgtaaccttaatcttatcttgtttctttagtttgtttatattatattttcctttcttcaattatttaaacaaatatataaatgttgtataaaggtttactagaactacgaagaaaaactaacatagatttaatgaatcatttgattcttatgattgtagaatctttaaattttaatccatacacttagaaatcaatatatattttagtcctcacacgtaattttatatcattttaatctttgtataaactcttttcaatccatttaaattcgtacaattttagacaacaaagattaaatcagattaaatactgtacctaaaggaacaaaacaagtagtttttgggatagggattaaaatataaaaattatataaatataaggactaaatgaataagtaaaccgtcaatataaatgcatggattttataggcaaattagttaacaaattaaattaaacataaaatattttgtccaaattattccaagataattattatctatatatatgacgcatgaaattagaattataatttaaaagtctaattttagctttacattccaattttaatttaattcggagtataaaaaataaacactagctgttaaaagttaattttcttcaattacatatttgtttgtaaatacttttttgtattgttatttacgcataataaataatgtcttgcacaaattttaattgctaattagttttttttttcttatttatcatcagtgactttacttatatgacttacaccttatgtttgaatacaatttcatcttccaaataattttttgatggtaaagaaagaacggatagttacaaagttttttttcttttcttttattcgtgctccctctctgtctgatatcttcatatatttattttttgcatttttggtacagaaagggggatgggggacacatatcactgatggacctgctacagctttcaagttttatctagcaaaaaccacagctcatctacgaacttttatccataaaaacagtaaacgttgaatgaaagtagacggcaaataaatttttaacttaagaagttgtaatttcatttacatagaacaatatatattaagttaagaaattacattattaatatataactattttaaaattatatttttaaaataatattaaactttggatcgagttgagatgagtcaaagtactcaaaagatattgaatctaattctaaatccaaattagtcaaagttaacttcaaattgatatgggttagtatagaacacgataagccatgaacactcttattagcaagcatgagtttgttcaataaataaatattatacatcataaaatacttatttaatgtatgtatgagtttgtcaaagttaagacgcattgttacgatgaaagctaattcgaattgtgtaatttgtaatgagtgcgtagaatcttccaacacctcttttttgaatgtaaatttgctaattagatttggacaacatgctacttgtggtatggtgacatacgggtattgccaccttgttgcattgctcacttttttggcaacatcaagggacaattgttgggaggaaagaaaagtcaatatggtgggaaatttggttaattacataggaatgaagtaagattcaatgtcaaaccaattgatccagggacactctttgatactattagctataaagcttgaacatggtgtaaagcgtacgttaaagactttgataccactttgtacgcttggaacactcatcctcgagaagaattgatgcaactggagtaaagcgagacgctacatatggctcatactgtttctctctaaaccatttgggtcatcttgtaatggtataaaatacttctcagcctcttggcttttgtgcatgtactgttcagtggcaatggcacttcttgtgacatttgctactttcttaattaataatataatgcctttcatgtgtaaaaaaattacttaatttaaaataactcttataataagcaaagatattggagatcaccttaataatttttatttttatcccaaataaatgcaggagagtcataatatcattccaagtacaatttaaattaacactttggcatgatctattaacgaagaatcaccacccaaattaaaataagaaactattttttcgaggttgatcaatcttatgatccaactccaccatctcattgacaaatagagagacacaagaagaaaaaaagttccaaccaaacaatgaattttaaaagaaagatttgtggatggattaccattttaagacatttaatttctaaacaaaatacttgttgctttgagaggtatcctcattgtgggtgagtgtttatatatatatatatatatatatatatatatatacactgaagaaacatatgttaatatatcttttcaattaaagtttgtaaggtatgtatatatttaattaaactatgatataaattattataaattaatctatttatttgaaacattaaaaatatttaaaattaatgttattatatacttttattatttattacagtacaagaaaattgttaaaattaatttattaaaaaatattgataatttaaaccaaacatacacagcatacaatctcttgaccgttattttaccttgttagttttaattttttggaactacttgcagggtcccatactctttaattcttgtaagaaaccagcttcttaattaatgagctagttaatagtcagtccatttacaaatcaataaatcgaccttgctgcaagaactgaagatatttttatctaaataaacatatcatctaattaaaacaccctatacaatagtacgaaacttcagtgtcgtgcaatttcttcaagggctagtagtacctgcaataaaactgttgtgatgtggggctaagaaattaaaactttaagctgtttcacaattcaattacactttgactgcttagggctcgctagtggcacatcctgttctcgacaacctatttgatgaaggaaagtgataggataattatatatcactttagaaaataattaaccattgtgttatatatttactccaaagtccaaactcaagtccgttgcttcgttaggttttactgcatttgaggtattattatttactttaaaaattgtatgaatctcatggttgtctttgaaaactgtttcattcggagaatagggaagagagtattgataaattactattggtactgatttttaaataatgtgagattttttttaagtaatatctgaacggattccaaaatcacaactttatcaaaatgagtcttctctgacttttcttttgaaaattcaagacacatatatcaatatatcattcacacgcatagttatttcaatatacgatccgtcttttctgttgaggtgctaggttattacagaattttcatgcatattatggtcccctgtagtcttaatttggtccctaattcatgcaagctttgtatttgcggctttccgcgcatgagattttttttgaaagatggcacactaccattaaccaaatataacaattagttcgtctcattggttactacatgcggataaatgaggttatgtcacaacaattaatatccattttaccttataacgtgaatcttcgtgaaacacctgtttatacagagtggtaaaaaattcatataggctctaaactcctttgcatgtaacccttgtttcaaaatatcctgtcatttgagtgtatacttcttgagaaaatataattgtattttaattttataagcaatttataataaaaaagagagaaaaaaaaatacaagtgaatgatgtaacgggaaaaattgaagagaataataaagtgaatctaattaaactacactaacaacggaaattttttatagtatatgtcatctaatcacttattatcatatataataaatttattcacttttataataatattatatttaacgttatacttaggataattttaataagttgttactataattttttttatactaactatccataaaattaaacttatataatattgtaaaaagtgttataaatatatattatataaataagataattcttaagttaattttcataagtgtttgtgtactaattgtcctgcactatttcacccatctcatcaaaatgggatcactgctttttaaaatttgtaagttcttcaggcttccttttagtaaaggaaaaatttatggacatattggcatcttcttttgttctcactgaattctgctataattgttaaaaccagcctatttaatcttaacctaccaatccataaggatgtttttgatcatcaaagtccagtttttnttctttctttcttagtagacattcttggttcatttaaatagaaatttatacaatatatcaaatcacgaaggaaaaaaagaaattgaaatttgggaaacacgaaaaaaggccagtacccacttaaaaagaagtcaattgcgtgctgcaaaagcctgactttttttttcttctaaaaggtgggaattagaaataagaataatacatgttctataattaatttatttttacataagtttaatttgatttctagatttattttacagtttgagtttgattgtacaggtgatcatgaaaattaatttttgtttttttgataaattgattataattcacaatacactcaacattgacaaatcactttaaaagaaaaaagaaaaggcaaaaaagtttaggaaggaagatattctccctttctaaagtttaaaagggtaatcgcgtaagagactgcttatgaagatacattactcttattgaagaaaatcactcctgaaaataaccttatataaacacagttccatcaacatttaagtagatataatttgtttttggctacttctgacttataaaaagtgtgagagggcgagggaggtaatttcttttcttttaggatgaaaacatttataaagctcaattataacttatgctagttggcaaaaaaattaatatattgtttttaaaaaaaaattatgaatttggggtattgttagaagtatttatgcaagtgtggtagttagttgcgccaaaaaaaaaaaaacgtaactaaacacatttaccccaagcgcgacaggtgctcagtcgcgccctcattaggcgtgaccggtcgcgccccagataggtgcgactccctcccccgttgcgtcccacacaggcgtaactctgcactgcgccatgttgcacctgccccagacgcgactcttccgttttaaatttgaaatccaactaactttcaaaaaataacctaggtataactaactaattatatcgctaatttaataattatattatcataattttttaaaaatttgaaatacaactaattttcaaaaataaactaggtcactaactaataatattctaagtcaataatgtcctcaacagataactaactatatagctaatttaatacttattttatcataattttttaaaaatttgaaatacaaataattttaaaaaataacctaggtcactaactaataatattttaagtcaacaatgtcctcaatagaaaactaactatatcgctaatttaataatcatattatcatgatttattttaaatttgaaatacaattaactttcaaaaataacttaggtcactaactaataatatattctaagccaataatgtcctcaacagataattaactatatcactaatttaatgattattttatcataattttttaaaaatttgaaatacaactaattttaaaaaataacctaggtcactaattaataatattttaagtcaataatgttctcaatagaaaactaattatatagctaatttaataatcatattatcatgatttattttaaatttgaaataataatgtcctcaacagataactaactatatcgttaatttaataattatattatcataatttttttaaaaatttgaaatacaattaattttcaaaaataacctaggtcattaactaataatattctaagccaataatttcctcaacatataactaactatatcgctagaatttaaaaattatattatcataattttttaaaacgatatgcaaagtcgagcttgggggaggcacaacaggatgcagagtcgcgcttgtgtggggcgcaacaggggagggagtcgcacctacctaggtgactggtcacgcctactaggggcgcgactaagcacctgtcgcttatgggggaaacatgtttagttacgttttttggaggcacgactaactaccatacttacttaaatacttctaaaagtaccctaaattcgtaattttttttaagaaaaacaatatattaaattttttgtcaactataattttgtttttaaagaatccaatctgatatttattttccacaatatttgatcaaatataatatttatttaataaaatatacaactcattcacataccacgcttcaataattagatatgacaagaaagaaacgaacttatctttaaagtgaaatgaaagaaagtgtatatttattttcaatttaaattgtttataatttgagtttaatatttgtaagtataaaaaagttatgatagataaaattatcaaaatattattaaaaagattaacaaattcaccaatacataattatttgtgatagaatgataacgtaattattattttttatattatgagtatatatatatatatatatatatattttaatttgaatacagtaaaattaaaaattaggaaacaaataattttttcttagataactaaaaatttaaatgaattaagtttggggtctcactaggacagagcaagccttaaaatttaaaacacttataaatgtatttataaacaagattcttatattataacaaaaattaaatacatgttttttgagaccccttgccaattcaattaatttgttggttagaaagcaaataattagtttttgtattcttagggtaataatgaacgggataaggttaggaagtaaatacaagaaaaaggagggacatatatgaacagcactgtgtctagtcttttccgataagcctggtcattgttcaaatggggaacaacatcaacaacaacaacccttcttcttcacaagcactttgagttcaactcaccgttgtgcttctctctctctgtctatatgtttagtgttttaccttttacacgcacacttgtctctctctagaaatcacgcaattctcatacacccggatttttctttccatttatcacccaccaaactaccaactttctctatctcttaccacaactcaaatgtttctttttgccatgagagaaatacaaacaaactgtaagtgtcaaccaaactccaaattcacctttaacaaaatgctagcatatgctctttggtagtgaatttcaggtcttgttttagccatgttaaggtcgagactataagagagtgatttaaaaacaaaaaacaacctgaactttttgttttcctcttttacatttgaaggtgctcttgagagttgagacatgagaaaagaccatttgagaaattcaacaaactcctgaaatcaggcagcaaaataaggtttcatctcatattttgtctttatttctctccccaccctcacttcgatctctttctttttggttaatactgttttttcttttttaaatttttttggtttacaaaatgaggggtacttactgaacaaaaagtattgtctttaacgagctaaaaattttaggttcggatttttgtgtttttttttcagtttgtttcaataataagggaactccagagacacagatctgtaagcttaacacctgggtttatttttgtctttgattgagatctcagcacctgtcacggaatctgacccaacattgtttaaactaataagactccaaattttatttttaatatgtttatttaattaagactattgagcatttcagaaatagtgtttttttttttttttaataatgaaccttgcagtgcctggagttgagagaatctgcacccttccaataatcaaaggacttatttagagccacacatcatccttgaaaattttccagtcaatttggcgccaaatgttggacctttctacatgactttgcaaccacgctgaagtaagccatatttgttgtctcatattttcatcctctggtacgtaccaacaactcctctatgccctttgagatttttcagaaaacattttctgcttatgttgttttagtgttggttttgcaattttacaagttgtgtctattgtgaattaattttatatgtatgcggtctttcataactagactaattgatgtataactaacgaagcaatagctttagttttacccatacacaaaagagaaaaatttgagttgagttacaaatgaacaattaccttagcaattagcattaacatttaagggctaatttataagtatctataaaaagtattattttttttttgaaaatcaagtatttattacgtcaaaattactaaaatagttgtgttatatatatatatatatataaattataacgactcatacaacatttttgtataacaatattttgggtgtttattttatgtatcctatcatttattacatattatatttttctcattttttacaaaatgtcaaatgaattgttgtaaaaataatattttcttataaaaatataacaaatacttctttataatgcttaacattttccagaaaccaaatatatgttttcctaagttggtaaagattcattattaatgacagtttgtactgagggacacatttcaattcaaccttttctcaaagtattgagttttttttcttcataaaagtatatcggtttttaatgtgccatataccaactatactaaacacagtcagatcttatctacttggggaatctgagaagtgtacgaaatatttgaattgaattgaatttattttaatttacttttgggtttgaatgataattaattaatagaaaaatcgtttggttgtttatggtagcagctgggtgtgattttgcaaggaagggtaagagagagggtgttgagacctagttcagtgttctgcaactgcaaaaagctaaacaaggccctcctgatttggaccgtgatatatcagagcataaaaaagcctttttatcactacacaaccaaagcagtctctgaattatcatcatcaacaatgcaaaggacatagtagccaaccccacactttcactcttttctctctttctctctctctttacaagtgtaacataacaaacataaagagaaagacaaaagtgtgtgttttgtgcaaggcatgattgtggtatggaggaggaggatgagattcaagcacagaaggtgagaagaagaggaggcagtgatggagagagcacgaacaggttccacagcagctggcaccaccaccaccaccactcttcgaggatcataagggtgtctcgtgcatctggtggcaaagacaggcacagcaaagtgatgacttcaaaagggttgagagatagaagggttaggctttccgtgaccactgccattcagttctatgaccttcaagatcgcttgggttatgaccaacctagtaaagctgtggaatggcttatcaaatctgcttctgatgccatttctgaacttccttctttgaacaatttccctgacacccccaaaagtgatgatcatgagaagagagcaaacactgatgttgctgctggggtagttgatggggagaattatgaaaatgagaatggcaataacaataaccagagccagaacatgtctttgtctaaatctggttgtagtagcacttctgagacaagcaaaggttctggcttgtccctctcaaggtctgatattcgggtgaaggctagagagagggcaagggagagaacaacaaaggaaaaggagaaagagaaaaatgagtctcatcatcatcacagcaatgttgttcctcctccacatcatcataaccccgtttcacaaacagcttctttcactgagcttctcactggtgggattcccaaagggtgtgatgatgaggagcctaataacgtgatgatgttcaacaaagcagcagctggtagacagcaatggtgttcatcatcatcatcagcagcagcacctatggactactttctgtggccttcttctagaacaacaacaacaccacacaatcagcatcaccatcatcatcaatattcttctggtgggttctcattggcacaaatccaactaggacattctcttcctgaggcaatgaatcacaatgtttcagcattcaacaataatgtgagtggtgagaaccaaaaccactcatcatcagatcttcatctgcaacagcaacaacacttctcatccataccggatcatcttatgtcagctgtggttacttcttcttcttctcatcatcaacctagcgggaacgactacaatctgaacttcaccatgtcctcgggccttgctggttacaatagggggacccttcagtccaattctccgtctcttttgcctcacttgcagaggttttcgccgttagacggatacactgtacctttcttcatcggagctgctccttctgctgcagttgctgctcctgccacggagaacaacaccaccaccaccaacaacaaccattaccaccatcagttctcatctgttttcgatggcagccgcttgcaactctactatggccattccgaccagaaggggaaagccaaaaactgatatttggattgctgcattttcctcctggtaaactatcttcatctttttattatgttttctcttttcaacccttttatttttgcagtaacaaccttatctaataattcatttaactcgcttgttagagttgttatgatacccagataaatctaagggttttgatatagcagctggttttttggccaataattattgaatgagattagagagagggagaaagaaagtagtgagtttttcaataagagaaccacaacccgtaaattttaaaaggatactataaaatttctctcatttagtaactaaactttatcaattcccattgagaactcataaaaaccactgtaaccccagtgcccggaggctccacgctatgcgcaggtaagggggagggatattgtacgcagccttacccttgcatatgcaaagaggctgtttccggattcgaacccatgaccaacaggtcaccaagacacaactttaccgctgtgccagggctcgccctctcccattgagaactcatatcaactaaaatatgatatgaccaatgcaatccttgaaagactcgtccttttagcagttggccgaaaacccaagttttaattaagaatgactcattgttatatataggtctaactcaataataaaaacatgtgttgaaaaattaagttagataatatgtaatatgcctgctattatttctcaaaaagtcctgaaatgtatatagtagctgtttcttttttgttttgtttccggaattgtttgtttggctttggtgtattgtaaatgtgtgatacattgcactccatcttggttgtttgatgtggtgccccttaatcttcttcttcaatgctttggctttggtaaaagagaaatacttgcacaaacacacatctaacacgtaagatttagacacaaccaatcacacaagtctaagtgtccagttaatggatatgacgtgacattaaatatttgatggtgtgcgtattgcttgtttggacgatgttgtttatggattgatgtgttgtgttgtgtgcaatactatgagccgctggggttctaggtaatgatgaacaagttggccattgggtataagtttacggtgttgtcttttttgtggataggaacatgggttgccgtgaatagggtatcggctagttgtctccttgtttgtgctctcattggttccctcctctatagcatgtcaggtgaaagcttttgtgtggcacaaaccatgtgtgtcactgatgagtggggacaatgttaattacgcttgggcccaaaattaatcagtctctaaaaatgactttataatcccaattactccaattaagctctcttgctgtgcacccacaagacacgatcctcattggctcattgcctaggttagagactagctaggattttcaatacacatggggtggacctttttcatgtgttgaaaggtccatgcacgtagtcagaaacttcactgctgacaccactcatgcttaggggagtattgaaagaggaattgtatttttatatgcatttttcccactgtattataacaaaaagtttgaatttatgagctgatggaaaaaaagtattgagcatagattcacacccaagaagaaattaataactcattttttttaagaataattttggatcttctcataacatctctttataattttcttcattggaagaaaatatgcttttgatatttgtaaaatattaaatatgagaagtgtttgcggcgctctcgatttaaatttattgaaaattaccctcaaatatccccaaatttggcaaaacttaaaataaaatacataagctcttgctgagattattattggatggtttataaaaaattctaatttcctttctctattcaaagttgaaaattataagtgatgattaaaactctttgctgagattattataaaaattaaagtactatgtagttaattttacttcctggaattttcaattaataattattactttcaatttttctctctaaagtacatgttttactttaaactaatgacccactatttaagcaaaagagaaactgcacatcgaccatggaatcttgtttgggagcttcaatttattgagaagagcatcgaagaaaagccatcctttcactttcaaatgttgaaaatactcagttttctggaaatgaaaatctttacatggacttactctttttgagttatataaactataataataatctaatggcacataatcattttggataaaaaataatattatgtcacgtatcacgtatatttgagtaattatttaatataaaatgattatgctttatttgttagcttagcctgcatatcttgcctagccttttgaacttgagtaggatatcttctcaagcatattagggctaacatttttagtaacatttttagtactttataataaaaaggtcctccgcataattattattttaggatctgaacattaattcttttaaacaggtgacatgggtattataattgatactatactatgagacggttttaatttaatggtcttaattggttggaagaactttatccttataataattatatgctgttcaaatcaagttagttggatgcctaatgtgatgcttaaatgacaaaaaaatcagatcatatgatttgttttgaaaacaatagtacatggaccacaaatagaacctgacaggagtaccaataagggtttgatatactaatgaacaaattagacgatttatttaagaaaaaaaaagttcaaataaatcaatgtcctgtttggataattttttcacaagtactaatagaaaaagctgtggtgataagttaattttaaattatggaagaagttcaattcactatttcttaatttcttcttttataagtatttataaagaaatttaaccaaaccttgaagagttaacaaatagaaggaagccttaattttctctttagaaagtttctcttgaaacttttctattaaatgcataaatcatttgatataagacttataatttaattaatgatcctaattgataggaagaaccttacccattataataattctaatcagctgaaacttagttggttgtccaatgtgatgtttaaatgttcggatctagacaaaaagccagatcatatagtacattgaccaataataaaacatgacgcgtgccaatatctaacaagagtttggtgtagtaatgaacaagtcatacgatctaaaataaagttcaagtaagtctatatgaaaatatatctcaaagagttaacaaatagtcaaaactagaaggaagccttcattttcttttcagaaaatttctctttgaaaattttctacttgtctcataattgggacatgttttactacataggagttaaaattgatggactttactatatatatatatattaaaacgtaactcttaaactatactaattattgccacatcctactagaaaatcatttagacatactaatgaaattaggaagatcgtcaaatttactctggaaatcttggccttttcttttcttgattgcttctatatattcccatcattcttgacagttgcactatcaacttgagtttctttttgtatgatttggttatcgtaatatccgttggttggatcatagtttgggctgagttatattgggcactgtttaccgcagtagaaaaggaaaacacgcatgttactacattgccatatataacaaacaaatatctaattcatcttaactaattaaaatagttaaattaattaattctaattaataatcttataaatttaaattttcgaaaacactcattgaattaaatgatttaagagatggttgtatttaataatactattcatttttctaagggataattttttcatcaataagtatgacttatttcattaatagtctttataataaataatggtatagaagaaaatgaataattaatgcattcaaaaatgatttatattttagaaaaaaatatatttttatttgttttttatatatccaggaacggaggtagcatgtgacatgacacttcctcttgcattaggattctttcatgttgagggaaaagtctagttaaaatattgaaaatagaaactagaaaacacttaattattctttgtacatgttttttgatgctatgtagcctattaccgttgtggcttttagaaagaaaaataactaagaggcgggatcactcaaatattgaattggaaaaattaatcattattcttacatttacacaaattttaaatacttttaaatctcttttggttcctttcgatatataaattttatcttttaatctttgatattttgtaacgaggctaaaagaaattcaaaagtacttttacatggactgaaaatgatgatttttacgtgtaagattacaagataaagtttgtacaacttaggggttatatataaaagtaatttttcctattaaattggtacataatggagttgtagattagtcaatagctttgctgttcaaatactgtcaggattcttcccacatataatccttctcaaacaacctcttttgactttttatgaggccctagtgagttccttttaagggctagcataaaattgtaggggcagttcctgaagaggctagtggtcatattgtaaaagttgagcaaaatctatggtgcaagttcaatggagctttatgaaactctatatggagtatggctgctatataaacctagctgaaaagtcattttgtaaatgaaaccaaactcaatataggcgnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacatataatgtgaattttggaattgctcagtgttcatatttcttaacattacaagttgtaatacacgtgttactaaaataaattctcttttgttctttggtgtctttggtttgtaggacttgaaaatagagtactagcagcaagctgtgtcctaaagcttgcttttgccaaaagggatgagccggcgttgtcatcaagtgttggtatttcttgttaacgttggatcactcgaagtcattcaattacatttagtatttggatatatatatatgcgtgggaaatcattgtgtgtttttggagaaatgtaaaagctacttgattcaagatattcttttactttctgcaattattttgacattattgtctatactataaatagagaaaagtgttgtccatcaggacactaaatttctaaacaatgtctgatttttggcgtttattttatttagaagaatttttaaacaaaatatattaggtaatcagaaaacaaagaatatttttctttttcaaaaaggaggtgtcaaactccaccgaatagttcaacaaaaaaaaaaaaatcctccgaattgtgagtgtctcgcatgtgcaatggcaatgcaaactgtaagctttgtcataaactcttagctttccgcaaacaaagcttcaaatgtttcagacttaaaggcttacgtagccactgacgtaaaagtaacggcaaaaagtgtgatccaagcattgaaccggttcattgaataagttgagatactcggttaataagtcatctattgaattggagttttacttataaaattgatatatattaaaaatattaaaaaataaataacaatttaatcatttaatactctaaatttaaaataaatgttattataaaatacttaatatctcaaataataattaatatttatgtcaatacaagtacataaataagtaacaaacaaaaaaagtattcaaatatcttaaaaataatcatatgttcacaaaaaataacataaaaaagttcatattttttattttgaaaaaagtacctgattcaataaaaaatctacttcacttcaataaaaaatccatcctaattcaaccaaagacacacttgatccaacctgatcacatcaattatgatatattttttatcctcttaacaatacaaaccggtgtgcctattgggttccaacctatccgattattaaaacaatgataaggagcataggaaggagaaagaaatgaaggtagtttgagagggggaaaatcaaagaaaaagggagtgcaaatagcaacagcaaaaaaaaatgtgttatttataacaataatttacacaataacattgcttgtttcaatattttaaatcttatatattttttctcttttcgttttctcttaatagtaaaaattattgtaccaataaagattcctcttaaaagaaatgattttctaacttttttttatgaacaaaagaaaaatctttgcattttaaatatttaaatatgaattaaaaagtaatcaatctacaattgtggtttcaactttaactcaaattttgttaagtccaaaactcaaaaagatcttcctaacaattttggaagactaagaaaaagctaaaagaacttaaattatttactactaaaaataataatcagataatggctagtatggtcctttacaatttaatgacgttatttataattgggttatttaaaatttagatcgaattagaataaactatatatctcattgtccagaagcttctctcgctatgcaaaggtaagatggaagaatattgtacacagtcttatccttgcatatgcaaaaaagctatttccaaatacgagaacccacgatcaacaagtcatcaaagcacaactttagcactgtgccaggactctttaaaaattacgtatctcattgtctaaagactcattgctatgcaaaggtaatgaggaagaatattatacgcaaccttatccttatatatgtaaaaagactatttctagattcaaactcatgaccaacaagttatcaaagcataactttaaaataaaccaaaataaaatcaaactacaatttcaaactgaacccatattttttggctggctaaatggatcaacctatcaaactcaacccattttcacaactcaattagggagtttagttacatgtcacttatctattgtacccataagttgattatttcttctcattttagatatataggggtttgctcagctcatgcagttgaatttgtggggtattcttaaaagtcaggaaattgctgagatttagattctggaatattattgtggacagtgactgctgaatagctacacttagctcagttgtcttcctttttgaagaacaaaagcataagttctagagaataaataaaagacttaccataatgtaacaaataacaacacataatgatgcgaacagagtagatggcatggcgaatctagagaactttgttctagccctaacaaaatcatatatcttatctcaaattaatcactgaagttatacaaatgagtcctctaactcctatatatttatttatacagctacctatcacatatatcatggacttaaattatgatgatatatggaatattggaacatagtttccagcggttcatgtataaggaataccattcttcatgtgctattttttttaaaggaaaattaaaggtacatgcaatccatatgtctttatatggttaatacaagactctaccacaacgatcacatgcactagaggcaactggagcagcatcttttggctttgtcttctgcaactttggtagatcaatttccagaacatcagccagggccttggaaccttgttggatctcatccagactgcaaacattactttaggtcacatcctagaacaacataccagagaagagaaacttgcaatggacaaagacactagggagcctttgggatctagtactcccttcaatcttgaatataagcacacaaaaaaaaaacttacttatgcttattaaaaatgttagttagcatcatttaattgtatcattctcattttaaaaatatttttttccctaaaatagccttccttggaactttataaaaaatgaaagagaaacattggaaataacctcaattaaatgaacgatatttgaggaatgatctcattaaataagataaaattacttgaaatttgtttatatttgagaccaacacccaagacatttttttgcttctatttgagactagagggtgtatctaccattcccagtaatctatctttgcttccaaactccaaggatcataattaatctacataaacacaactagagtaatgaatatatgcttgtgttagtttaggtagtaaagaaagacatatcttataaaagaatgagcatatatttcagccttaaagtttccacattagtttatgactttatgatgatcaataggccaatttgatactgacacaacacacacatactctcacttgttttttaaaaggaataagttcataagttataaattgagataagtttgagtactcccaaaggtgtagcttgttaagatattcctcaaagttataaaaccttagctttcactagcttgaaatttgaaaatcttccaagttattctccttcaagccttctaggatctatcaatgatacaactttcaggtgtcaattgagaaaggtatatgaaggttaatttatcagaaagagaggaagaggtaggtcattgtaatacatagatttaaacagcattttttttcaacaaacaatgaatgatcaagaaaccaggaaacttgtaacattgatgattgaagaaaatcacaaaaacttggttctgcttgataaaaatttgaaaatattaagtactaatgattggctgcggtgagacaaagctatacttcaactgtttaacaaatttaaaatgtagtcccatattcccatgcctgaatcaacagaaaataactaataatgtgtacaacacagacactcctcaattcaaccattctattaatctgattttttctttacttgtcagcagattttttttttctatttatgttttatcgtgtatgtcttttggttatttattgatcatagtttggcttcagtaaaatctggactacacagtaatccagttttcatttccaataattattctaatatcaactaataatttccaagaggcagaactttaacataatgtaatgataacttgatataaagacattgcttcttgttttcgtaacttaccttatgcaaagtgggggagtaaagcggataattgtatcatgtgttggcttggcaaggactcctctatacttcaattttttgcatagctcatagcccgatacaggcaacaaattttttctgttaaactccactccaatgaacaatcctcttccccgtacctccttcatgtagtctgggtattgctgctgaatcttaagcagctgaccagcaagctcctctcccatttgggcagatctgttcaatagtaatacatcatttgcagattttatatattaatatctcagagaaaaattcacagtagaaaaaataaatgaaccaaattaataaagcatttactgaaacatggaaatttaaagtttgaaaggattcaagtcaacaaaagctagaaaaacactcaatgctagtaaaaagcaaaataaaaaaatttagaacataaattgatgaacataagctctgtaactcaagttctgaggggggggactgagtagaaagttaaagggcttagaaagaattattaattccctacatttaaactttgttagcaaataagtacctcaggatctccaaaacttgtattatttagtaacttcaaggaacatcaatcttttttgcacgccgacgcagttgttttgtaaacatggtcggaaacttgtaaatggggcaaaattagaaaatacaaataaatgatcaagccaagtctaaagagttgtggttactttttcgggaagggtgaggaataggatctgaaacaaaaataggtactgttggaagtgcaaatattcaagatatatgatgaatagaagtccttaacacaggacatcctaaaaaaatnaaaaaaaaaaaaaaaaaagatacacaacaggatttgatctaagttactgagatttatttgtaaaattctctgaaaagcacaagaagcatggagataagttctcaatcatcaataaacaaatttatcccaatataagaataacattatatttaatacattcaactcccagaacccaggccttagttttgaagcttttatttcacatgctgatgatgcttgatgaaatgaataaaatatacttgtcgagacttgtatttaactattcaagtctgtattataataagtatgtattggcaatataagatttggcaatgcatttgatacctctcaacgagtctttcattttttatcacttctagtgaggcaattgcaactgcactggccagtggatttccaccgaaggtactgtgaacaataacagagaagaagaaagcttcagcattattagtcttagctttcatactttaatatcattgaattgtattgtactaaatgaaattattagctaattacataaacaagaaatgaatgcaaaactaaaagcaaaatttcaagagtacacaaaggatggaatttttttataaaaaaaatagcaattgaaagttcttaaacgaagaactcattttaataagaaaactgagggctgttgaataggttcatcaacctgtagaccttccatcaaataggaaatgattataccatcctagaaagatcaaatattttctttaagtgcattgaaataaaaatagccaactatttaatgtgctggtgatgctacagttcctgtcctgaacgtaggtgtttacatccatgatgactttgcagtggaacataataagaatcctaccacaataataatcccaatattctaatactatttatctttattttcagatacttcctaccattagaacttataagcacagataagtacaatatgaatgaccaagccagtgtttgtaagaatcatcagctacaaactccaaagaatcacttacgggaatttacggtgcagtaaataatctcatctcagtcaattgtttctcctttggaaatataaatggttctgttcacagatagcttttgcaaatggagtagtctaattttgtcccatgatcctatcaacttgaacagaactaacatccctaacccaaaataaaataaaggcttaaatgcagttttggtccccctattttgctcaatccacaattttggttattccattttaaaatagagacatttggtccctatgttttaaaaatccgcaattttagtcccaatatttcaaaataaagacatttagtccttttattttagaaaattcacaattttgatcctcatatcttttttaaaaaaatagcaattttggtacaacttcaattttatctacattttttttcgtttatttcttacattataattaattaaatcattttatgatgataccttgaatgaatgttaggtctaggattcaattgtatcaaaataaaaaaataaaaacgtaggcaaaattgagaatttgacaaaaataaaaaaatttataaaataggaagtccaaatgtctttattttgaataggggactaaaattgcaattttttttaaaacagagggaccaaatatctctattttaaaacagagggaccaaaactgcatttaagcctaaaacaaactatatactataagattccaggttccaacagaagggagaattctgtctcttcacatgatctgacaaataaagggatttaaggatgaaaacagatgtccatcataatccagaagtttgacaactataggcaagaaaatgctaaacaaaaggagcagattaaaataaattataaatttataataaaatgaaaccttccatgctgtccaggttgtatacaaagcatcacatctttgtctgcaagaactgcactaactggtataactcctccacccagtgctttccctagtatctgagagaaaagacagttaaaacagttatgcatggtggtatcgaaaggagatagaaccttaaaaaaaggggtgtgtgtgtggggggggggggagtttgcacgttgcagcagaggcagtaaatttctcattttcttgaaagaaaacacaaagttgggtggccaagtctttcaagtggaaggtagtcgtatgcatctaaatccctgcatacttggcaagtgcaatggcaatttctatgattcaggcatgttcataaaatatatatttataggaatggagggagaaactatatcgattttgactaaaagtatatatccaaaagattttctgtcataaagcaattttttttattaaaagcattgagaaactaatccaaacatggtattatctgatttatcagtcaaacacaaaaaacataagcattccaaagaatgacatcatatgcttaaaagaagtatggtatctatggaatcaactacacatgcttttttcttgccaaatagtttcggtttcaactctaaaatattgtttggtatatcaacgagttttgcattgactgccgagggcctaacacaacctcctcctttactcggacttggaaccatatatgaaaccataggtggagttcctggatctaaattattgaagggcaacaatgatcacaacagttacctatagattttgttaaccctatgacgacaggtaatgtttatatgaatctagagatataaagtactcaagaagtaaaggtggtttctaaccacaacatctgggcgaacttcttcccactcacaagccagcatcttccctgttcttgctaacccagtttgaatttcatcagcaatcatcaagacgttatatttggagcaaatatctctaacagcttttaaataaccatctggaggaaatatcacctttaaacaaaaaatattatatattaaaagaatgtagagaagattatatactttgagaagaaaaaacataataaaaaatgtctacagaatgttatagccatcctgcaggatgagtgatatacaagggtaccataaagtttttcttttaaaaaaaaaaattcaaagaatttagaaaaagcaatacaaagtacatattgttcataacattttacaccatatagaataaaaccagttggcagattaataaaatgaagaaaaaaaacttaattgcactttttacccccaaagtttcataatgtcttgaattttgccctccagtttttttttccaggaattttgcccccacatagaataagcaccagaattgatgaaaaaattaccacaaattgtcttaattgtggcagtttaaaggaaaaaccggcccaaaatgtcttaattgtggcgatttttctacgtggggggtaaaattcacgatgttttgtaaattgaggcggcaaaattcgtgagaaaaaaaaattgaggggcaaaattcacgacatttgaaactttgggggcagaaaatgcaattaagccaaaaaaaatcattagattagattagaagaaaaagaaaaggcatttaaatatggattagcaaaaagaaagcaaaaacacccaaaacatataaaaaatgtcaagttcacttgacttttataagccaccaagaacaagtaactatgtttcatcgaggctatcatagttcatacataatattttacattcttattaggaaactaatacattgttgcacgaacgaaacaaaacatacaatgacaggaacgcagaatgtcaaaaacagctcacttcacaagtccaacgaatataaaaaaagtaaaaaaaaaactatgtaccccattgtccggaggctccacgctatgcgcaggtaagggggaggaatattgtacgtaaccttacccttacatatgcaaaaaggttgtttccggattcgaacccatgaccaacaagtcatcaagacacaactttaccgccgtgtcaggcatgttctatgtggtattgcaagcaatagaacgtctaaacattggtagattatcttaaaaacatgacttcattgaaaatagaatttgtggtgtgcttctaattcattatccatgtaaatgaaaatgtcaaaattgctgtagaaattttccattctagacatgcattatgtattttactaaaactaaaacatgcaacatggaaaaaattctaactgaaaacatacatcatcagtttttttgtgtaactactaacatcagtaaacagattagagaaagagaaagagagggctatatagcagcttccttatcatctcaattcaatcaacacaaggttggcaagcccataaatatgcacttccataaaacttaccccagcttcaccttggataggttctaaaataaatgcagctatgtgttctcctttttctgcagttcatagagaaaattcaaatagtgaactccaaagatctgtcatgataaagcaaaccactgaagtaaaaagtatatggcggcacagtgcagaacctttaaaaattctttcaagggcttctgcatcaccaaaatcaactttaagattgccaggcaataaaggaccaaaaccacgggtagcttcgttgtcacagctcaaagatatgacacctagtgtacgaccatggaagcagccacaacatgagacaataatagcctggaacaagtgtccatgagtaaaaagattcatagaaaaaatacctgaactgattctcataaaaattaaaaagaacaatccaaatagaatagcaacaaaggacagatgcttgtgctcaaataaagaaaaataactttcaggttgtaaaattgaatggtaaattactgacattatgaacagacaacaaaagtagaaaaatatataaataaatataaactgttaaacttcctacatcatataaaacagaaaagaggatgatataacaaattttctacattttctctttgtaatggaagaataccatatgtttaaccataaagaattatacatctcagatgcatcttgtttgcaaaatcttccataagcatatgtcacttgatgcctcagtcatacttaaaatttattccttcaagtgttgtcaaagttcacatcaacagatgcctaagtattccgcagataaaaaaataatagataattagatttgtcaagtattctggtttcagtttaatgtatccttaattgtattttccatattaatggtcaaagctttgtgaattggacccctctgtatctattttaagctacacaacattaaacatggactcaaatggtaaacatatttgaaaacgtctaaactgctatagtacacagaacatgtgaattataagtttttgaaaacaagttaacattataaaaaattgcgattaaatcactaccaatgcccatattaagcaaagatttagttggacccaacattttgcaaaattgtaacatatcatgatattacaactattagcatgcatcattctcatacttatacctcatctttgggaattcttttcttttcataaccccactttcgtgctaatttcagtgctgtttccacaccttcagcaccagtattcataggaagtaccatatcataaccaaacatgtttgtcacatactcagcaaagactggaaagcgatcattgtagaaggctcgagagctcacagtcagcctttctgcttgttcttgtaaagctttgagaattttaggatggcagtgtccctacagcaaaatgaaaagcacttagattattagaagttcgatgccatttgttttcctaaaaatcaaggaataataaaaggaaaagtagtagcaacagtagaagggatctggccacattaataacctcacaccacaaaggaaacaaaaaaaaaaaaaaaatgtatataagcattattattcattagggcaccattctgaagaaaaaatgcagatctagagcattgggaattaccaagatacagtcaattttacctgattaacagcagagtaaccagatagaaaatcaagatatttgtttccctctggatcccaaacagaggttccctttgcttgagaaaatacaatcggaaggggatggtaactgcatttgagacaggaaagatcacttcaatatttgaccaaaagcaattaattaacctcattaacaattaacaatcaatacaaaagaaaagtgtgaaaagaaaagccacctaaacaagtaaccaaaagaaagctatgttcaataccaaccagataagctgacagccaaaaaaaaaaaaagcaaatccccacaatccttttatttgtaaaaatgctcagaagagacaccaactgtgaatatttactattgagagtgttttaaggaagcttcaggcataaagaaactggcaaagtgttgctggtattttttttatgctcaggtgatgaagaaacagaataaacatgattgcattaaagtacagtttttggaaggcactttcagcttactactcatgattagttttaagttttctttttaattatacaattcaaatattccaatgaatgattcaaaaacttatatcattcattcaactcaccaaagtttaacccgatccaagtgggacaacaacatcatcagatttaaacatgaaaagttagagtcgagaaaaaataagacaaacccatacatcaaaatcttgtctttggggcgtagcaacatatggcctaggttgagagaaggaaagaaggagaaacgtacttgtgggcactatgttcatattccttgtcgatgattttctgagaagaagatgaagaagaagcattaacttctgtggcaaccccaaaacttctacttcccctgcaaacccttcgtaacaaacactgcaccggtctcgtggcagccattgatgagagacaaaggttcctcagatttttcaggattcaagcgaatgtaagatgaaatgaaagtagcatgttttaataattgtcaccctctctgaaatttttttgtcaaccaacatgttttactatattaaatatcaaattaaatataatatttaaacatcaaactaaatatccatgatagtatttattttaaatttttatggattactatcctcttttaattaattcacatctttcaaaaaatactaattaatttaattaataatattaaatataatagtaaaacttattatctttctattcactttctacttaaattaatcaatgtgtattaattttattcttcaatttttataagagagaatacattattttttaatttataactttttattataaagtaattaaaaatattttgacaaaaaaataattaatacaaaaagataacataaaaaatattatatttaaggaaaaataaaacaaaaaaattatatttgggaacaaagtagtataaatttaaaagaaagaaaagtaataagataggattaatgttctaacagaatttaattaaaatatattcacaaaataaaagtattttacactattatttacttattttataaatatcgttaatttagttttattaataataatctgaaaaactatattaacaaaattttcttattacttaaccgtataatatatttttttgtaacgacagtgcatactgcatagtcatgaaatactaaaaattataataaagaattttatttttttttgcaatataaagtattttccattttagaaaaagtgagatgagggagggaagattatgatgcgtcagctgtgggtgtcgttttcgccaactttcaaagcttatcagacggcctcgaattcccacatgtaagtgcgtgtttgtgtttgttcgatcaaaagtaacaaatggttacttctcacaaaatgacagtttttaaaatttctgccaactgaacttaatgaaaatacaaacacataatatgttactactatttggatcatgtctggatctttgttcccacttccatactccaattggaatattggatttgtttcatcaacggctcatcgatataaatacacagccaacaaataccacgatacactgtcgatcgattcactttgtagtatcttttttatcatattaatgttgtaaaaaaatgaatttgaaagcataaaaaaaaaatctattttcatttgataatttaaaatgctgtaagaaatttataattattcactctttggatcattaatcgtaacctttgacaattgttagtcatcattatcattattacgtagaaaacccactcttgatattttttaaatttatattatcattctatcgctttcatttttttatcgcatagttccatctccacggccatcaggttgcgtacacgtataaaatcatacacctgacagcctacttcaaattgctttctaagttggatttacactttcccgaactacattacaaggatatcaggatatgcattataaataacgaaaattttgcattgcttattatgaattttaatttttaataacatttacaaacattttaaaaatgtttaatacattccaaaatataaaaaaaggagaaatattgactctacttaaaatttaattccattgacgccatcaataaaataatattattacattcacataaaattatcttgataatgattaaaacttaagaacaaaagtcagacatcgctatgtcgttatttacatgtttaaacacgaatcgcttcggagagtagaggagacggtattccacaaattcacaattttatatttctccatcataatgagtaataacagccataaagtgttcacgaccattcaaactataacataatctcgtggtcttgtggaaataaataaacctcgatttatatatatatataaaaaaatcaatctttcaacaagttataatggcctcctcaaagaaaaaaaacaagttctaatggcacaattgctagtgaaaaataatgaataaacagggtaacgaatgagaatagtgaactggaaactagtacccacaccaaatcaaagatttaactatcacactacaatacattgcttgcttaccaatacgaagccgcgtacaacttataataattaatatgattgtcatttttaaagattttaatttgatttttcgttaattgaaagtcaatatcacaaattatgtaaaagattgatgcttatataaaaaaataatttgtgagaagccatcgaattgattagctcaaatcaaggttaaccatttgcccaaaaaaaatatatgcaaaatcaaagaaattgcagcgccaaacatatactaattagatgaagttcaattaaatgtaaatacatacgcaaaaaacatcaaagcaactgtcttgaagctaagctgtatatacaatggaccatcatcttaaactacttaatgtgcaccataaatcatatacaaagtgatactctaatattaacttcccctacgttcagccccccaatgaaccatactcaaactaaacctccagcataaaatgtctcagtgcagaacattatcaacctatcaaattatatccattaaaaatcaacggcctaatgactaaactcaaactaaaccagacatctttacttaagagaattctagcagaaaagctaagggggaaaagaatgaacagtattccgtacaggatcaagaatgagggtttgaaaatttcggaaatctgagctagctatagaacaaagggagaattgatccacatgcatagtattatattgtattttaagattcaaaagtattataacgaacataattgtgctgagttcattgtggagagagttcaatagatggctaatgaaaaataaagaaaatttgtactttaaatttgctaggaaaagcgtaagtttgacattatcccagagaagtatcaagttaatagcattgcatataatagatagatcataatggctaatggaataaagaggtccgtcacatttcaaaaaagggaaaaggagttttgagcacactgatgttgcaactagtaatctggatgagagaaatgtttcacaagatggcagtatggatacaagggaaatgtttctggaataagatggatgatttaatctagttgcatcctataatttagtcatataaaaaaccccaagctattgcccacaaatttaattataacttgagttgggtgaaatcaccattagagcagaggatgttatccatgtcacggtaactataatccaaatttagttggaatactaaatattatgctataaacaggaaaacaaataagccagaaatggatcaaccggatcattttataaattcaacagcccccttcatagaatttaggagatcgagttaaacaattctgaatcatattggaagagaaggcttgctacattaaaatgtgacagctagcaaacataagatgtggctcagatgacaaactgagctccgtgtgaacaaactttacctccagtgcagaggttcaaattccactggagatatttagcaaatattttcttgtgattgacatccatcacaagtcataagaaatggaaagcatgtacaagttccgaaataaaatccagaggcttttcagataatatgcatgagttgtgctacacaaccaaaaaattgttagaattctcacattctgttggatcaagacggtaataggagaccattcaaccatccaagagtcaactcacgattcttttctttgttcttaaatgtcttatgttttcgttatatgccaaggaagaagaagctgtatcttcctactttgtatttatcttctgtcttaatattttaaccacaaaaaatatggcttctagcatttttgtacatcatgtttggtgtgacaacaagatggttatatgatatctagctgtaaatgtcctcatgcatgacagaattacaagatatggaaatagaattagggcgatgaaaatgatccagggttttccgaaatcctttgaattcatgaggcaacttccccacttttgaataaattacttggataaccaaggatacgagaaagcacagattgctagaggcccagcatctcattttgcatcaatagggaagatattttcagcaagaaaggagaataagagtgagccgtcagaaacataacaaacaccgttttatggttccacagaataatttatggagatagtgatgactacacactaatcaaagacaagcatcatgaaaggacagagagatcctagatttctaagataaaacccagatgagaatagattaagaggaaacaaaaggaaaggaattataattcctacatacaaaaccagcaatggatcctcaggcacggtcctgtagccactggtgtggaagaagcaggattcaacctgtaaaaccctagagaacattgtctctccaggaccaacctaacagaataaggagaggaacaagaacatgcttcaagaattaaacttttcaccttcaataccccaggaaagaatttcaataattcaggttgccattataaaagcctggatcaaattttcagcagcacgcttttgttcaggtgtccctgatataaaagcaatacgatcaccacgagcagatttgttgtcagatatctcaattgatgctcctgaaatctggtttgaaacaaggcattaaataggcacatcaaatgaagcaaagtttgtattagttttacctatatgcattggggtatgggagaataaacaaattatcatgggtatgggagaataaacaaattatcataaaccaaagttgaatacagtttattatgctaactaatctagcccctgacattgtatagaacattgtatactcgagaataaagtagcataagcaaaggaaaatatttcataaaatagtttgcatagaaggatctcattagatgtcatcttgtaaaatgataccatggcctagcaaatgtgaaaaaatggaaaaaggttgccgatcaaagactagggacacccttaaccttttgtttcctaattagttacacatcactaattgttttagtccaagacaaatcacttgatatgattaaaaaaattggatgtccattatctcctacaaataactggactaaatggaaccagtgcaagtgagcaatcaataaaatcactcaccaccaagaataaatttaaaaaaaaaaaacataaatatatatatatatatatatataaaatacaacctagccctatcctactgggtgagttggttagatggatcaatcaacaacaaaatattcagcaaaaccatttagagcctttccttttgattggatatcttctaattgatccactttactcactgaaatgcacgatatggaatttttaagaaaagcaattattttaagcatacagtgaagagacatacagcagcaagaaccaaacctcaaattagtttttaagataaataaaaaataatagataaatgtcccatcaaatattagttccccctgcaattacataaaagaataaacaattcagaatgtgtgaactaaccttcctgatattggctatatttgcccctcctttacccagcactttaccaacagcattagcaggaatcaacatatccagagttgatgggggaggcaaactgtgtacaataagagaaaaaaaaatacaagttcaaccaatttaatacaaagtttaggaaagttaaatcggagattaagtgcatgattgattacgcccaaatccacgattagactttagagggtaaaattgtacaaatacaaatacaaaccacaattaggaaaattttcatcctcaattcgacgtgttaggcaaaagtccagttggggatggcaaatggaatctcattctcaaaccatggtttgggtgaaagtgagagtttctttcataggattgggaatgcacataatcaaaatattacttttaagataaaggcatccaaatataaatcactcaactgcatacccagttttacaaaagtcgggttcatccaaaatgagtttagcaaattccaatccaaacaaacactaaatcatcagctataaaagtgttcacatcatatataaatgtatgtatactaacctgccatacagcttggtggcatacgaggtcatagatccatagccattttcctccatctattacataggatcaaacaaagagagaaaagattagtgacacaatatttgaaactaaaaatggaaaagacatgaaaagaaagagactgaaaactgttcattagcattctgtattagaaaaatagaaaaatatatcataatatacctgcaaaaaattatcaatattcttatgaccatacagcaagaaaaaatgtgacataccgataaagatccatatccaccataaagactgcttgaagaaagcatgcccaggccagctccactttcagccctatgatcataaaccatcggagcagtaacaggaggaactgaatgcatcatagatggcaatgaaagaccagcactgcctgggtacaaggattcagcacctatcaaaggattatggccagtatccctttctctcagtacatcatctctaagtcttaagataatctggattagtgcatcgctcacacaatcaactgagccacccacctaaatcccaaaaaacattgaatgaaataaatatgaaagttggtaaggggtatcaccgttgtgaatgggttttcatgcatgaaacatgaatgaatatttttaaaagaaaataattgtcagttaccatttacttttcaattttgctgtttacctattaaatcatgattggttgctttttaaagaatcacaactttcctataaaagctttcattctaaatagaattgctgaataaatatactgtttaaacaaggagagaaaatgagtcaaacctcaacaagttcatcattagcatctgcacattttggcttatcacctttagatattcgaacatcagccttagttctcttccgaatttcatttatgattgaaccacttttaccaataatacaacctatcaccttggatggaactagaagccggattgaaacagtggtatcgtcttcatcatttatcttcccttgcatcagcagaacagcttcaactgccattgacttcagatcacttggtgactaaaaaagacatatccacatgatcattatccattttatgataaaataagactacaagtatagaatcaatatgttttggaaaaggatagttacattatatgaaaaaaaaatagagaatatgggaacaacaatccacaagtaaatcaaacataaaactgaacttgctgtacattaaccatattagccttgggggggaattacttcagaacataaaagttgtgacaaaactgtatacttaattgccacctcacagaatgctcaataactattcacatgcctgaagttattgtattttagctttaaaggcacatgtaaaaatatgatctgccaatattttttgaaaaacaccctttgtttccttttccttgtttctttccggaatgctgttaacaagtataagtgttgacttcctaaatgaatatcaatcctcattattgtaagggatggcactgcaaagcacaaggtagttgactattaacaactatagatctaacctgttttaatggatgatatgcatgaaatttattacagcgaaataatagagggctatgtccatgaaaataaatttgacagtattcagcaaactagtaaatagcaacctggccaagacagattggagataaacttgatgtaaaaacgttaaaatgaaatgaaatttattgtacataattctgactataatttgtagagaaaacacaaagaaactagggatcaaacattttgaacttttaaaatgcaaaagcatatacacaaagcttaacacaaatcactcaaggtcctgaaaatcaagaatcaatcaactcatgacttcataatcaagttttaaattatttttctgttttctgattattgcatataattttgagaaatataactacaaaaataagtcaaaaaaatcattggtaaatagtaagggtcaaagctttcccagttgaacagcaacacacatatagctttgattatttttctctcaaattttttcagcccaaggcactctagcattttgattatatactgtccagaaacaaaatatctaagctaaacaaacacacactagggtacatcatgaactccatcaaatgcaacaccgccaacaattattggatgagcaattttatgttataagaaaaaaaatgtaacaaggaaagatagtgcacctctgttgtagttataatgattaaacactcatcataattagccttggaatcatcaacctcaatacgagcaccacttgcctgcctcatacttttaattgtactaccacctttgccaatgacacgcccaatcttgtcagagggacacaacattctaacaattaactcctcagaccgggaagcaccaacaccagaaacaactggaagggcagatgagtacagaggccatgaatttcctgcatcagcataaccttgcagatctggtacatttgttgtgcctataatttgaggaactgctctagatgtgacaataggatctgaagctggatatagtccaccaggaggataaattggaacatcagagggaataataatactgggtagggcttctggtacagctgtgtcaagagagatgtcctccctgggaccgaacttatacataatagatgaaactgcaaatagtgctcttttaactgcttctgattcaccagtgatctactcatagaaaaagcaacaacatagtaaggaataagtttactgcaaaagaacttatcttgacatgaaaaaaaaatgattaaaaatatgacaaaagatatagaaatttcagatttttctaaaaactaaatgcaaaaggacaaacaagtacgatactgttaaatgttaaataaaaattatcaagttcaatgtgtacaattagaaagacaaactgtaaaaagacttctacgccaatacatagtacgatactaatacattattagtaaaataaagtattaatattggcatgtgtcagagggtggaggattagatgctactattctaatcagagaaatgattacgaaccaaagcaataaatcattcaatgctgagttttataatactcaatatactaaccaagacaaaattatcaaactccatagcacatgtgtgtgttggatcagctgcatccttggcagtaaccttgatatttgctcttgtcttacttctcagctttttaatggtagccccagccttaccaatgatatttgcagactggctagatggaacaaggatttgacattcatctctatcctttcgtttcttctcagaatctccaagagctgctatggaattcacaatggcaacgtgaacctttagaagagcaccttgggcagcacacagaggttctttaccagcgaactcatcatcaatctcaacatcttccttctccttaacatagctgtagattgttataacccgatccttggcaccgggaaaaggatcgacaaccttgactttagccctggtttcttgccttattgaatttatcactttcccattcttcccaataacactcccaataacttcatctggacagagtatcctataaacaatcaattcatcattgcccctgtcatctctgtcagtcattcgtctcttttgatttttcctgtccccatcatggtctctctgtgaatgatatcgttttccagtctcccccattttacaaaatatcacccaactcctgaaaagcaaaacacaattttagttacataaccagtgcaaatatatacttctatttgttagtctctgaccatcctccctcccttattccccttctcataaagaaataagttaaattaaagcaataaatatcacacctgcataagcccacttttaaatattcacaacgaaacattaatacagccaaattgaaagttgaaactgctttcaaattcgacagtatcttttatcacccaaagtgcgaccaacgagcacaaataattagtgcagcaaaatttggacaaaaaaaaaaatccacggaacatttagaacagagtaaaacggagttagaattattacaaaaaaaannnnnnnnnnnnnnnnnnnnnnnnnnnnnnnnnnnnnnnnnnnnnnnnnnnnnnnnnnaaaaaaaaattgtaacaaaattgtctcttaatcaatttaagccctaatttagttccaactaaaagaataaataaataaataaataaaaatcttgaaaacgctgcaactgaacactgctacataaggaaaggaatgcgggatatagggtggatgtgtcaaaccgaagattttgaacataccggttgttagagagaacaagagaccacacgaaacctaacgagagagaagaagaaggtgggtcaaggctgcgagcaatccaggattctcattctcggaaccctagttttaacgttttctcttcacaatgatttgtttcttttcttttgatttatttattttgaataaataaataaataaatattcagaaattaaaccggtaatatttttgtccaataattacggcaattaactttaaccagtctattagtgagataattatattttattttatataaaataaataataaaataataaatagtttaaatttaaaattatactgatattataattacatttttaattaattaaatatttttaaacatatgatatattttagatttatagtaataatacatattgtgatataagtttattttcttaaatcaaaatacttaataggatcggatatatttatacaaaacttctcagcacacgtaattaataaatgataatttaaagaaattgaatttcaattgagaaataaaaattaaaaagatatattaaaagnnnnnnnnnnttaataaaaaatttaggttataaaagatattgaatgttaaaaaaacagataaatttaaatattttaatctattaatctaacccaatctaaatcatttacaaataaattaatttggtttagtttttaatttttctcttagaaaactaatcaaaacgaattcatttaaatttaattagattgagttacatacttcactaagtctaacctaaattgatccacatattgataaaaattcttcaaattgatgaaaattcgtgcagtgtgattgatatattcttaagtacagctcataaataaatgttggatattttcttcatttcataataattattgtgtaagaagataaaatttatcttaaaataattattattttagttttctaatttaacagtaattattttttttatttatatatcttgtaatattaatgatattgattaaaaaaataaattgaaaaatgataagcttaattttgcaataaaactataaaattttaagaactgtgtgacatattaaaaagattaaataacgtgtaacgtctgtgtcttcacgaatacctagcccactctgtatttctttcccttactttcaagttccgagctttactttcagcttcaacactccaagccttaccaggtaatgttatagagtgtttcttcctgcaccattcgttatttctaatacaccattcataaacagtacatttccaaaattgtccttcgcttttttgcagtttttataaaggatccgtataattcatgcttacggattcgtcaatccgtaagattcttacggatccgtgaatccgtaagaatttacggattcgtgaatccataagaatcttacggattttccaatccgtaagttttttttttttgcatgtacggattgggcaatccgtaagcccaatccgtttggtttttttttatatacggattgggtaatccataagcccaatccgtttgttttttttttgaaaagttaaaatatattttagaaaataatggtgcaagcaagtatcgaacttgtgacctttaagttattaatacgatgctctaaccaattcagctaatagactaattatgtcaaaaactaattgatattgatatatatatatatatatcactaaatttatttaatttaaaataatttattatattaaaaaaatattgtattaaatatacattgaaataatttaaaataattcttaaacattttttaatgttttttatccttatttttgaagctaacaatttatttcatatcattaaataatttcatagatatgtaaattataatataaattttacatataatttatagatatgtctacatgcattaattcaacatgtaattttaacatataatgttattataaaatttaacataataaattaaactataaattaatagctcaattacaacatcaacatcaacaacatcaacagcacctttaacccaaattaattggagtcggtggtagatgaacccaatgataaatcgaaaataaagcaaaaattaatagctcaattacattaaaaaataattaatgttgctaatataacactaaaattttcaatgtatatttaatacaatatttttttaatataataaattattttaaattaaataaatttagtgatatatatatatatatatcaatatcaattaatttttcacataattagtctattagctcagttggttagagcatcgtattaataacttaaaggtcacaagttcgatacctacttgcatcattattttctaaaatataattttaacttttcaaaaaaaaataaacggattgggcttacggattgcccaatccgtatataaaaaaaccaaccggattgggcttacggattgcataatccgtatataaaaaacccaaacggattgggcttacggattgcccaatccgtacatgcaaaaaaaaaaacttacggattggcaaatccgtaagattcttacggataatcttatggattgacgaatccgtaagcatgaatcatacggatccgtgtataaaagctgcaaaaacacgaaggacaattttggaaatgcactgttcattaatggtgtagtagaaaaaacgaatggtgtaagaagaaacactcaatgttatatgatgttatctatcccaattcccaaatatcacattcttttcctttcggtgaaaacgctacaatccatagacaactaatattagtctatataactaaagataattatttcttttatttattgtacacattttatcgaataattttactcttaaaaattactttttaaattttaaatttttcttcaaatttacattaattttcactattttatattattaatttgtattctattatttttattaattatatttaacttctattttttattatttaaaaagtttagagacacacttcccctaatatttataattgcagaaccggccttgaaatcatgcattctcttctgccttgcggttgtcgttcactgtaacttctcgttcggtgagtgctatgatcatcacatcacaccacgtgtgcgcatttaatcaattttgacctacactgggtcctggaatgttgtctatacccttcacttttgaacattagaaaggataaacatcatgtataaaaaaggttgaacaaaagaatgcgtatacctatattacatatgaaaaggttaaacaccaatatgcaaaaaagtttaaaaatcataaaattagtacctaggacgggtcgagaaactaaacccctgatggaggtggatcgaaaaggttgagtcttgaggataattaataaacatcacagacaaaaattggcgtggagagctcaagcaaaggtttgaaatacaatctgtaaaacatgttccaatagttagaaagcttctccaagatagcactgaaaataaaccaaagaaaggggaaaaaaaacataattataagattaaccattgtagtcacttgtcaagagagaataaaacctaccaggtatctttagaagagtgatattgtagtagcaataaacaagaccatggatattgaaatccagaagttctagaacattaaagtacacaatctactgaatctagtgttgagcttctggaggaaaagtgaaaatcaaaataagaacaaaaggtttgaacattcagtataaaaaatcctacatttcctctgccaaatctccaatacattcttattgagctagttttctgtctttgatgttttatttgaagcagcggcataatatccaaaaattattgttttttgatttgctgatcgatagcaactttggttgaagttattaattgggtgagtgtctttgacaagacttattttttaagaacacacaccaatatagatttttatttatatgcacttagctgtcattgattgttttttacaaaattttagcagtgcaagctgacttacatggctgaaaaggaaccagataccagtggaactctaggggaaagtcgtcccactccaccattaagtggacaattgaaacaactctagtggattcacctactgatgccaacactcaatcttcatttgaaggtattccatcttcacaaaaggtatgtaacaaaaggcagtgtagatatgaggatgaggattatgagcttatggaatccggattcaactaagaaaaatgtagatttgcgcctgcaaagatgattatcatggatgagttcagttaacaaaaggcaatgtagatatgaggatgaggattatgagcttgtggaatccgaattcaaccaagaaaaatgtagatttgcacagaatttattagtgtgcttgtgcctcaatttgaaatttccagttggatgaccattgctagagattgcatggagttgtacagggtggaaaaggctaaattggaatctactttatctcttaacaagcaaatggtatcattgactaccagtacttggacttcaatccataatttgaattatctgtgtgtgattgctcactatattgatgaaggttgggaattaaacaagaagattttgaattttggattgatttctgaccaccagggggacatcattggtaaagctttagagaaatgcttgaaagagtgggaaattaccaaaatttgcactattatagtagataatgctaatattgagaatttggctttatcatatttgactcgaaatatgagtgcttggaacggaaccaccttactgaatgaggagcacatgcactttaggtgttgtgcccatttattgaactcaattgtatctgatggattaaaagaaatgaattgttgcattgctaagacaaggtctgcatgtaagtatgttaagtcatcttcatctagattggcatgttttaagtggtgtgttgatgaggcaaatataacttgtgaccaaatgattgtgctttatgtgccaacatagtggaattcctcctatttaatgttgaaggttgctgaaaagtttgagaagacatttaatctcctcgaatctgaggatggttcttatgtgaattgtcttgattatgaaggacgaactccaaatgctgatgattggaatcgtgcactcgtatttaataaggtttttaattttttttatgaggcttcactttctttctctggttatttgaacgtaagttctaactctttcttgcggatgtgggtcaagattcaaaatgcattgagatcatggatggagagtgatgattctgggctgctacagatggcaactaatatgaaattcaaatttgacaagtatggtgatattgatgggaatattaataatttgttgtttgtggctattttcttgatcctcgattcaagtttaaatatcttgaattctgttttgggagaatgtatggtcctgaaaaatgcaaggacatgcttaaaaagttggaagatttcataaaaaaattgttcgcaaagtatagttcatcgcatcctattattcctgatatttgtgagtctagtggcctatcctttgatgttaccacccaaaaaattgtgagtaatggtgatggtggtattatggatatcaatgaggagtacgggataacagtgaagaaaatgctaagccacaaagcatctagtaatgactacattttaagctaaattttttgcaagaatgatatattcagtaaacattaggaagcaccgcttcagtgattttggttgccaaaatcgctaagccacagacgacaatggggactctatactttagtaatgactattcagagtaaagaagtttggcagaattctagatcattctggatgtaagaaaacctggtatttcaaagcatctagacttcttggaaatcccaaatatgtgccggagttggtgtactactatttgcttttgtcatcgtgctttatgaattttgtgaacaattatcgatatatatccacctatgctattaaatttgctctcacttctacaatatttgaatttattgataataattaagtactatgatgatgaatatactgtggatatattattaagttattgccattattaaagaatgtatttggaaaggtgtcaagagataaaatgaataattagattgaacaatttgagcttgataccaataaagagtgtgatgttttgaaagatgcttctaacctgagtgtagtgattggtgggtatgcaataagacatttatgaaaaaaactacaaagaacccaaacatatgcatcatgcatggggtgtgaattattgcaaaggcatcccattcgttgttacaagatgttctgcatgcaaaataaaataaaaattataaagtttgcactaaattagtcaaacaaggcttaatgtccactaatctcatgaggggtgatgggttgcaatgttctcaaatacggtgtgcgatgcgttagaaaacagcactttaagaattggttcaactatccgagagattgtaattaaatatttctatgatgtattacttgctttccttatgttgtcctttaaatttatttggccacaacatttcatgtttgatgatagtcaagccaaaaattaaaatgatcaacaatattggtcattttttaaaattgtcacaggaatgagcaaggttcattattttaggaataaaatgctgaatattattgatgcaacgaactagcagaaattacatcgtttgcaatgatttaatccacttggtaagggacctcctcaatccaacgtctatcaaaaataggtgaaagataggaaactaagcaatgtgttgcctggttcccttgtcttttggtaaaaacaagaacacttattcttgaattggggcaaagcttcctacagtcatctacaatgccatgaaatgaaacaaagactagctctggtcttctctctttttccattgttggaccagctgaaggcagtctgagcaaggttcattaaaagaaagagtgattttgagttctattttaaaagttaaaatattattattatgcatatattttattttcaatttaattattaacatgaattgaaaaaaaattgttaaaagaattatatatggacattaaaatttatattggtaattacatatttaaaattaattttaactaaaaatattcaaacactattctgtctgcaaaaattatttttctgatttactttgtctaaaagaaaacgcattgattgaaacttacttttgcaatgggttctttggtttggtggtttagttatttagcattgtcagcatcagtaaccgacaaagaaaaaccaagtggtcctctactctgttagtacgtgctacagaaacaggtgaaggacagtattatttttctgatacattatttataaacgctcacccaaattcaaaccaagtaaaataaatcttgtcactgtaagtttgtttgcacattattatgctttttcaagtttaaccaaaaaatattagttataattttcacgttttaagctacattaacgtgtttctttgctttctaatcatcagtattaaaactaaacatgcaaaaaatcaggatgagttaaaatcaaatatatccagggatatcctaacacgttaaacaacactgcaatcagcaattcttacttgtcacttctacggttctaccagcgatgaaaactacgcgaggttattcacagcaaagtctcctccctatttatagtttttaatttcttgattaaggatgagtttatttaaagttaaaaaataattttaagataagtattttttatataacaattatttttaaaaaatagatgggatttatttttaaaataaataaaattattttttaaaactaaaaaatttaaacaaacacactaaaaatatttaaaactacttattttattaaataaatatttattttaatatataaatttaaacaaacttactctaaacctggttattccagaacaaaaagcacatcgtaagcttcacgttctcgtatcattatatactcagtgaacagctgagacagtttccatttttaccataacttactgttttgcgagtgcatgtaatgtactcttataaatgtaatacaattaattgtcatacaaactacttttttaattaaaatttgaattaataatgataaaaaatattctttttaattgtaatcaaattaatttgattacttttatatgtggtaacttctaaagtaattaattcaattttaattagaaaagatcatttatatgatactgattaggttaaaaaaggtagtttgtatcttaattaatttaattttaatttaaaaggataatttatatcatcatttatttgattggttaaaaaaagtaacttatatctataattaatttcaatttatttcgtaaaagtttaacaaaatgtatttatattgtgtaagagtgggtgaaaataatatacaattggaaatatatttcggttatatactttaacacaacaaaattgtgtttatgttattattttaatataaatacatttttgttgtataagagaaaaaaaaattacacaatgaaaatgtgatttcatttaacaacatatataattgaatcatgtttttattgtatattttttcacaccccttcttatacaatataaacatgtttttgttgtgcattttgtcaataaaatcatgtttatgtgaaaatagtnnnnnnnnnnnnnnnnnnnnnnnnaataatatatatatatatatatatatatatatatatattctggattaaaatactatttttttacccaaaaaaaattagtgagaatgcatgcggatatatctacccctgcccatacaagttcaaaaattttaaattctgaaactcttgtagtatgtagagttctgtaatgcatttttttgtgtgtgcgtgtaatgtattttatattaagggtatggtagggcaaaattaattgaaagttaaaaattaattaaaaattaaaaattagttttattaagcatttaacaaaattaagggttaaagtagttgaaaagtgtaaaatgaaagaaaataataaaataataatgtatttaaaaaggataactaggaaattagataaatattttgaggataaaaatagaaaaaaaatataaaaagttaaaagttagatgttttaaaaaatgttattttaaggttatgttccataagacattttaattagtttttaactttttttatgagctaaaatccgtgtttgatgttaggtaaataattttttttaataatttctaatatttttttaaacctacttcgtttttaaatgttaacttctagtatgttatatttttttatttttattttcaatatatttattcaattttttattatattttttaaataaatcatgattttattattttattatcattttatattttttaactgctttaataacatgattttattattttattattattttatattttttaactgctttaataattaattttattggacatttataatttaatacgctttcaaatatcagttagttaattttttaattttcaactaattttatcaaatataatccaagtaacattttaaaatcattagaaatttaaaaaaaaaaaacttatttattaaannnnnnnnnntaaacatgtttttgttgtgcattttgtcaataaaatcatgtttatgtgaaaatagtattttcaaaaaataaaatctaaaccacgcttggaggtgcaaatagcaaatttagtagtgagaataacaatttcataagatgtttgaacattgtggacaacgtgtttgatgcaaatctagctgatttttttaacataactatataaaaaaatgctttcttgattagtttataagataaaaatactaactaatgaacagcataaaaaaacaatattattatttattttatcaaatttatccaaaagctccttactcatggacacatggttaagcagccaaagtccaaattattatataccatctcaaacaataattggtaaatgcttcacattgaccagagtaatattattcataatcacatgccctcacatgtcctcaccacaaaggcttggagattctcctattgtttaaccatctagttctagtaataatttctcacctaattacataacatgcatttctttttcagaccccaaaagaaaaggaagaaaaaaagaaggaaaagaaagtaagaaacccatgattgtttctattgatgtcacaaaccatgatgcacaaattcattaaactgtactgcaaataaatacaaacagacagctggccttctgcaccctccacacaacacaacaacaacattaacaacaacacatacactaattagtctctcactggtcactactttgcagcacactcttgagttttgactctccctacctcgcagtttcatggcttcttcagtgaccagatcagcctcaggcttcagcttctcagagatctggctcttggtggcagccacagcactcatctgtggctttctgggttacatagtttatgatgcaatcatggccactgcttctgagttgctgcaacgtttgctggtaatttctccactgttcttgatcatcattgttcactggctctccactggaagccaaataagcttccccatgccaggatctgagcctagtgccatccacagagctggtggttccccttggggtgttgcatttgttcttcttctgcttttccttctcatttcttaccaaccttccctgcatgaccttgtttcttagctagcatgtactatatagtttattaggctatgaaaatttagtgcatgtcacttatgtggggtgcttgttccttttttttttttttaccagctaattattagtttgttaatttttgttagaaagaaaatgcgaacgtaccacctttctttttttcttttcttcttaaccactccactaatcttgtatcttctataattttagagttactgtaactcataatgaacctgttaatttctatgtgaatctgggtgtaaaaactattgcagtgtctctctctgcctctaaaagagtcttgcttttcctttgtagcaaattttgtggctgcttatattaagtttcgagctttgctgccctatggcaggtgtttgtccttttctctgagaaaattgaaatgtcgcggtgtgtcaaacatcaaaattaccaaggaaattggactattatatatctttttattttggacttcatctgttggtgttcatatctaaatataaagtttaaaataatcaattatttctcagatgaataatccggacacactgtaagtctttctccggctttttttttcattcaaccaaaaatctcacattccatagactaaagtaattaagaacattttcacgaaattaaggatttaacttttataaagttaagtcatgaataatatatatatatatatattctggattaaaatactattttttttacccaaaaaaaattagtgagaatggatgcggatatatctacccctgcccatacaagttctaaaattttaaattctgaaactcttgtagtatgtagagttgtgtaatgcatttttttgtgtgtgcgtgtaatctattttatattaaggctatggtaggcaaaattaattgaaaagttaattgaaagttaaaaaattaattaaaaattaaaaattattttattaagtgtttgataaaattaagggttgaagtagttgaaaagtgtaaaacgaaaaaaataataaaataataatttatttaaaaaggataattaggaaattagataaatattttgaggataaaaataaaaaaaatataaaaagttaaaagttagaagttaaaagctaatattttaaaaaatgttattttaagattatgttccataagacatttcaattaatttttaactttttttatgagctaaaatccttgtttgatgttaggtacataaatttttttaataacttctaatgtttttttaaacctacttcaagtaatatttttttaaatgttaatttctaattttttatatttttttattttcaatacatttattcaattttcttattatattttttaaataaattataattttattattttattgtcattttatattttttaactacttcaataacatgattttattattttattgtcattttatattttttaactgcttcaataattaatttgactggacatttataagttaatacgctttcaaatatcagttagttaaattttttaattttcagctaattttatcaaatataatccaagtatcattttaaaatcattagaaacttttaaaaaaacttatttattaaataatcaaataaatttttaattagtaaaaaaaattaaaaactacctcaaattactttgtaacatggctaaataatggcgtgttaattgtccaacctaggcctacgcatttacgaaacaaattcaactgctaagctacgaattcttgaaagttttgaaagaaaaatccagagcattttatagaattttcccagtcaccaaatttgacaattgccacattaaaattgtcatgattcatgaatattgtcaaaatccaattccttattttccatagtatcgttatgaattttcctcaggatttttattcaaacactgtaatctttaaaattcatggaataaaaacaagtattctattgtataaaaaaaaatataaaatcattgaacaaattgcaagagatatcatgttagtcaaaattaacaccgttaggcattagcaataaaactgaccaaaatatcaatttgatctaactttatgggactataagagaccaaatcaaaacaaaaaattaaaataaaataaaaaacaaaaaatatattttaaaaatcctttattttatagtaatatatattattaataaagggaaaagttccttttaaaaaattaataaagaaaatacttaattacatttagtatacacaattcattaaacaatttttttgacagaaaaacaattttattcttaaaccatttttaaactttcattgttctcttttaaattatgataattgcctcatcattataatactattgtaagttttttcttccctgtcacccttattttttattaaactttttcctaagggtgttcaatggtatggatcacccgagaactcgaattgattcgaatagtttgcgttgaatcatttatgtatttggatcaaaatcaaatcgaaccgatcaaaatcattcatgtatgagttgagtcacgggtttagatttatagatttattgacccattgatctgatccgtgaacccgtaataaaaatataaattttattacatatatatgtattaaaattttaaaactaaaaaaatattttgacaataaaaaaaggtgtggtactgtaaatgnnnnnnnnnntaaaaaaaaaaaacttatttattaaacaatcaaataaatttttttaattagtaaaaaaaattaaaaactacctcaaattactttgtaacatagctaaataatagtgtgttaattgtccaacctaggcctaacgcatttacgaaacaaattcaactgctatgctacgaattcttgaaagttttgaaagaaaattccagagcattttatagaattttcccaagtcaccaaatttgacaattgccacattaaaattgtcatgattcatgaatattgtcaaaatcaaattccttattttccatagtatcggtatgaattttcctcaggatttttattcaaacactgtaatctttaaaattcatggaataaaaaccagtattctattgtaaaaaaaaaatcattgaacaaattgcaagagatatgatgttagtcaaaattaacaacgttaggcattagcaataaaactgaccaaaatatcaatttgatctaactttacgagactataagagaccaaatcaaaacaaaaaattaaaataaaataaaaaacaaaaaaatatattttaaaactcctttattttatagtaatatattcataattgttaatatatattattaataaagggaaagttccttataaaaaattaataaagaaaatacttaattagcacaattcattaaacaattttttttgacagaaaaacaattttattcttaaaccattttaaaactttcattattctcttttaaattatgataattgcctcatcattataatactattgtcagtttatttcttctttcacccttattttttattaaacttttctctaagggtgttcaatggtataggtcatccgagaacttgaatcgattagaataatttggattgagtcatttatgtatttaagtcaaaaccaaatcgaaccgatcaaaaccgttcatatacaggttgagtcacggatttagatttatagatctatttactcaataatccgatccgtgaacacgtaataaaaatataaattttattacatgtatatatatgtattaaaatttaaaaactaaaaaaatattttgataataaaaaaaggtgtgatactgtaaatgtctggaccgaataaagggtcaacttataatcatctcatctcatctttgttgtgaaggtgtagtactgtaaatgttacaggtttaggtttctttttcttttgcgtttttgtattctctctcatctcatttccttctctgcgtttcagccacttctgttctctctcatctcatctccttctctgtggttctgcatcaactccttatctgttctctctcatctcatcaaatcgatcaagtatcaggttttcttttgcgaagctttttaacttcttgtgattattctggtttgtattcattgggattttgatggaaacaaggataggaagaaaagaaataaccttcattgttgagtgttgaatcgaatttttgttgttgtatttgatttactgtttttttttcttgtttgctttataattaagctaatctttggtaaaatcttaagagagaaaaatgtgtttatttggattaaagattgagagaattagtttcagagtgaggaatagttagggcctgattttttttctcttattggttgatttattctttgagagtttgatttaaatgatgtttttttatttttattttattcttttaacattctttgaaagtttgatttgaatgatgtccttttttttttcttttgttcttttaacattaaggttacttaaaaatcaatgttcaacttgaccaaaataatgatattactttttttgttaatgattgaaataatgtcatttcatcataaaagcaaaaacattatattagtataaaatcaatttatttttgggctaataaggttgtatttaaatttttagaattatttgatttgattttaaatactactaatattggatatccaagtgttgaaattgcaagtactgaggtttcttaatgtattactatatattgttatttgtttaatttttttttcatattttgtttaccatgtttataatattaataaataatattttatttatttgtttctttcagcaaatctggttacaacaaatttgattatagcaaaacttattgtaataaattaatttgtgagaaatagttgtaattcagactattataataaatattgttcaagaatcttttgttttaatttatattataagtttattttaaaatattatgttcatgatattaaatgaatcaattttactattttgatacatttgataatattatgtcaattgtattggatatttgaaagaatcattatataaaatagtagttctaagaaaaaaaatttaaatggataatccgttggtccaaaccgaactgaaccgtttatgaatgggttggtttaagttccaattttttttttgaaaatccaactgaatcaaaccaatcaaatttgattgagttatgttctaaatttgacaaaaaccaatttgaaccgatttgcgaacacccttacttttccctccttttatatatatatatatatatttttttttcttctaaatttaagagagacatgcttccccattaatatataatgacgataagcgaatttgatgtccacgtttttttttaaagtacgtaattgcatgcataaccaatcaacccctcttgcctatttttttattcaatcccatttgctctctaaaccacctactccttcttttttttaactctcatgtcaaaataactattttaaactttattaaaaactaaaatttttcataaaaagttaagtttaacatttttaaaagatttggttagtcagcacgcacgatgtgtgttccacccaataataaataaaaaaaagcttaatccagttaaatacaagtaaaactaactaattttttacattaattgagaaaatgggttaccaaaaagaaaatgggttaatattattatatcacatttaaaattataaactttgatataaaaattaaaaaagaataattgaaaatagaatctcaaatctcaataaataaaagagtattttttatataataccgttaaataattaaaatttacttatatatagatttatcaaactttttgttttgttatttataactaagctcggagggagtataatttattatgattatgtagaagaacaatcaagtaacctacatatatggtacttagccaaaaagttgttgaccacatatatacttagtaattgcggcgggctgtggtcaacaatacgatagctcacacttccatggaacagttttgtctcgttcctcactcactttggtaagaaagtcacagttcctcactcactttggcaacaaagtcacaaagtgtttgtcccattcttttgatataattgatgttatgacgattctgataatacactcatcattttgtcactatgcaacttattttattattttcattttttcctgtttctttgggtctgatatatacctcgtgacttttttttacttttctcccaaccttttcttgttccattttgcttcatcgtattccacccacctcggaggcccaagccaaaggttctcccacttagtacatggttttgatgccaatttgtttgctgtcgtgtattacgtatttgatcataatttttttgttatactaattgattatgaacatgattaactctgttttgtagtctttatttacggctcctttcatttttcgtactcaatgattgcaattcatcgtttggggtactgtttgaggtttaaacgttttgaaagtttggatccttaatctactggttttgcttccatcatggatgtcttcagaatctggtccttgatcactagttagaatttgagtggggtaaattagaactgttccggtttgtggaattgctcatcaatatcacattcccgtaagtttggatctgtttcttctaaagtcaacacttcctttataggataaagcaagtaattttacttgttgatgaaaaaatcacctgtcaatattatatgtgtacatacgtaacaaatcatgaaactgaagttttgataagaaaatttcagaagatcctgctttcatgtagtggggactgatgaatctttcatttgacatggaacggtaaccagcatgcttttagttgaaataccatttggggacaccaaaaagactaagttttctgcttttagttgtcacgttgacaggattctaactagcatgctttgtagtgttctaagtttttctgcttttagttgtcacgttgacaggattctgactagcatgctttgtagtgttctgaaatcagccagtgaacttgagatatattcattcttgcatttattgatattgcatagcatctttgcattggaatgcatctgatataatatcatgttatttaatcacactatatttcaaactctatttcagcagatcctgcggacattgtaagtaaatcttatggagatggagatgataactaatgttaccgagtatgaggctattgcaaaggaaaaattgccaaagatggtttatgactactatgcatcaggggcagaggatcagtggactttgaaagagaaccgaaatgcgttctcaaggattttgtaatatacttttctcaggaattaggacctccatttatctgttctagccctctagaaacttttcattcaaaatctaagctttcttttcctttgatttactaaggacacattaggattccctgggtgatgggattgcaacttgtgcttcgtttaattaattttcatcttttttgttctgaagcccttctctcaatatctatttggtttacttcaaacaggttccgcccgcgtattcttgttgatgtaagcaagatagacttgactacaactgtattgggcttcaaaatatctatgcctatcatgattgctccaacagccatgcaaaagatggctcaccctgaaggtatgtgatcagattctttggtctgtgccacattaatatattgccattacattcggtgcatgtttggattaaagtttacaaacttaagtgaatgaaatttaattttgtaaattatgcaaaagcaactttttctttacttctttttcaaactgagtttcagtttacaatcaaatacaactgagaatcaaacaaaatgttttttctgttttactttttgagtgaaatttttgaaggcaagccctgctataacggtaaagttgtgctttggtgacttctttgtcatgagttcgaatctagaaacagtctctttacatatgcaagaataagactacatgtaatattcttttcccttaccttcgcataacaaggagcctctggacaatcggatacgtactttttgagcggaatttaaaagattcccaactgaaaactaagcataacttcagtcttttgttgttgttcttgtggttatatacaagtataacggcttcactctcctatggcaaaaagcactaggttacgcatttccacaccttgaggtggaatgattataggatgaggtatagaatgccataatatgtaacttcctagcatttaattgaatgagaagatattttgtggctctttgaaagatagcttatggagtatattatgctgaaaccggtataggttctgtatagtttagtgtgcgataagcacaagaacatgaaaggagatttaaaagaggtttgcttaattacgaagacaatagaacattcccttctaaacaaaaactgctattattctttcttaaataagattacaatcccatttgaagcaaatgaatttatcctaaaaatctcagtcaatttcatctaaccattttgggaagaaaattccagcaagttaagattgtctaaaatgttttacaaaatgtttgcaaattgcaatgaatatagtgttttatagagcagaatattgcggaatgctccaaccttgacatcgtttaactattgtggtggttatttcttgtataactacgaagtataaaattaatctgaattaaacataaattcttctgatttcgttaatgcataagtccctgattcttaatatatttttaatagaagtttattttttactacaacaacaattgataaaagcttctgaattaaaagaaattatgcaacttttatgcaggagaattagctactgctagagcagcatcagcagctggcacaatcatggtttggctttcactatatttgtcatgcactttggttttatttcgagatgaaaactatatttctttccttgtagtttattatttatttgactgtaatatgaaattttatatgcctacttaactacatgcatttgttatacttatttacgttccagcagattagattttataattttttataattttttttttgtcacagacactatcctcatgggctacttcgagtgttgaggaggttgcttcaacaggtcccgacattcgtttttttcaactttatgtgggtattttttcctcaattatgcaagcactactattaatatctcctcttatctaaaatcctcaacaatcttgtcttaatacctaatatgttactgttctcttcttctctcagatgcttaaagacagaaatgtggttgctcagcttgtgggaagagctgaaagagctggtttcaaggcaattgcccttactgtggacactccaattcttggtcgtagggaggctgatatcaaaaacaggttggcaaaccatttggaaatttcaatcggaacagcctttcaacaaaactttatatggttcatcatggttgaattgctaaatctcctactttaagatatttactactggctagtttgatgggggtattttacagatttacattgccaccaaacctcgttttgaagaattttgaaggattggatcttggaaagttggacaaggtgtgtgattacattgttattttctattatttggtttagaattttgaaataaatgttttttttttcttttttaggcttaaatatgtttttatctttaatatatagtcaaattttgcttatgatccttgataaattttttcttcacatctgttccttgatatttgaaaagttgttttagattcttacacttagttaagtgatgacgtgtctgtaaatattttataatgcgatttgtgacgactcaaaaactgtgttagtatttatttcaaaattaaattaaaaaagaatttttctctctcctattttatcattttttttgcctctctctcttcggccctcttttctttcttccttctgtcatgaatacatcaccatagttactgtcatgaaccccttgtgtctgttcctttcatgtttcgtcatctttgttcaatgcctttggagtggatgcttttgtagtgggttaatttaaaacttagacaagcataatttagaaattagtattattaacataaaatcaacaaatctcccaaaattaatcaatacattccaaattccaaatcacaaatccaattaatctctatagctcatagcaaattcagagcaacaacaattcgaaaataacaaaaaaaatcaaccgaaggacatcgttgacgttaatgactcaaagggtttagagaagcttatgtggtatgtgaagacataaatgtacgccaagatgatttttccacaatgattgtgaatgacattcacggcgagatcaaggtgggagaggaaggtgcgaagggagggattgtggtcaccgctggcaacccaatcggggatggcattgaagaaggcttgtccaagtaactcgtagtcgttgaagaataactactcgatgtcagtgacctccccgtcgacgtaatcaaaggtggcggtggaagagccgaaaatgagagagttgtgttcgcaataaactttcttttggtagtcttgctctgcggtggtgactttgaaggtggtgccgaagtgtttcagatttgaaagttaaagattgacaatggagagaaatgttccagatctgaaagtcaaaaacaaagagaaagttaaatttgattttgaaacaaatattggtgatttttgaaccgctacaaattgtattatcaaatatttaacagacacatcattatttaactgacgacagagatctaaaacaaaactttttaaatattagagagcaaatgcgaagaaaaaatttatcagggattaaacacaaaattcgactatatgttagagatcaaaagcatatttaaatcttttctttattggtcatattattattgttacttactatttgctctttgggattacattgcagactagtgactctggtcttgcctcttatgttgctggacaaactgatcggtcactcaactggaaggtgatatagatctttgacacatgcaatttcctattctgtgacactgaatgtggaagtaataatatggtaagtcttgtttcaggatatcaaatggcttcaatcaatcacttcattgccaattttaattaagggtgtacttactgctgaagatagtaagcctatcaaacagacgcactttgtttctttcctgtccttttatctctttaaaattgttttctcaatctttaatcttattccatatttaataatgtagcaaggatagccatacaagctggagctgctggaatcattgtttccaatcatggagctcggcaacttgactatgttccagcaactattatggctttggaagaggtagtggatcctaaccatttctagaaattttatattaattgaaatagaaacgaaccacttgctatcattctttatttgattttatttcataatgccttatacattgaaacttcaaagctgttatatttgactcattggaaagttttttagattgcctgcttccttactcataatcattgcattttcattttctttttaaatttttgggttcggttgaataatgtcatctttcaattcatttaacatattggaaatattggttgcttgacttaaataggtagttaaagctgcacaaggaaaaattccagtttttatggatggtggaattcgccgagggacagatgtttttaaagcactagctcttggagcagccggtgtattcgtaagtacatgaaagtttgatcaccatcatagaaaattaaactattgaatgctgaactttagtatatgtgtttgtttgccttatggcatgaaaatatgcttttgtatttcattgatttactactttttaattggaggcagatgatctaaaataatctgaatagccccacattcttgctatttatatctttgtctttcatctcaaatttcagattggtagacctgtggtgttctcattggccgctgatggtgaggctggtgtgagaaaagtacttcaaatgcttcgtgatgagtttgaattaactatggcactaagtggttgtcgttccctcaaggagataacccgtgaccatgttgtcacagagtgggatcacccaagattttctcccaaattataagacggcaagactcaaccttgttctatattttaaaaaaggagttttagaataacctttgttcttattccatgcttcagtagaaaactttgttgttacagcgagtgaggcattagtcatccattagtaattgctacttttttattagttgtacataataagtttctacttgaactcatttcattgcacttggtgctaagatttggtaaactctagaaacataattgccaacaaaatgtaggtttttcttggcaaaagattaagttttatgatcatttatctctcatttatgtgcgacaactttgatttgataagttgcttgatgtctttggattgaaaatgctcccaagaccatctcatttgatgtgatggttatcatggaatgaagaacaaaaacatcacatttgaatcaaaggatcttaagaccacatgacttggttctaaggtcaccttatactgtagggtgttcttaaatgtttggtaacccactctattatttatcatgaagggaagggagggagtaggagtgaatatgtaagaaaagaaaaggaaaaaaaggaaaaaggtgaaaaataagatgaaataaagattatttgattttagagaaattgagtgaaaattaattttttgagatcatttgatttattgttattatttaagaaaacatgaatgaggcatgtaggtgggcacatgtgtgtttcctttaaaacaaaaaggtattatgaaatcatattgattaaagcattgggcgggtggggaattttttttgttgggttccactaatgtttaaaaaatttctctttaattctacctatcaaacaactcagtcttccttactttttccctctatttccataataccaaacacactctacaagatatttctttacccaccttttgactctaacgtgttatatttgattgggaggaaagaaaatgaataaacgtgtaagaaaataaaaaagagtgaaaaaaatgaaataaaatagaaagaaaataaaaaaagtaagattgtttgatcgaaatgaaaaagagtaaaaaagagaagaagtattcgagataaagtatgtggttaggaaagtaaaggaaaaaaaaaggaaatttaatattaaatattaatgtattacctttatttttatgaaatctaatagttataataaataattaattttaattattagatattaagaaaataaataattaagataaagaataattattttaaaataattctctagagtaacttgatttctagttagatattattattattattattattaaaaaagtaagaatcaagggggaggggtctgaataagtaaaaaaggaagaggaagacataaccatatcgagagactagtttttttgaaaattgtgtcatttgatcgctttttatttcatttgagcaatgaaaattattgtcagtctcattgtttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtttttttttttttttttttatataacttttcccctctttcatcttaattcaactcttttcactttcattacactaggcccttgtaaatgcagaccaggagactttacaatgctaggagtagtagccaaccacgaacaaaatccatgatgaacccctagacctccatcaaaagaaaatacccaccacatattgtgtttggtactatgtcttgcaatgtatttatttagataataaaaaaaataacgtaaaaactaacaaagtacacagaagctttatatataacctttgaagcgacagaaaattaccaacacggacatagccaaagatatgaataaaccaaaattgtggtcatgagatcttccacgtgtaatccttctttgagaaccgtgatattgatccatccattcatcgtcaactcacttggatagttggataagatattgtccattttcacttgcctcacaagttaacaccaccaattccttaatttcctcattatctatagcttctccttaatttcaaaaccatctcgaataagacaaccttatcatcatgcatggcttagtaacttagaagacagaagcaagtttctattttattttcaatatatacttattattttcagacatagttttgacaagtgcctaactatatacgtggaatgtggaaggtataccacaatcttttgcaacttatttattaaatttttttagaactgtacaagtagagaagaaacatgattaaggtgtttaatttttttcccccaaaaaatgatatgtctaatctataaaaattaacttaaacaacatataacatggtagttgcaccattatagttactgtaaagaatgctgaacattaagtgatacatactgtagcactttgcccatgagataatgatcattgcactccagtttcagactttagcacgagaatttggatggtttatctaaatccaatggacgtaggttttcaactttatgtgaagttatgcagattgcagatcaagctcttaaaattgattttttcacacatacattcaacaaataacaaatatatacataaacatatatatgtccaatcaatatatataaaaacatacatatttcttatttacaatttaaattcggattgaggaactctaatttatactgtaattttttaattaatctttaaaaaaatttcttaaaaaacagttaagaatttgagttgagggacccaattcttaacttgattttaattttttttgaaaaattatagtgtaaatttagatttttttaatctgaatttataccgtgaataagaaatttgtatgtttatgtatatatttgttatttgttctatgtttgtgtgaaaaaatcgttaaaaattcgcttctgtttttgtttttctttctttcctttttgttacattggacataaacctttcagaccaaggaaaaagagacaaagaagggactaaagttataacttaaaacaaatggagcaatcagaatttcgaatacaccgaattctcaaaggaacacaacctcagttttaatctcttatttattttttgggtaaaaaatgcagttaagcttaaaaaaggtgtactcatcatcattttgttactatgcaatttctttattattttcctctcgtgtttctttggctctgttacatgatgtaacagacttacatgccttgtgactctttcacttttctccacactttttcttgttccttttgagcttaatcgtattcctcacttcggctgcttagcaatccaagcgcaaaggttctcaatttcaacttagtacctgattttaattccatgttatttgcagtatttgatcataattttttattattactaattgattatgaacacgattaactttgtcttttagtcttgattcacggttcctttcatttttgtacttaatgattgcaattgaccgttttgggtactgtttgaggtttacacagtttggaagtttggattttaaatctgctggattgttttccatcatgggtttcttctgaatctgatcctagctcacttaatttgaaagggtaaattgaactgatcctgttagaggaattgttcatcaagatcacataaagtaaaatgatccataaatttggatctgtttcctctaaagtgaacacttgctttattggataaagtaagtaattttacttgtggatgaaaatatcactggcagatattttgcatgctcggaaacaagttgagaatagaagaatcatgtttcagatgtagaagctataactattggtttcggaaaaccacatccaaatcatgaaaccaaacatgctaattatgtaaacatacataacaaatcatgaaagtggagtgttgatatgaaaatttaagaagatcctgatttcatgtggtgggggctgatgagtctttcatttgacaaaccctttttcaaaaaagacaactcttctattgttgttaattgaaataccattgagggacatcaaaagactacgtttttaagcttttagtggtcatgttgaccaagactgtgttttgaaaggattctaactagcatgttttatagggttttgaaatgagtcagtggacttcagaaatatccattcttgcacttattgacattgcgtagcatctttgcatttgatatgatttcatgttatttaataactatatacttgaaactcactttcagcagatcctgcagacaacataagaaaatcttatgaagatggatatgataactaatgttacccagtatgaggcaattgcaaaggaaaaattgccaaagatggtttatgacttctatgcatcaggggcagaggatcagtggagtttgaaagagaaccgaaatgcattctcaaggattctgtaatctacttttctcaggaactaggacctccatttatctgttctagccctctagaaacttttcattcaaaatctaagcttacctttcctttgatttaccaaggacacattaggattccctgtgtgatgagattgcaacttgtgcttcctttaattaatttttgacttttttattctgaagcccttctctcaatatctatttggtttacttcaaacaggttccagccgcgtattcttattgatgtaagcaagatagacttgactacaactgtaatgggcttcaaaatatcaatgcctatcatgattgctccaacagctatgcaaaagatggctcaccctgaaggtatgtgatcagactcattggtctgtgtcactttcagatattgccattacattcagtgcatgtttggattaaagtttacaaacttaaatctgaatgaactttattttgtaaattgagtatgcaaaaacaacttccctaagttctatttcaaactaagtttgaaggcaaaattatgattaaattcagttttaattgaatccaactggaaattaaacaacaagttttttcagttttacttttttagcagacattgaaagcctccaacctgaaaactaactataacttcagtcttttgttgttattgatcttgttgttttatataactacttcactgtaacaaaggcaaaaggcacataattatgcattcccataccttaaggtggaatgactataggataaggtatagaatgccctaatatgtagcttcttagcatttaattgaatgagaaggtatcttgtggctctttgaaagaaagcttacagagtatgtttatgctgaagcaggtataggttctgtatactttagtgtgctataatcactataacatgaaaggaggttttaaaagaggtttgcttaattacaaagacaacagaacattcgcttctcaacaaaaactactgttatcctttcttaaataagattacaatcccatatgaagcaaattaatttatcttaaaaatctcagccaatttcagataaccattttgcagagtaaattccagcatgttaagactgtctaaattgatttctaaaatgtttgaaatgaattgaagacgatatcaagaaaagtagtgttttcaaatgaaaccgaaaagggtttgggagcttctggaaattttatattactttttagtgttttatagagtagaatattgcacaatgctccaatcttgacgccatttaactatttccgttgttataattacaaattataaaattaattagaattaaacaaacactctgctaattttgttaatgcattaatccctgattttcaatattgtttttattgaagattatttcttactacaagaacaatttagaaaaatttcttaattaaaacaaattatgcaacttttgtgcaggagaattagctactgctagagcagcatcagcagctggcacaatcatggtttgactttcaccatatctgtcatgcattttggttttatttccagacaaaagttatatttgtttccttgtagttttattatttattgaaccgtatgcctactgaactgcatgcatttgttgtacttaattactttccagcagattagttttcataatttttgtgacagacactatcctcaactgctacttccagtgtcgaggaggttgcttcaacaggtcctggcattcgtttttttcaactttatgtgggtattttttcctcatttcttctttccatagttctcttttctgtgatgtgtattaaaagtctcgtctcccccatgaatacaaaacattttcttgacaatgaaacatttccaagcaacttagtatgaaacagaaaatcacttttatgaattatcaattatttttttgttgcacttttatgaatgttttaatgagtttggaaaactaaggcttgattcctgcatactgccacagggcaatgtattacttacattttttttccattgttttttgccagaaaagatcttaatagtttcacaaatattttcttttctttcctctgtgatttcctccacacttccttttaataataaaatgttattctcattgcttaagttatgcaagcataaatatgaatatatcctcttatctaaaattttcacaatcttgtgttagaacctaatatgttactgttattttcgtctctcaggtgttaaaagacagaaatgtggttgctcaggttgtgagaagagctgaaatagcaggtttcaaggcaattacccttactgtggacactccaattcttggtcgtagggaggctgatatcaaaaacaggttggcaaccatttggaaatttcaatcggaacagcatttcaacaaaactttatatggttcatcatggttgaattgataaatatcctactttaagatatttactactggctagtttgatggggtattttacagatttacattgacaccaaacctggttttgaagaattttgaagggttggatcttggaaagctggacaaggtgtgtgattacattgctacttttcattattggtatgaaattttgaaatcagacgagtttttccattattggtcatcttattgttataactgttgctattttctgtttgggattacattccagactagtgactcttttgctgcctcttatgctgctggactatatgatcggtcactcaactggaaggtgaaatacatatttcgcagatacaattttctaatcagcgacactgattgtggaagtaaatatgggaaatttgtttcaggatatcaaatggctccaaacaatcacttctttgccaattttattaaagggtgtacttactcctgaagatagtaagcctatcaaacagatgcactttgttgcttccctgtccattttatctttattcagattgttttctcaattttgaatctaacttcatatcctatgctaataatgtagcaatgatagccatacaagctggagctgctggaatcattgtttccaatcatggtgcttgccaacttgactacgtccctgcaactattatggctttggaagaggtactagatcctaatcatttctggattttttttaattaattgaaatagaaatgaatcacttctagtatcattctaggtagtggaactaaagtcttagtcattctttgttttattttagttaatcacgcattatgcattaaaacttaaaatctgttatattggaatcattgcaaaattcattttcattgtctgttaccttgtaattgttgcattttcatctttttaaatttttgtgtcctatttcaattcttttaagatattggaaatatcggttgcttgacttgaataggtggttaaagctgcgcaaggaagaattccagtttttctggatggcggaattcgccgagggacagatgtttttaaagcactagctcttggagcagccggtgtattcgtaagtacacaaaaatttgattaccattatagcaaattaaactgttgaatgctacttcagtatgtgtgtttgtttgccttattgaagcatatatgcattagaaaggtgtagttcctatgttctacagagaagcatatgatcctggatcttagaaatttccttggaatatgaatttccacaaatgccatggaaacttatggaatatgccaatatgcttttctatttcattggtttactagttttttttggaggcaggtgatctaaaataatctagttagtcccatattgctgctatttatatatttgcctttcatctcaaatttcagattggtagacctgtggtgttctcattggctgctgatggtgaggctggtgtgagaaaagtacttcaaatgcttcgtgatgagtttgaattaactatggcactaagtggttgtcgttcactcaaggagataactcgtgaccatgttctcacggagtgggatcgtgcaagattttctcccaagttataagatggcaggactccaccttgttcttctatattctaaaataggaggaattttagaataacctttgttcttatttcatgctttagtagaaatctttgttgttataccgagtcaggtgttagtcatccattagtaattgctacttctttattcactgtacaaaataagtttccacctgaactcatttcattgcacttggtgcgatttggtaaactctagaaacatgattgcctataaaatgtacttttttcttggccaaagattaagttttatgatcatcgatctcccatttaggtgcgacaactttgacttgataagttgcttgatgtcttaggattgaaaatgttccgaagaccatgtaaaagatgtgatggttatcatgagatggagaacaaaacacatttcgtacaaaagatgcctaagaaccacaagacactcagggctaaggtggtgctcttaaaatgtttggtacaccgctcttgaccaagtgagagtgatttaccttatcaccttttatctttaaccaagccatttgccacgtttttttttggccttcacatgaaaattgcatcctcttaaaagaacctgatgctttcttaattagccttactcaaaaatagctaaaagcaacctaccacactcaaaggcgtcttgtcattgcttttctaccccaaaaggaaccaattgattgtctcatctacaaacacaatacattttattttctcccaccttttgactctaaaccactgtaaatgcaaaccatgaaactttacaaagctaggagccaaccatgaacaaaagccatgatgaacacacacagacctccatcaaaagaaaatacccacaacatagtgttagatacaacatcttgtgcatttatgaagataaaacaaatcacatcaaaactaacgaaataaatcactgtaaatgcaaatcaacttcgacgcaacagaaaaccaacatgcaaatagccaagataggaaaaaaccaagtgtcatagcaagatcttccccgtgtgtcgtgcttctttgagaaccatgattgatccattatccatctgttcatcttcaagtaacttggataagagatttttcattttcacatgcatcacccattaacactccaacaactaatatattgaaaaagtcattaagatgatgtcacatcatcacttaattgattacaaattcaatacaaaacttttaatatatcaaaaagaatagagactcaggaacaataaaaaaaatttgagaaactcaaaacaaatattgaatatatatcatgcatctcaaaacatatttaaatctctaatctataattcttttctcctttcaaatccatcacgaaacaatgtgtcaaccttatcaagcatggtctagtaacttaggatgacagaagcaagttttttctttaaaaaaccaaaaatattcttacggtaaaaaaattcatctgtcttgctccaagcaagctttttctttttctgagatttagcaagtgggaagagaagatttgcatgggatagggtcttctttgaacaaaaataagccaaattattggtccttgtcgacgcatcaagtatgataccacttttcccaaatgcccagcaaaagttaccgtccttgagatcgaattctttgagcattgcaggcagagtgaccttagctctatcagtgcttcaagctttacctactacctagctacattatgcaaaacattgttacctaaatctgtttgccagtctttttgaagtcttaatcaccaactttgtgtggaatgggaatatttaccgtacatggcataccatttcttggaatctgtatgatgctaataaagctatgatcatgaaatcattccccagaaacctaatgggttcgtgttctaagagcaaagtaccattgtggaaataacattatttcccaatgtcagcaaaaggcaaatgtttggagaagcatttgaactgtttgggatgatgttaatggactgttccgttgcgaaatctatctggaatgttttgttgaactcacaaagacatagggatttctttgtaacagaccttaatagattgataaggaagaatatgactactaagaagcatgtgattcgagagtggcaagtgatatttagtgcagtgtgttttctaagaaaatctgggagcttgcactgttttgatggcagaactcagtgctatattgtctgctctgctcttgaattggcatggcagagaaggaactcggtggcagattggatggcttcacagggtcatagcttacctttgaggaaccttctatgattttgtagggatcaaattcccacctagagtttccttgtagttggcttaggccacccctttaaatcaaaaatgtatacttatcattttgtcactatgcaatttctttattattttccttttgtgtttctttggcttattgatatgctttctgacactttttctggttcctttttagcatcatcgtattcctcacctcggcagcgtgttttccctctcaatttagtatctgattttaatttcacgtgatttgcagtcgtgcgtaacatatttgatcataaatttttatcatactaattgattcaagactgtgttttgacaggattctaaccaacatgttttatatataattctaaaatgaatcagtgaacttcagatatattcatgcttccatttattgacatttcttagcatctttgcattggaatgcatttgatatgatttcgtggtatttaatcactacacttcaaactcactttcagcagatcctgcggacatcgtaagtaaatcttatgaacatggagatgatagctaatatgttatgacaaagccagtcaacactgacaaatttacatggtgttaatcctgttatggcctatcaaaaatgtaacatggaatagcaaggaagaaagaatggtgtgaagatatgatttaattaatcataatcttcaagttggagaattgttggaagcgaaatgcggaagtgcggaagtgcggatgtcccacattgctgggtcttcctttgagtttttactttgttgctataaaaggaaccttagtagtcccatgtttagcatctcaaacattttcttctcccttcttttatttactaggttaccaagagatataaattaatttcttcttttagattctcttcgtagatgttgtaatttttttcacttggttaaattttttccttgtccattgtaattttagatgctcttttctcatctctaattttagttgagttattatcttggtatccaacacgaagaacccataatgtattgtagttaattataacttgcattacacgaatctggccaaaatgttcaatcctaataagtaatgaaagctcggcttatatgtacaaatgatatatagctaggtagttcagttcctcaaatgctatcctcatattctccaagagttatgtttcgtttgcaaccatggttcccaaacgtcattttcaagagatatgtcactgtcactttgaaatagaaccaaagattcccatatgttcaaggttcacgaaaaatatactaccccaatccattggttggtttatggattttgggttagtgacactgacataatgatgcgattcagcacgtctttcttgtacttacaaatgcaatttcttttgtaatatcccaaatcatggaatctcttttaatgggtattgaaattcatatatacaatttaaatttggtatatatggtggaaagaagagagacggataaaaaatgaaagaaaaaaagatggagatgaaagcaaaaaaaagtgaatgtatgataatatttatattttttactattttataatataactatgaaaattaatgactgtccttaaaacaagcaataaaaaataaaaatataacatttaatattatgcatgtctttgttaaaaaacatcaatatatttaagacattaaaattgacctacatacaataaaaatttctgagtttgaacctaaaatttcatgtaaattatttcatatttttttgtttctcttttttttattatattgcttaacacatatggcactttatctttctctttttttcttcttctaaatttctctctctctctctttcttcttctatgtacactcaaaatgtaggtatgtgttcattttcctaatgctttttgtttaatttggaatagaaacatagtagaaagaaaataacagaataagaaggataaaaataaaagaaaaataagataaaaaaaaaagtattgtttgaatggttagaaataataagaaaatgagttgtggaaaaattagttctacatccacaagtttggatgattgaaaaagagtcataagaaataaataaattatatgataccatgatgaacctgtgatgaaaatacctccatcggaagaaaataaatacccacaacgtagccaaagatgaaaaaaaaaaaaaaaacaacagagagtgtcccgagattctctcntttttacatgcctcacaagttaacaaactccaccgatctctttcctcattatctatgataaataattttcctttaaacatcccgacacaacgagccaaccttatcaagcatgcatggttgagtaacttaggaagacaacagcaagttttttttttattaaaaaagtaaataattttttggtaaaaatattcgtctgtcatgctccaagcaaagcttttgtttttttttttctttctttctttctgtgatttaggtaagagaagacacatatatttgcatagttgcatgggatagggtattagggtcaaaagaatgctgaatattaaatgatggtagttgcatcattactagttacaaactaataacaaaactttttctatcagtactatttaacacaactatgtatttaaaactcaaatatgaaactattactagttaaccgaaataatattcatatccattcacttgtgttttaatctcattttattcaaaatctgattatttatattgaaactggtattcaggttgaacaacgaagagcctataatatattctagttatagggcttatagcttaattagtactaacgaatctagccatatcgttcaatcgatcctaatgagcaatggtcaatgaaagctaagcatatatgtacaaacaaatgataggtagttctgttcctcaaatgctatcctctttctgaaggtagtacgtcaaattaaagttgtgtttcatattattggagccttggttcccaaacgtcattttcaagagatgttccattttggaaccatggttccccattcatttattgtgtatggattttcgacaattgggaaaatatctatagattgctgagtaagaagaatggacaatgatattttaatgtagtagcatggtgcaattttaaaaaaacgttttattgctgtttgattacaaaggttctgcaagtctttcgcctacacttcttattaattgcttcctatataagtttccttattaaaaggattaatatattatttatacaattattttataatatttttttatcttatttttatttctttttattatatatatatatataacttatgaaaaattgtacaaattcataattaaaggtcacaaatcatggtatctctttttataataaaattatgaaaaaaagtattaacgaataccttggggcaagcaataaaaatccaaaactgttttttataaaaacttataacatttcatattatgaatatacctttgttataactgtacgtacactccaaaatataatgtatatatgttctcatttccctctnatacctttgttataactgtacgtacactccaaaatataatgtatatatgttctcatttccctctacatatacactttttcttgcggagcggaagatgtgatcgatttgaagcttctaaactcgaaagtacttatcagctcatttaaattactttttgtgtttcacatactacagataaaggaaacaagcaaggtatatatacgttcaaaggagagagaagtagtgggatgaaaagaatcgatcataagaaaatgataggaaaggaaagaaaagtgattacgaaattaaaagaatgaatactaaatatgtctattttaagtcaatataaaaaaattacttataaattattcttttataaatggcatatattttttttagtatttattcttttaaatttttaaaccgtaaataaaattaacattttgcacaataaaaggggaaaaacaaacaggccaggtcagtaacctgtgtatatatattcacattgcttctaattttgcacttgtgtatactttttccttgatgttttctttccttgtttatatatataaaaaaaattctttcatatatcacactgttagtgttacactaacgaccgattaaaatttattaaaaataataatttttgagttttacattatatttaatgtttttttcttcttattttataatttattaaaaagaatatgttgttaatatctctcttattttctatcatcaatactagcactatatattatcatgacaattttataatctagagttaatgttggagatgacagtgagacaaaatacacacatgtaatagctaattgttgttaggggtggataaacgtactcaggtccatgaattgatcacagaccaatattttttaagaattcatgattatacaagattgtgcgggtttggataacaggattcgtgggttggccctcaaatccacaaccaccagccaagttcaatccaattaatcctaaacacacaacacaacagcgctaaacactgcaaaacaaaaaacaaaacggcacaacagcgcctcactcccttcctctatgtcatttcttctcctcaatccctctaagtcgcacgccacacctcacggccacagccaccgcgacgctgacccgtttacccatccctccttgttgcccgttccgttagatagaaattcatacacttgagtacctgtttaaaaactacatttggatttatatatatatgtgtgtgtgtgtgtgtgactatgtgtatctataaatatccataaatacttccaaaaaagaataatcaacaaaactattttgtgagcttcaggcaaactgcaggcgcggcaaatatcactttgaattttttaattaaagaattaaaagatatcactttaattatttttccaattattagtagccacgtgcacacacccacacgtacatccactaaacatgtgcattggcacgtgtgtgctcacaaacatgagaaattaacttattccaaattaaattgtttatgtttaacttaaactttttagtataactctttgatttgaaaaatcaagttaaataaatcagttatacaaaatttcatataatttataaattatttcatattttcattaattaattttattttaaacatataatatatttttcaaaatataaaaaatattaactataagactatatacaactataaatattcaatttattcaaaatttaacacacacacatatatatatatatatatatatatatattattacatgctttaaaagcatatgaaaacacttacaataagttaatccctccttcatatgtgtgtagacactaaagatactctctatttgattaaaaaatatgttaagaaaaattagtattcatgatacacataatggaataaaaaacgaatctattttgggattaaaatatattagtgcaaaaatcaaatgaataggatataagctattggattataaagttcaatattatgaagactttatgtgtaaaaaatcaatatatgttatcaattcttttgataagtgaaattctaaagaataaattctctttatactttttaggtctaaaattaagcttgaacttttctagtttttgtttagtacattttgcttttatgtagatgtttttatttataatgttaaaaatatgtgaatttgggtcatttttcaaagaaaaaatgaaagattttatttaaaaataatttcatatctctttatctttataaaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccgaaattaaaacataataaataatttgttaattactatgataatttcctgtcaaatgctattatatttcttcttgagaaattactatttacatatcaaggtaatattaattgtaaaaaattttcaattgagtaagctcaatgataacattcacatgtacatcatctatatatgcattttaataaatgagatatattatttatccaataaagaccattatatatattgatctatccggattatcgatatcatattcacaataatcatacgattaaaaacaatttagattaaattataagagacttatttctcatttttataatcaatgataaaaaaatctttaattttaatcaaagacattatcaagttaactattttatcaaacaatataaaaatgataaaaaaataatattttatttattggaattagaattaattcgatcatgtattaaatcttagacatacattattattctcaacaaaatgtatgttcaagaattcatcggattaaagtgttctattttttggtatagataaactagataaagtgcttttttgtcatttgaaaaaagcccattagctaaatcttcaagcaccccctctccccaatacagtatacacaaacacgcgcataagaaaccatatatattaacgaataaattgtatgagtttcgatcatagccgcacttaatttacaagcccttgatccacaaactgtattgggcaaaaaggcatttcattcatccatagtcttgcaacaagctagccaattaacaaccaagccaaattaattttcatttgtttccccttgattttgatgatttaacttaattaattagctagtgatggtatggggatgtttcttggacacgatttttcctcttctggagaaacctctgcaatgatcttttcatggaaagtccagtgctggggctatacatgttataatgaggtgattgcagtaatattggcgaagatggttctgacccagttggtgtcatcacccttctctccgtctctttatttgcgagcattaatatggatctggcctggatgcaatatacatgaccccacttacaactctttttcataatccaaataattgacctaacgactcatgcaccatgtgaatattctgtgccttaattaaattaatatatagtgagactacgtggctactaactatcgactcatttattatttttctttatttataaagtactagtatgaaataattaaggtgacttgataaaaagaaaacctcgagaaaaacatgcaacaaaagtgccgatcggttctacagttgtgtctaatttttttaggtcaaataatgagtctttgctttgatagcgcgaaacttcttggaaccccaattctaactaagcagtcaaatagtcataaatacgaccttctaccttttatatctttcgttgtcttgtaccctaaatattaccaacttgtctgcaaagactttaccctagataaatatctttattctctctcagggtagtcaatattctattttgttacagtagttactcatcatattataaattgaatcaagtctaataaagtaattagtggtaatcataactctcagtatcatctgagatacagtaggaaactaagtcaaattatatactacagtcacaataatttggagagttttttatactattagtttttaaccaatcaaattatatgacatttttattaattatttatttttgtttttaaattagtcattgattataaaaattcttattattatttcttaaacataggttctataaaagtattgaaagtcactaaaaaaattagaattcaaatttctaaagttatttttaattatattttctaatttaaaaagttacaattttaaaaaataataatcaagaactaaaagattaatttgaaaaaaaatttaataaaaagataacatataatttgtttgactaaaaaattaacaatatcaaaatctcctaaattattagagactccatagaaactcttcagagatgatggatgatttccaatagtttaattaatttcggaaatgataattagacacctctttattttaaaaattctatgaatattatctcatattttcttctatatctttttatcacattcaatcatttattatatttttctttttcttttttctctatcacgggatgttaactagcacttgggtgtcgaagtataatttcccaatcatttacccctgtgaatgtcatgttaaaaaaaatgttatgtggtaatagatagataaaagctacgtactttttttttttttaaannnnnnnnnnttttttttgtttgctattggctgcactgattgtgagttatgaccaatgatgatggaattaactacatatgcattttatttttaggcatgaacttctcctttttgaggccctacgtgaaggtttggaagaagaaatggagagggatccttgtgtatgtgtcatgggcgaagatgtaggtcactatggaggatcctacaaggtgactaaaggccttgccacaaagtttggggaccttagagttttggacacacctattgctgagaactccttcacaggcatgggcattggggctgccatgactggtctgaggccagttgttgagggcatgaacatgggannnnnnnnnncctcaagatatacacattgttaaaaaaagaataaaaaaatttctctatctttaagatctcaaaataaaatctactactaaaaaaagatggaagagatcttgagaaatattcaattttactgacactatgagatctaccaaaaagtgatataagatttcaatttaggatctattactaaaaatactcttaaaatattaccattaaaattataaataaaataaaatagacaattataaattttcactaatgatagtagacaaggaagaatatacttgtataacccaaacaacaactgaataatgatcctagaagtatatatatcatctagctaattttaagaaattaaaataaaaaataaaatacattaaaacaatatcatactattctaataatatatcttaacttgtttattcagcaagttctttaaccatttaggtttcaagacgttttttaccttcctagttcctagactatcttaaaagacatccaacaaatgtaaacattttatccaaacccaaacactcttcattttctttctctctttttttaattatcaaatcacatcaccaattatatagattatttatctcttatttctttttatttttttcaaggtttctacacccaacaagtattccaagattaatttctaaaaaatataaagaaagagagcaccttaattttgaaaaataaataaataaattacatggttgataaacaaaaagagcagatatatgtatacctgaagctctgtgacatctgagacacaaatcttgccatcatagaaaatggtcagcggatgttgcagttgctgttgatggtgggggtcctgttgttgtgggctctcactcacttctgcttccatccttcattcaaaacacaaaagaaaaaactcagaaccatgaattaatccaaattaagtacaagctttgtgcaaattatatatatagacaaatatcagaactcacaaagtaaaaccttaattaaaaagaagagagagagaaaaccactcacatgggacgaagatcggagagggagggaggaaaaaggcgaagttccaagttgcaattcttcctcatcttctatattctttgagagaattgaattctgtgacagagagaaaagtaaagataacgtgtaaacaagtaccacaaaggaaaaaaaatggaggatggtagatgtacatatatacatatatgattgaagaatttggaaaagcacccacaaatgaaacacgtaaagcacaacaaaaaaaaaaaatcggcttcggctggtaaacagtgttaaagtatgtttgaatttaaattaaaaatgcggtgtgtgcaattttataccaattcaaaagataaaaataagttaaaaataaaaataaaaataatgatatttttataaatatacgtttaccttaaatatacgatttgcaaactgcaaccttttattcaaagcacacttagttgtaggcagcaaaagcaaaagcacgttggagttgtaatatttattattaattataatttgagcacatgtttcacggttttttaatatttgcgacacaaggcgacggcgtgatgagttgagataagtgacgaatgaatgtattgatgatggcattgctgcgtgcggtgggcaacaccacaagacgaaattgtttctcacgctcgctttcccatgaaacgacacgtgctttcggccaaaccatttatcaaatataacatttttagtgatagatgttgtttaaatattttaaatttaaagatttgatttttattagatctctaaaagataaagtaatataaagaatgagtttttatgaaaaaattatctgtatattgttaaaaaaaataataaatctaagatctcaaaatgagatatattattaaaaaaaataatagagatattgaaattttcaatcttacttgtcattatcagatctattaaaaagtgatttaagatctcaatttgaaatctaacattaaaaatgctcggtattatactgttaataattttttttatggatttttcaaatttttatattaattaattttttaaattttttaatcaatatcttaaaaatattatttagcaaaatttatatttatatttaaactaatttatatataattgacacttaatactatatattaagtttttctttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaaatatatttcatctaacaaaaaattatccaatgattatttatatatagaattagattggggtctctttagaatgtgaactatgaatgtaataccaggtcttttagtaagtataaaaaaaaaatataagatcttttagtgcatacatgagcatgtgtaaggattatgtatttctattggctcgttctcattcataagattcttattgaatgatctaccacttttagtgattgagacattttcaagtttatatttttgcttattaaatctctcaaagactattaatatatagtcttatgagacaactcaagcgaacaatgtgactcatctttgtgaattttccccacacagaactctcatttgtatctttcatgttaaagaacctaatcaacatttttatcatcgatcttatgcaaaggtggcaaactgagctactcgacctaatactagttaagttgatgtgggttgtgggccatagtgagttttgctgttaaagcccaaattcattttggacctataaaatgaagtccaataccatatgcatcttcatggatatagatcataaactcatcatcaataatagaccacctttatctaatagacaatcttatgggaatctagttaactaaatcaataggttgtagaaccttaaccttagcaggaagaacaatcacattttcaacttgaggatatattctctcaattggaacatgtgcttcaaagggacaatagaagcaacattgttgttagtgctaaggtagccgcaaagaaacaatctcaattaaataagcattagccttatatgatgggatgacaagattcgctacattaagctccaagaatttagtgtgcatggacttcacaaccctagtgtccttgttaacacaaaatatcatatagcctttaccactttttagatatcacttggaaaaaaaaatgactagtcgatcattaggatttttaaactcctttggatattctactgacacttatagatgtgttgtcctctctcaacaggggcagacccaaactccaattagaggaggccaacaaaagaaaataaaattcgtactacaatatatattatcattttttatacaaaatattaataatttgtctctaattaaatcattaatctattatgaatactatagtgtatttatatatacaactagtcaattatatttattatatataaatttataatactaaaacctcaattataaagtataaaaattaaaaataattttctttcgtgcgatgccatgcattttagtcttgacctcttgttaatgtcataactctagtttccaaaatatgaaaattacattacaacaatttctgaccagtctaatgaaactggtttatgagattttaaaaacaataactcctttagttgcaagaaaaatagagtttaacaaaactcaagaaacataaaaatgactatataataactaaaatttgataaaatatttagataagatttcttttaaaaaaagataaaattattatttgttttatattttaaaaaataggagataacaattgattaaataataattaaaatttaataaaatacaatattcaactaagatttcttttaaaaaaataaaattactaatactattataattttgaaaaaattcaatagtaaaaactaaattccttccaacttccttactgccaccataaattatacgtataaaaaacaaattagcatctatagttaataattgcaatccctgcataatgcatggttaattatgtgcaacatttgtctaatcctaaatttctttaacatattgtaaccaattagttagctaacacaaatctcatcagtaaaatatatccttacattagaaaaaataaataaaaagtgaggggggctatggcccccaacccaattcatgggtccgcctccatctctcaataataatttcttcatatatttcctaatatgcatatgatatataaaagtatttaatttacccgaactatatttaattatataaactttttatttaatttaatgtataaacttatggttacaattttgaatgggctctctcctatactgtgtattgaaatagctacattaaggacattttaagtattcaatttaaagtaattaaggacattttaaatagctaataaattaaacttaacaatgaacgcttgaaaaaaaaaacattaaggacattttaaatagctgtttgatatataccgacactcttgatccgtatgataattattgtaagacaaatttataaaatacttggtttgaatgctggtaacatcccaaaaaaaatagttgtatggtcattttttctaacttttcctgttatttatcttcttattttttttaatctagagcatttcttgttatggaggtgaatatgaatgactcaacatacagatatatatttaagaaattaatattaaaatagttaaaaaaaaacacacaattatctgtaaagcgtattatacataatacatgttgttacggaacccggtcactacatgatcccgttttatgcttgtggagctaatagtgtttctattcagccccgagtagtatgaatcaaacagtagaaaggacaattacgatgagataaggttatcggaatattagctacggattcaaccaaatcgtcattaagtttttcactaatacaacaaattaaggccacgtttaatgggggcatgcatgactttacacattaccctgcacagggattatgcaacgggtctatatccatgtgctgtttatgtaacacgtgataattaaagttcattgcagttgtatttttttttttataatcatgccatagttaatttattaaaataagtacacttattgaaagatattgtaacagtaaaaaggtagacgtctgacaaattttaaattactagtatttatttaatagtaaagtaacaaattttttttcctgtgatattaccctagaaaataagtaaaaatgtgtgaaagaattgtgctaattaggaatgttataggttttttctgtgatatctccataaattagaagagaccaactaagctaacaatttgattctatatttgaatttaaaacatccaaagagaatcatcttgattttgtgacttgggtctttaatttcttaactaaaaattaatgttccgttgctcgaatcagttaactttgaacatattctcaaaatgtcactaaaagtaggattttattagtattttgttttttgctggtacaattcattaagtattttattgatcttgttctccaaaagattatataaattactgaagtaaaactacaatttcaattaaaaaaacacacacaaataattaacatctaatcaggatttgtatctaagttttgtcctacaacaaactgcaaaattaatgaactttctggcacgatgtctagccaacacaattttatgtttgtttaaaaggtttaacttttcttttggtggtataaaattggatagggatcttctcctgttagagttttaaaatcagatgtcctgttaaactaatctcaaggatggaaattaaaacacttgaaacttaccgtttcattaaccaattaaagcaatacccgagagagcttgaagtaccacggcattcactgttagggtgttctagcagggaagatatcaagtctgcagaatgggaattttcgaactgatgctgtcagaaatacccgagaatcactctctcctgttaacaaggtgtgataaaattctcatgttaacaagcacttttattaaagactaggtgtttctgttttaaatttttgcgaattgattttaaaatgttgaatatgattatgtacaaaaattaatttgaatcaaaatattatattaatatgtgtgttatgatgtatggaatttatttgaaataaaatcaaactcccgttttaaaaaatatcattgttaatgattagcatttcctaataaccattattattaaatttacttgacctgtacgataacttagaaaacaaaaagacttattttctggagttttaaatatgaaaatatcttatttgcaagggaagtagtgtgttattcagacgctacattgagagatggaaagcacaaacaaggggaacaaatgtgcagtaatgaccaaaagaaaaaataaataaaggcatgcaatgtgaggtcccatgccttataaggcccatgtttcctgcacctcatataattttgaggatattggtccccaaagtataattcaataataaattaatcctaaaagatgaaaaatataaattaaatttttaaacgtacaaaaattatgataaattaattattccattaaatttgtgagatattttttcattaagttataatattcaggattaatttgacaataaattatatttttggaccaatttaatattatgttataaagttttaggaactaatttattaataaattgtttgttgtactaatttgtttatgtatattcagaaattaaatttgaatttttcatcttgtaatgaccaatttgtggatgcctagtacttttgggacaaatttgattatttattcttttaattaaaactgaaaatttcaaaaatatccggtgccactttttcttcttatttgcacagcgtaatctcattttcttcgtgcaaaaataccctgtgacagccaccaccctagccacttttttgttcgtccatatatattcaagatttctcacatctcggcctcattatttgttgagatccggatcagagaatccgtaagtgtttgtgtttattccggactgtgcgttccgtaacatggaggtgcatgccgaaattggtgaggtgcaggaagcaacgaccccattctaaacggggttaagtccaattagacaaggaaaatgcatcatcgaccacaagaaagaggtggtggtgggggcgatggaaactatgctcacaagtgacagagtagaaccaaaagattttagtaataactaacataagaaactaggtgaacgtaactgcacagacacaactactacataaatcttccttaatttctccgcccacttccctcctataaataaatctttcatcctctctcttctcttcatttcatttccatctttcttgggtgatccaatggcgacccttttccagggattgggagttgtgaacccatcattgtcttcttccaactccaacaatttcctgcttccttctcgtacttccctctcaggtttgcttcttaaatttctttcctttttattttttccttcaaattgcttattgagattttagtttcattctgtgtgcgataattgattggttcagagaggaaagatagcatatttgtagtcagatctgatgcaagggtaagcagccaggttctgaaggctggagctcgtaagcatgaattgttggttactaatgcagttgcagtaagttatctcatgactctcattccattcccttccctttttttgcagtttggtttgggatcaatgttgtcatcatgtttgtaatttgtgtttcttggttgtttatagacaaaggaaggcagttctgcggcttctacttcaaaatctgggtatgtctctttttgtaatcacttgctagttgctttttgtatttccatgttattcaaatttaagcattttaatttttttttaatgtgagatgaagctatgctgatatgttcaggttgttttctcttttgctgattgattgacttgattttagttaaaaactgtaaaccaatggttatgtttcacttttcctaatttggtattgtctacaaacaattggcctatggttggatgggtactggaaatgacaatgcatttcaacataatagaatctgcatacctttgcaatttcatatttttccttattcattccaattaagcataggtttagagtgtgtttggtatactatacatgcaaatggaagcatggtaaagaggagaaagtcaaaacagtgaaacttagcctaaattcccgtatttatggatgagtgaatagtgtggggaactggctgccgcttcatcccatcatcagcacatctttaccctttgataaatgagataaaagtaggtccagattgtagttataatgtaattagtttatttagtttatgttctgatttgtttataaatgcttcttgaaagtacaaaatgatgctgcacaattttattcctttccctttatgctcttaattttgtgatgaataagaggacatattccatcagaaaacaatacggcactgaagcaaaagaacagacatgctctatagaattgactatacaaacctttccctgtatgccgtattactgaagacatcctattcctatgtgttaaaatatctagaggatttctcataatccatatcaaataggaaacaaatatgaaaaccactcgaaagagattatcctagatactttaagatattctatgataatgatgttatgagatgtatcctagatattgttacatgtttatgtcaaacctttcatgtgcttcacccagcaacataagcttttggggcaattacatgatatcaaaacttctttgcaagtgacgagtttgattcttttttctaagtataatttaattttcagtgcaaggtagggtggccagctttgaacaatatcattcacgtgttcttacccaatattttaagcttttggaatagttgtgtacttgtcactttacaattccttgtaaggcaacaactcgttgtcccatgatacccacaatacttcttattcttgctaagattagtaacaatatccatacaatgtttatctttgttcttaagagtcaagagtcttaccctttttctttcactataccaaatgtccataaaaggtaatcaaattataaggcgccacctctcagttgagagacaggttttgacttaccaaaactaggaactgacaaacaaaaataaaaagaaatgagatagacgaaaaaatagtctggactcccttatttaaggaccaaaacagataagaatgcaacaaaggattatattttagatagattaatggatgaacagcctcaaaaaaagattgtttgtgattggtggtcccttgatgtggtacttcaaaacttttgtgtagaaagccttaggaaaactccttgtagagtgtagaccaaggatcagattaccttgttacggtcaaaatttagggatgacaacttctttaggtctgaaagaatattgcagtaacaaaaaagagttaaggtgacgatggttgaaaactttcaggatgttatagtgacatgtaattcagagttgctaaaaaacatttttttttgtttgctattggctgcactgattgtgagttatgaccaatgatgatggaattaactacatatgcattttatttttaggcatgaacttctcctttttgaggccctacgtgaaggtttggaagaagaaatggagagggatccttgtgtatgtgtcatgggcgaagatgtaggtcactatggaggatcctacaaggtgactaaaggccttgccacaaagtttggggaccttagagttttggacacacctattgctgagaactccttcacaggcatgggcattggggctgccatgactggtctgaggccagttgttgagggcatgaacatgggatttctacttctggcatttaaccagatctctaacaattgtggcatgctccattacacatctggaggccagtttaagataccaattgtcatccgtggacctggtggagttgggcggcaacttggagcagagcactcgcagcgattggagtcatattttcagtcaatccctggaatccagatggtggcttgctcaaccccttacaatgccaagggcttgatgaaagctgcaatccggagtgagaaccctgtgattcttttcgagcatgttttgctttataatctcaaggagagaattccagatgaagagtatgtattgtcacttgaagaagctgagatggttaggcctggggaacatgttacaatattaacgtattccagaatgaggtatcatgtcatgcaagctgctaagacactggtgaacaaggggtatgaccctgaagtaattgatatcaggtctttgaaaccatttgatcttcacgcaattgggaactcggtgaagaagacacatcgtgtcctaattgtggaagagtgtatgaggacgggtggaattggtgctagtttgactgctgctattactgaaaatttccatgactatttggatgcccctatagtatgtttatcctctcaggatgtgccaactccttatgctggcacattggaggaatggacagtggttcaacctgctcaaattgtgactgcagttgagcagctctgcaagtgattgctacaaagcactagcaattaggatatggtttttggtaaagctattgtgcttgttaaattaagcttgaattttcatcatgattttctcttttccttttatttctgaagtctaaagcccataactttaaattgttctattttcgatttatcattgggttcatctaccaccgaccccaattaatttgggttaaaggtgctgttgatgttgatgttgatgttgatttagaactttagaactgccaacccaatccaaatctttctctgcttgttcatctgcatcatttgtgtggtgtgtgtaagagttaggcaaagccttataactagcgagatatttgtagtcagtgctgaactgctgaagccagcaaatatctgttacagattttgaatatgctattcaatcctagtgttaggcttctgagttctcgtgttctaattggaagttttcgtgtcagtttcatatatatagtttagttagtaatagccgtgggattgcactactgctaaatattcacctgcacggaacagctgaaatttttgtattcacctaatatctttgtaatttaatgcctatacattgtcagttagtcaatcacaaataaccgtttaaattactttaagataattattttaaacatcaataacttatcatacatgggattgtaaccggatgactgtaaaacttttacattgtcaatgcatattcttctttctcatatctttatgcatatttatcatcttgacgataacatttgaggaaatttggtatatgttattaagcttcaatttttcttactattgctgcaactactaacttttagcacttcatctggtatacgtgcatgagaattttatcgtccaatgtactaaattcctattacatagcagctcaatgctccccaccaatgacaaaataaaacaatcattgaagaacacgagttgtgttagaattaagggacttttctgtgaacatggtaatgtaattgtatgccaggttgtctcaaagcccatatgtttttggtattgactatagaccatagatattttctggtataaataattttgtttgaagcaggtagaactattatgaataacaaatttttttctgtgtatttaaagtggcttagaacccgaattggtgatctctaattaagctagaagatattgtatgtctgataacgttttgtgttttcttcgagaaggctattgaacttgacagcttttataggaatactgtaacaaaatgcgttgttgggttttgaaagtcattgatcattttgtaagtggagggtgaccgggggatccttccacattgagttacacgctttctctagttctctaattagttgtcaagtagggataacaatgggtatgatcccacggtatatgttttcatatccccattttaaacaaatctccatatttggtcacatatatgtgtggatactaattttaattttcatctccatacccgttatatatctataaacacattcgcattcacaacccgcattttagttatacataaagttaataaatcaataaaaaaaattagttaaaccaattactacaactaaattaaaaatacagtcttaaatttaaaaaatataacattaaaaacattcatacttaatattaaaaacaaacaagcatagattagtttaaattcaggttataaataagtaacattacaaagataatcatctaatatagtaattcttaaagttaatattctaataacttaacaaaaactctaattaaacttggatgttatgtagtgacagaaactctttaagatctgacaaaaaagaatatattgaaactaattaacttataatcatatactataaaatttatataaaaaacacaaatgaataagatatttgacctcatcatcataatcaacttctccatattttttcaaacatttatctcctaagtctatatattgctttggtccactaataacaatagaaactagaacattacaagaagacaagagattagactatcaaaacaataattaaaactatcaataaaagattagtcacaaataaatgaattagatttagagtttcactccactattctaaatctctattactatcagagtattagttacaaaattttaaaaaatacattattattttttcacaaaagatattatatatatatatatatatatatatatatatatatatgacatatgcaagacaagacgagatgagtattataatacctgcacccgcatccatacctgcataaatttgcgaataaatattcgtccctgtatacaatcacaatatgtggatagttatccttcacacttatggatatttttatggataattatcaatcagtaaagtggaaccttgaatcagaatcaagcttcaatgtttttgcctttcctttccttttgtagtataaaaaatttaaatataagacatgtgaaccaaaactatgaaaaccatttctaagaatgaggggaaagtacgtagatagttaactgtatattttgggaaatgtcttattgtatgtggcaattaattatttgactgaagtactgagagttggcccaactttgatgaggttttgttaccacttgttgctactttaattgaatatcagatcattagatttggaataataatctcatcaaacaattgttataacatagtagttagaaagaagccttggggtgtcaaagctatattttacttgaaaagtacctttgcaatgggcatcgttgaacaacgttatataaagagttaacatatcaattctttacgcacaaaagtttgaagcccatgttcagtccaagttctggaggcctacatggcctatgggctttgatatagatgatgcacttcaatgataagctatgtgattgtgatttgcgattgggaggtaattgaggaagagtaataattctttcttatgtagcctgagcctccatcaaaggatcaaaattaaatttttttttatctttaaaattttaattttgcttctagtattttactatgcatgtcttttaatgaaagctattacttatccttgggcttctaaaaagtggttcatcttattaaggtgtactatattatataatattaattagaatcatttttggataacatcattttatattaaattaaagaaatgatactgaaataatatgattttaaaatccgtgaaccatgcaatatagtttggtttagactgcacatcattttatgttaattccatttgtgattcctctcaaagttaaaaataaaaataaaaatagtattagtaaaattttacctgaatactgagtcgttttttttacataattcgcttagaaattgtcaaaatgatttaattccgtataaacactatatatataatggtgctttctattatgttgatctaggttaagtgagcctcaggcctagggtttatttatggcacacatgtacataacttattctgctctgctttcaataataataataatattcttattatcattattattattatattgacatgacaactgagattattattattattgtgattattttgggcaaaaagtgcctgaaactacagacttaaaaagcttcctgtgtgactagagcaatagtgacaactaagctgatgaggtttgattacaattaatgtttctaaacatttgtatgcagccacacaaattggttttcttttattttgtagtgcactttgagtcaaattcaaagggatatgtttttcttttactttttttttggtttaaaaaataaaaatcagcgtaaaaagaaggcaaataaatttgtacaaagaagaaaaaaaatatcctggaaattgtacgttattatatatattcttcatatcttctcctcctgtcggggtttctcttataaagaattggttttcttgtttctttggtggcactgatcgatcaatatatagtccttttattaattttttgacatccaacaaactgaattccaacacaaaagggaggacatgaaaataattctttttaacctacatgtgaaaagtacattgataaataatacattgcagcgaaaacctgagtctgaatcgagggcatggccgagacatgctgaaacatgttgtcgtggattttgtaaatgtgcatgcatgtggtctaaatataattggagcattgctggttattaaatatacaactgggccaaaataattaatatgcatgacacatcagggtcttggtggtctattaatcaactgaaatagtagttaatatcttgaagccaaagatggctacccttttccattttattggcaactgctttctgctaggtgggcattcaaatctaaccatgtggaaaaaatgatggaataatatcatgatgtgatttgagttgtagcagtataggtttggttttgatatgtctttttggataaatttttaatattcatattatcaatgaagcatcattttctggcaattgtgtgttccattctgggccacaagtatcgcttaacaggtaaatagtctcactccacaatatgatctttggagattctcgtcttggaattggaattcaatctcctcgcaaagaaacaaaaaggaattggatttgaatctagttacttagattacaaatgtttctataccgtggttttctgtggaattcatgttctgaattctccaagtggaatttcccccccttctttttttaaaagcatttgcacaactaggctaaaactgaagtaaaatatatagcattgtgatatgcaatatctatcagtaggtgcagaatattaaatactcaaaaaaaaaaaatggatcaaatttcatttaattttcgcggctccaaacatgcttcatgatgtgtttaggtccatgaccacattcaccaccatattaaaagaatctgcttatcaagcatttattcagttacatgcgtagaatgacatgctggcgcgggcagcaacagaatttcgacctagatctttgtaggtaacttttcctaacgttattatatatgtagccaagcgagttaaggaaaatatataataagaaaggtgagacaaagttaatctaataaattttggccacacaatcatacatgaatagtgaaaatcatttcctccctctctcaatatatatgtatttagtgagaaaacttttttttatgagaatgaaaaaaataatattaattattaagttttatcatgaatttgacaaaattaaatatttaacttttctaattgattatctgatttcctttttgaaaattttatcatttatatatattctcattttaaaattatacgagaactataaactaagtcatacaaccataatggttatgataattaaaatgtactagtaattagtactcacataactatttaaaacagttaagtagtgtagttatcttttaatctcgatattttgagtgttagtgaaacgggattatatgcgttcctattgatctgcccaatttttttataggaacaatttttgtgaatccaacccaatttaattaagacatgataaatatgagattagactacgtgtttggcatcatatattaatcttaacggtatatatagttaaattataaaattaaagaagtatagattacaatatatattttatgataaataatatcaatataaatataacattattttagacaaatataatttattaagttaagaagatatataattaatacataattattttaaaaaatatattcttaaaaagaatatatgacatatacattgagttgggacgtcccaaaataaaagtcgaactctcgtccttaaaatacattaggtctaatttcttatattcgaaatcatcaaaagttccttctaactaatttgaatcattaacaccttcatcttgataattaaaatataatctaataatttttatctattgttttttctcacattaacaagatttttcactcgatatgttctctaaattaatcttaattaacgagggtgtgtgggcttagaacccctccctgcttggctttgaacttctcttataatgagctcgtaaatggttatgttcttaaaaatcttgagtttagtcattaagcggaattagataaattggtgcaactattcacttcacatatgcaacataatgtatcttgctcatcaatcatcttcactatatgaagttatcatgaaatagttttgcacgtgccttctaatagcaagggtaatgatacagtgttgttgattcgcaaaagttaacacgcgttactagatttatcatgtacgtaactttcatataaaataataatgaaattaacggcttccaacataaaatcctttcagatatgatttgtctcccttcttgtcctagtgcggctcgaaagttaatcagtctcttcatgtggaaaacatgtgtggttctatctaacattcatgttgatgcattatcatttctcaagcaaattatcaaaatccggtctttcattgtttcatataacttccatttactcatggtgtaacaccccggacgtgttatcattaataatatcataagtgcgctatcagcgttatctaaatgcggtgcggaagcgatagaatcgattttcttgattacattatgcatggaatataaaacataacacaaagcatcataaacaagcctctgaggatccagttaactcaaacataaaacaacataggcagagaacatataagtctaaacagagataatcaggaggaaacataattcatacatatacatagcctgtacatatacatacaactcatagttctaccacatctgtggttatacaacataaatatgtacagataacgggtgtacgctcacaccctatactatacagaatacaagacagagataaaaataaaagctcttctaatcttcatctgcagcccatgatcactccagcaccctcagctagggcctcctgccctgtagtaacttctctcctctagaagtacctgaaaaccacaaactccacacagggtgagacagacatctcagtaaactcagggttttgggagatcctctctttccctggtccacccccacgcacacacacaaacagataacagagctaaggacaccatcccagctcacaacataaagcctaggaccttagcctagctttcacacaatcccagctgtctgggtcatcaactgatgatctcagcatcagaggtatcccacctcatactggctctcaagccatctcagactagtctcacaaaggtacataacataagtgtcaaccactagacacttctcataccagagaggcaccgcctcctgaaccatataaaccatgcctgaggactctcactcaggactttactcatccagatatggcttatctaagaggctctaggctctcatcccctcgggaagccctctcttagagatgcaacatatctgtctgttgcctggcctctccaggactttcataacacatgcctgggcaagaacatccatatgggcaatcaactccaggactttcacagcacatgcctgagagagatcatctcacaacggaggcactcgatcactcaggacttcatatcacatgcctgagagagatcatctcacacaggaggcactcgatcccttaggactttccactgcctgtgagagactatccactcagggagctttcaatcccacaggacttccaatcacggtctgagagagactatccactccgggagctctcaatccctcagactatcaagccgccacctgagagagactatccacacagggagctctcaatccctcaggactttaacatacactggcctgggaaagaacctcctttacagggcaatcacatccaggacttatcaacatcatggcctaaggaggaacatccatatagggcaatccatccttaggactttaggcggagagcagtggcacctcccatggaatctcagctattccaaggagtcctcaaactcttcctctggctagggaacctcaactagcccgatactagtctagtatcctgtagattccatcactgaccatctcatgatcttcatctcaatcacagaaaactctcacagtgttcatcaatctcgaggcccaaggccccacacctgaaccacaggtgtcaaaacaccctcacaccatctcggtgtctatcctagggttcatcatatattcatatatctcaaacggtctgagtatcccaccaagatccgttcatctagcccttcgggcttcaattacatactaatatcaataacaggccttattggcctttcattctacagcatgcatataacatatataatctaacatagcatgcatcaatcacccgcttgagtggcaaacaagaaaaatggactgatccccagagcgatgagcttacctgatagttgtgcctgcaacaccaacctctgaaacaatggtctgctcctctgacacctcgtgtcaagccctatcaaggcaaccaaatgcatatcacagaccattcaagcacagaataactataagctcatcaggcagtccttaactgtctcagagaaaggaacctcggtccttatcatcaacccaagttatctaacttaaggtttctcaggctcatcctctacaagcctttccatagaccctcaatggtctattacagatcaccacagactcaacacaagccaacaacagtgagcatcaaagctctctcaacccacactctcagggtttctcagagcttggacggtctatctcgccagacaccgtctccatggcctatcaggcatctcaagcccatcacaaaggctcttgcatgtctcaaatcaagtgactcagtccaagtcacacaagcacaacctagagccaaaaccaacattcgccaaatcacaaactgaaagctaatcctttctcctctcatcaatctaaacacttctctcaactagaccaagagctaattctagttctatcacatatgggtcactattcacaggaaacccccaaatccaaaatcaatcggagaaactcgagtttcttacctcagaactgatgaggaaggcctctgtgctactctccctagccttggtgccgtggaaacaccgccgttcctcgtccaactcgagctctacaacctctttctgagaaagggcttttttggggtttcaaggagaatggaagaaggattttagctaaaacttggtttatgagagttttgataggcttaggaaatgttttgggccataaaacatagtcatggaagcttgggaacctcagccatggaggttgggacgctggaggaagaaggataagagagaaatgctaagattttcgcgttttgggccttttataggctcagacgtgactcccacgcctccagcgtgggctggcagagaaataacatttctgggctgcttcccacgccccaggcgtggactccacgccccaagcgtgagactccagaggaaattgattttctgagttgtttcccacgtccctggcgtggacccccacgccccaagcgtggaacctcagaaaaccaaaaaaataaaactttaaacgcatggttataacacatggtgcccattgctccaatgtggttctgatgacttgtcgttttcaaaatgtaatcaaagcaattcgattggtcttatcatgcattcatgcgtagacagattttgagtatatttgacacattcaaatgaaatacaaaaagaaagtgcaacattaagagctcattactcatcagatttagtttgcaggttaaccaaccagttcatagacttgaacagtttacttaaaaaatatattattatacactatgtcctttcctttttaaccgtctttgtcttttaaaattgttatgtaaaaatcaagaaatgtaataaatcacttacaagtggttatatgcataaatcactcagcagaaaatagccgatcctatccaacaaattgttctgggtctgtctacagctaggtaatatagtttcttgtctctatttttttaaaaataaaaaatggcaaaaaaagttggtaatcgttactatcggtatatgatattattcaagcatcggtaacaataagtctctagaagcatgcttcagacaaatctcaacgattttggctgcctagctagctttgcatcatgtggaagatttatggaatcatatcgcaagctggctttagatatttggataattaaattaatatatatattctgttccttgttacactcatcaactagagttaccatgtgctagctactttaattccctttgtcaatgaatctctgctaattggattcacaaattatccttagacaaaattgtcttttaagaaatttgtcatgaaaaaaacatggggtgtctaatactctaatttatgtctgatatcatggagtatctttctgtctaacaagctgtataccgaaatttataggatcagcacaggttctaaaaatatatatagggttagatgattaattaattaatatatactagttattttgtgccttgggggtaataactaaattcgttaaaaagtctacaacttcagtttatatttttttcccgtgtaaaaccaatggttgctcatggggaccattagttgtgtctgtgcatcacatggaaggcactgcacgggcatgttacactgggaaactatagttgatgcattgaaaggaacccgcaaccatctatgttttgatatagttgtgatcgatgactatttccttggtcgtgggatacacataattgaaatgttggctcttccaaagatagctagattgagtaccgtcaattgatatcattgtatttatttgtttgttttttggatataagcacaagaaaatggggaaattttgttgatgaaaaggataaacatgatatgacaaccaaacataagcgacgtgaaaacattggatggtgacccttgggagaaaggctcatcctgcaaattctaatcatcatatgcatgatttaagtaaaatatacctaacatgttaggaagcatgcaatccatagaaaggcttaattattcccatgatcattaaatagacttaacacagttgggaaatgcattaattttgagaaataactattttttaaaagatttttaagaaaataaacaaaatagtttttaaataaattataccaagaataaaacaagtttatttggcactttcttttacataatatctttccataatttttttccataatcatcactggtctctgaatacggcaaaatgttgaaaccaaaattcttatcaataggtatttttcattcacataaattttaaaattaaaccaataccctacgctcaaagaattaaaatacattttactcaggacaatatatatatatataaatatatatatatatatcagtagtcttaatcttaatattactttagttaattagctagggtggttgtagagaacaaatttaaattacatggactctgggtgaacttaagagccaactacttataaacacattaatgtaaaacatttaattaatgtaaaacatttaataacaggttgcatggagccaaccaaatttaattctacattccattagactgtggctcaacctttctttgatcgaagaggcaaactagctaacttcatgattgctgagatcgaatgcctgcctcctttctttacctaaatttttgtatgcaattaggtcatcctcagttgtcattcggcaattagctacatatccttgactcccactttacaggaacatttgagcttcaacacactacaactttctcttgtactttttatttatatttgttggatcagcaacgtaagatgagatatggtgcttacattagagaattactgtcatatgtgtttctcactatatatgaacgctggcgacctcgtaaataacatgtctcttatatgtttttattcaatcaggatatatattttgataattctaaaaaaaatgtattttttgagagagtatatggtgtcattttttttataaattagacttttttttttttactttaatattttagtaatgaagtataaggtatgaaccaacttgtgcattttgacctaccgtttcataagctaannnnnnnnnnnnnnagtacaaagaatactctaatccttaaaaaaaaaaaaaaaacactatctttcagccaatagaagacatgatacattgaattggacagctagctacaccatgcatgtagaaaaataaagtctaggaatttcaaattagcaaataaaacctaaccttaatcaagtaaaaaatgtaaacaaaatcaataaaacaatctctttaaaaaatacattaattctcaacaacaaaaggctcaaaactgtagaatgctagaacaccacaccatccaatcctttctttctttttttctttttcttttctttaccttagttagaacctctaaataatcctctatatgttgattaatataatattcatcaggggcactggctatactttgtatgtggacctatatatttgatttttaattcaagatcgcttaaccgtagcaagagcacgaaaaattgagctttcttatatactttgtatctggacctatttgattttaacttgatcccacgaacatatggttttaattttggtttatactcattattattagttttataaattaacctttattatgaagggtaattaattacgctgaatgtactgcatacgaattgcataaatgatagtatacgtgtatatctaaactgcaggacacgtgcatgttatgtgcaatgtccgcttgttttcactctccaaagcacgggactatcggttctgcaacgtagcaaaggcaaaatcctgccagctacgagctaataaacgtttgcatgcatgcaagtgaattaccaatgggctgaatttaaaacgttacttgaacacactagagtacaacaccgtttacttcaggattttttttttcaagaagttaaaaaaaatagtaatggaattatgtttaattagctttaattaatattatatttattggaaattaagccagaatattttctttacaaataattttggaggcatcgtttctgaaaataatggcacaaaatattttcagtaatggatttctcttcttgttccttcattatttagttccgtttctttttcctgtcaagtatatcctccaatatcctttaaatttgcctttcaaatcaacttacccttcaaccaggttttcttgcatacagtgcgttccgatcttgaaccgtccccaagaatatcggttggaaaattatgtatgggacactattatatactagtcgatatttaatgacaagaaaagaaaagataggaaagtgtgataaatgttactactataatttagaaaaaatatagatattaataaatgttataatgttaaaatgttcacatatatagtagtaattatccatttcggtttcagtttaagttactttttgctaatggcagttgactcttcaataaatctattgactcaaagtatgtgtcattttgtataatcatttgtcagttaaagtggaacaactataacatcttataaaggatgtatttggtttaaaaaataaaaatgaaaaagataaatttgaattaaaataaaatgtaaaagatgtggatttcataaataaataaaaaaaaactatttttcttcaatatttaggagactttcaattttcttcaccgcagggaagcctctagaacattccgtagtggatgatgacacaagcatgagaaagcggtgccatatatttatatattttagaaatagaaaataggaagtaatcaaatatttttaaataaatttaatttaaaaatatattaacagtgtaaaaaacataatatcgaaaatgataaacataaattaaaggtgttggaaacaccaggaaaattaatgtgactaaacttaagggcatataatagaatgcaagaagctggataactgtgacgactgtgccaaagatgaagggatgatgtggataattaagatgagaatgatttaggtgatgaaaaaggtggtagttcattagttcgtagacattatcatcatttagctatgcaacagaatcatcccgtgtaaatatattcctgtactctatgaaaaaataagattgtcgacacaaccaaacatatcatcataatgtgtcttatccttaataactaatatataagtatcctcctatctcaaactcataactgataggtaactatttatctcactaactcatgtacaccaatattataaataagagggatacagcaggtaacggtatcttctaactatataaattatttatttattaacttaagcgttagaggaattttacaaataccacatggctaggagcagcttagctgttacaccttggtggaagtgctttaactcaaaatgttaaaaaaaataaaatataatgaaaaattataagactgacgtaattgaaaatttcaaacaaatttttatgtgaccccaataccacattggacaagatatttacccgttaagccaacttccttggcatataatattattttacaccagttaattatctaaaccctataacaaattttgtttcttatgcatgtataaccaatgggataaagcacttaatgggatggatgagactttattataattactaatattatttgaccgaccagagtgtgcaacttttggacattctttttagttaatataatccttggtgtttcgtcaatgccccttaatccaaggtacatataatatttacaaagttatgcattgacttcagagtttaatgtgttaatgatataaaataattttatattattatttaattataaattattgttaatatgatttacaagataattttattagagttaataaatttatcatgaataattatttttttattaattgatagcgtaaaataattttatattattaattattaatctttttatcttgatatagaaaataaattatttattaactatttaactagtcgaggacacttttcttctaattatccttagaagaaaatattaaagttaaaaatcagcctagctaccaaccattggacgtgtgatatgtctttttggacaattaattttaaaagtatttttaaatctattatatagaaatcaatctaaaatgtcgtattactaaaatctcatcatcttacatatcacatccattgtctactatccgatataagtttctaaagtaaaaaacgtttttttaagaagtgttggtgtatataattaagataaaactgaataagataaaactttagattaacgtggtaagtgagaacaaaggcagtagcatagcatcccatcaaaatcaacttgtctcggaaaggatcaaggaaaagcacaagaataacaatgagtgaaaatttggctttttggggtccatcattgaagaggtcttttaggcagcattagaagaaaatacgactttctttgactacaaacctacgataaaggcaagtgggacttcttgtccccattgtcttctgtcattagacatgtaactttcaatgtcttaataaaccttttgcaaagttatggccaatattgcttcttcggcaaaatgaataataagtttattttaattataatagaatagatgtaacaaataatattattaatactacattgtcaccattttcctcttgcttctgcagcatatatgctctctaattattgtcagaaagagtcacgttttgatgcgttttttttctttttttctttttccattttcttacaaacattttgatgctattgaaacacgaactttttgtgtggtaaagatcacgcttaaagggagggaatcttgacaaataaaatttacctaattcaaacaagcagacaaacaatatttaagactttgtggttttgtaactttctccaaatacgtactagcatatggaagaaattggaaaatgatatgcagaaagcattggtaaaatttttcttattaattaatccagtgaagataattaaaataatcaaagtaatgtagggtttgctggtgtttgtttttctttcatggaagagatatgatattttaacttttttaggacactttagttttagacgaaacatcaactacaatagaaggatgaagacagaagaaggaaaatgtgagagcaaagttataataaagaagtgtagtttgagggtattaaaattttaggggatggcattaaaaatggagatgcaggaaacaattgtctcgatgacctctaaaatgaaattcaagtctaataaaagtctaatttttaaagcttttgatggattttgcaagctaaacctgtatcggactattttttaatcttaattttatnnnnnnnnnnnnnnnnnnnnnnnnnnnnnnnnnnnnnnnnnnnnnnnnnnnnnatatatatatatatatatatatatatatatatatatatatatattaaatccctagtttaaatgttgttcctttatttcctgaatttaatgaaatggaaaaatggtccttcaatttgtaacctgttttgtcaagttagtcattctgttaagtattatgttttaactttaacaaaacatcatattacaatccacgtgtgttaggactattttgaagagtttaagggttagatgggaaaagttgtaaaccatcatgttagtctttgaattttttttggtctcttcttttatgaaacccttctttatttcttacgtgtttaagggaaggttaagtcacaatcttagtaatatttcttagcgcatccacattggaacaacttataatagttacttccaatgagacccgtgtatacatattatttatttttattttttctaatacaagtaactttaaataacaaatttttacagtgaagtaattctctttagttcttctaatgggttccactaataatacatttatttcaaggtaatgttttatgagtgacaagcaacttaaaataattatatatatatatatatatttttattttattaatttaataatgtaaagcaatgttgctttagctagcaattgtaccaaggaagcaacccgtccgtacgcgactacaaaggtagttgcttttgtagcaatattgctttcagtatcctatcacttcccaaccatgtgatggccttagttttatgatacaatgtcaacatgtgatatttttttaagaaattctaaattcctcaaataatttttatttatttggcttaaaatgaactttaggggacaaaaatatagtatgatttcaatatttggagtgtttatgatacaatgtcaacatgtgatatttttttaagaaattctaaattcctcaaataaattttatttatttgccttaaaatgaactttaggggacaaaaatatagtatgatttcaatatttggagtgtttatgatacaatgccaacatgtgatatttttttaagaaattctaaattcctcaaataaactttatttatttgccttaaaatgaactttaggggacaaaaatatagtatgatttcaacatttggaggggattaaaatcaaggaaaaatgtcttacaaggtctaaaatcaaaattgataaaaaataatttttaattttataagatgaaaaacaatgaaaacattttataggaaccaagatcaaaactcactttttataaagattaaaaatatatttaataaagtggtggtaaaattgagttgaatatactaatattaaatattaatagaaaaattaaccttacagtgcgtgacgtaaattggtccccgtctagtgatgtaatcacgtagcttaacacgtgggctaccaggttttgaccaccgtatagttcatattcataggttagattttcaagttaacaaatcgcaaattcgcaataatccatatgattaatttagtagtaatccagtatcagttttaaaataagtgtcaaaccaatcttttaagtaattggataatcatacactgccacagtaccacttaagaagagcataaaaggaaacgaaactaaccgctcgtttatattaaatgttgcaataatagattatgcagttgggtacagacaatctaattgcttacaaagttgtttagactcacttaaacattgattcatgagataaaatgagatgataagcggttagttgacgttccaaatgcagacaacactttgacggatgacaaaggactcagaaagacaacaagtatatgattctgttcattcagaaacattttttttctctcaattttatagaaatattttttataaaagaataaaatcgtgaggaagaataaaaatggactgcagaacagatcaaattgcagaagcaaaagccaaacagaaagtgaattatttcttttaaataaattaaatttatatatttctattagaaagaaagaaagagaaagcagctgagcttacatggtccaaagctacaagctgattcccgaaagcatgtttatgtttattcacccacactggctcgctcactacaaacaaggtaaggtagaaaaggcacataataatatgaacatagcaagaaaatgtttgttaaaaaaaatctgaaatccttttaatgaaaagtggagctggagtcactggggcaaatccttagcctccacaaaggtgccgtgaaagccatagggcactctggaaggcagcatgatggtggcctccaacttcaaatcaacggcattcagaatctgcaactcggactgccacgtcacctcgtcatgcacaaaagccatcacgtacccttcatcctcattcccattccctccactgggcaaaaagaatggctctcctccgaaccttctctctccgtactcgtgcctcttcacttccccactctccaggtccaccttcgcgaaacccgacaccttcggccacggttccgccatgcacaagtacgcgaaccgggtttttctccccagccggttccggttcaccatccccgcctcaaggttcatttcctcaaccaccactcgccgcgtcgacttcccgcttctcaggttaagccttatttctgttaacacgcttttcagactctcttcggtgtcgttgaagattgaatccggtggcgtcatgcaggaaccaattaccactacttcgtctgtgtcgcgttcctcccacgcgttccagaagtggaagaagaacgtgtctggcgactccacccacacgatcctcgacgcgtcggaggcgtacttcggaagaattccgaaccgcgatttcttctcgccgtcatagatcaccggcgagcctccttttatcatttcgccgagcttgaacaccacctgctggtccgggatcacgacgaaattctcggtgatcgcgaagtcgtgcgtcatcgtcggagcgccgagtgggatttccacgtccggcgacttcttctcctcctccgccgagaaacggaagtatttgaggtacttgctcgtgacgtcgtagcttagagtgaaaagctcgccggagattggatccaccttcggatgcgcgatcatggaggaattgagctggtcgtggaagctgtagcggccgatcgtttccaggtcgccggaggcggtgatttggagctcgtaggggaggtcgtcctccgacatggcgaggagttttccgttgaagaagaccaggccggcgttggcggcgccggcgccattgcggtggtcgacgatgccgcacaagcctctcgcgtagaacagcatcagcctcgcgatgccggaatggccatggagctcgccgattgctttcggaaacaccggttttcccaattcgcgctcctgcatgagacgctgcgtttcggtgaagcggcaggcgtagctggcggtgccgtgattgattttaacggcgtggaccattccgtcgccgtcgaagaggtggtgaccggctttgggatggaacaatgggttggcgccgttacggagataaacgccgttaactgcgtctgggattgtgccaataacggggagggaatgttggacggggtgttccggaacgggggcgaagttaccggcaatttggacgcgtgggtcagtggttttggggaggggttggttgagctcgcgtgagagcaacgcgctctcgaacatgtccagggccttggctgcggctttttggaatgggttccactgaggcctttccgcggggagggaggtgggttctttggtaatttggggtattttggtgtagggttggtttggaaaatggatcactgggggggagtgtagagcacaatccaccacctttctaatgggcttcttctgaaatctaatggggaagcccaagtctgttaataataatgaatagaaagaggagaaggaggaggaggaagaagagagagggagagggaattgaggtttggcccaagtgcttgaattgagtgctgccatgatcatgatcatggagattgaatatcaagggggagggggagaagtgtggtttgaactttgatgtgtgtttttatttttattttattttattatatatattttatgagaaaaaagacaaggaaaggaaggcaaagagattgaaagtgaagaggggttttggagggggagaaagggagaaggaaaattgggtataaatagagtggggaaggggaaaataaaagaagtgttatttttaattttattttggggagggaaagggagtttgttttggaggtccacctcagacatgtaagagaagaccacgtggtggatttgtctgtgacttccaaattgtacgtgcgtgtggggaacctatcgcgacaccaaaacccttacgcaggcacaatgcagacttgattaagtcactcattcttatgagagatcaaattcaatcaactctccgggtattgaaatactacttcttcaaaggttattttcgtaaattcaattgcattcaaacaaattaataaatatatgcataaaaattattactaccatttaattacattcagttccagtaacaattgtgttggtgtttagattgagatttttatactaatatttattatttattccttattatcaccaattactttaaatatcacactgaattaatgattgagattattactaccatttatgtacaattaataaatttaaaataaaataattaatgattgattttaattacattcagttccagtaacaattattttggtatttagattgggatttttatacaaatttttatttatttagttatttcttattaaaattaaatgaattactttaaatatcacagtgtattaatcttcctacaactaaacttttggaatacaaaagtttatccaattgaaaaggaatcgttttacttcttaaaaacagaatatgtgagacgacatgcttaaaaaaaagtctcaatgaaattgcttttttttttagaagaatgaaattaatttttctacctctctgttaaaatattatatcaaataagataaaatttatatcttatcatgaagttttccaattatcatattatagtatgaaaaaattatatttataaagttggagttgattttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgtcagaaattaataatagatatttccaattagcatttatctgccaactaattttaaattagagtgattgctaattgaaacgtatagaatttgcatgtcatttagcattttttaattagcaccattagattataatcgggaccattcaaattatattatatatatagatatattacatcctaattttttctacattaaattttattgttcttcgtataatccctttatttatatttgagttaactatgtttttggtccctgaatttttttttgagtttttatttttagttcaaaaaaaattaacttatctcagtctgtcatgtttttcaaaatacatattccaaaataatttcaattaattaagtggaagattaagcaatgtttgaattaccgtaatttatttcttcatttgcatgtctataatagcctattgattgcgaatttctgtaattttccctacatcctagctttctcgaatataggcacagtagtgatcagagtcaaataaaaccggagaggcgcaatggtgcccataaaagtaagatgaaaatgagatacataggcacatgcagttaataagtactctttcatttcgtgtagtgcattttatttattttcatatatttcagtttatctgatagatcagttgttcatcgcgaatagggggggatcaagaagcgtaggaatatgtgtgctatttcttttcgaccacgtttcttagtcacatcattaataactgcatgctatagttagttacccaataatgcacagacactttaattgccatcgatcccactgtttcttccttctcctgatactttatacaaagctatggtgtggcccatgcaaatggattactacgtcttaatgtatctggccccctgctgttttcttcagctcagggacattcagaattccttaaccgaaactgtataattaccagtaggtatttaataattagggtggaaatcgttaaattactcaaattacactttattagaccaggatttaacttcttcttttttaaaaaaaatttaagatgcccgtactgataaaaaaaattaatataggagtcatatttatttattaaatatacacgtcttcttttaagatctaacggttttaaaactttattttgatatttttttaaaagtctaaactaatcttaaagtttatttcattaaaattttgcttgtaataaaatctttcaatagactaacaaacctatggatctaaatttatgtctaagctaatcagtttaatagactattaaatacataaactcaaaacagtatattataataataatattttatttatttaattttgcatgatagactttaattaaaaaaaatcttaaatgtgttagcatggctaatttgaataaataaacccttaaatatatctcaatttgacttacaaataaatttcatataacctagacctaatatgagctagctacgtcataggtttttgagtgacatatccctttctcatcccaaattattgaaattctcacaaaaaaatcccaaattatttgtatagaaggtatgatttattggaacgttcaattactttttgtgtatcattttcttacatctaggatttagttatacgtttatagtcttttataaaaatctccacccaaacctgcgagaatcatcaacattatgtgtaaacttctatgaaattaatttgttcgctaaaatcagcccctgattcgttaacattatttttcttttgatggaaatatttttgcatggccacagtctatcattaataaagttattataatgatctatgacatactcatcatcactttctcttcaaaaaaaatgacacactcacgtaaaaattgttattggtcctgacatggtgtgaaaggaaaccatcgtagtcgtagttagcgatggattcacgactcttcccacctcataattttattttccttaattgttttggttagaaaaactttaggagaaagaacgatacctcaatccaagggagcaaaaaccgtgaatgtaaatttaagaagggttattattttctctgagtaattatgagaaatacttttgcatggccacactctatcgataaatttcttattcaagggttatgaaaaattatgacaattaaaataaatttaagaaggaatacatttacttcaaaaaaaaaaagaagaatacatttacttgtattaaagtactccagactatactttcagtttcattttctctcttgttaataatttttgcgtaaatgttttttttagaatgctaaaaggaacataaaataaatccaagtgatttgtgtcctagaactagatatccagcttgttattgttgctgatcaaatcatatattgatattagttgagtccaagaattagattagtcatttgcatatgtttattagtgtagattttatttaacaggaattaaactattagaatagacatttcaagtctgtaataatatgattcacatataatacatattaaatcttattaataaggacaataacaactagcttttagtatataataaatatttctttttagtactgatatggcgtaatatcaaataattttggttaagaagtcaatatcaggccttgcctgccaaattatccgttacataattaattcaaaaaattttgatatacaacaaaacacgaatgaaagtaacaaaaacatgtatgttgaccttttagtagaggtcccccacaaatggtcgtgtataagtgtgtgaagaagcgaattcaagcggttgaattgaaagagagacgccattaatgccctcatatatataacggatggggcgggtaattggtttaattcccgttttggagttttgtgggcacatcctgttgaggattctggatgccattcaaggacaaattagccattggagccattttcaagggccattggacaaactagtatgatagcgaacaatgatatatgtatggctgttgccttaccacctttgtttcttcaagtttcctttcgaaaacgaaccccattcaactagatattgtagtgcacatggaatggaagacaccggcctctactttttattagctaggattgcaaatgctataccttgttgtctctagtattttgtttttgcttgtacaatttttcagatcgaatattactattctacagttggagtacttattagcttgttaagagggccacaacctactactacgtacctacaaattatagtataatagattttattaagaattgtgatatttcaacacctgcttatttcatatatcacatcaataattcttatttatttttataatttttatcacattatattatttattatatttatatttttcattctcttttaggtgtcaagtaggtcttgggtgtcaaaaatcttgttccttttactaaattaaaaagatgaatttcttttcttttctttttttctttacttcgttgtcatggaatatcagggaaattaatcgagaaggacacacttgacaaatgatgggtaactttgttcgcttcttatctgtgctaccaaaaagttagctcaaagtctgaaaatcttattgcgaacaaagtatccggagaaagctagctatctgattctctgattcgagaaacattttttcttctattttttatacataatttttcgtaagtatcttaactgctattgtgatgggcaggcaagtgtatcgtttgatacatttacaaatatttaagtatattataataaaacagcttaattcgtccatatttcatattgtcattttcgttagcaaattatcaagtgaagatatttctctgtccaatagcattctcggtataagaatatcttattgttaagaaatattcaacgtttttattttgatattttaaaaagaaacttgtctgttcttgcagttattgacaacaaaccataacaactgatcatactcaaagtgatttcgattgtttgattgatggtcactgactatataagcaagtaaaattcatttaaaagaaacgtaattggaattctgcaataccaggtctttccaaaggtgttcacacagttaataaactcgagaggataattaaataataatactacagtaacttatttatttgatgatttcataaaatttcttgtaatttaagagggagataccaagagaagagagaaaagtgtagaataagatagcttatgttagaaaagagagcgaaaaagaagtgttataaaaaatactataaaaatttgttgtgatatttcagtatcaataaagaataatgctattgctatggacttttttgaaaggtgtgtgtacaaaaggaggtcaaactatagcctctcaattttataaaagtgttgaagatagcacacatgaagagtgtgtagctgatataaacgcaatatttatcaaaataaatggaaggaaagagaatgacagctagtaaccaaaagagattaaaagagcatatatatactccggtcacaacagtgagaacttcaccaaactagattatgatttttatttatcctagtcttcgctctcaacaagtaataattatatataatttcttttataatatatacaagctaatattgaagtgagaattaagaacataagctcaacacactcgtatcattttgaaaagtttacaacaatcggttggtgtttcaatactcactaacacttaagaatgaaatttgctttcatcacaatgcaagagcctagttgagatcacaataaagcatggtatcatgtaacaagcaaggctgttaactaggtttgtgaaaccccatatcagaggcataaccgcttgtattttcattaattatgcagtagtgtactaaattgtgttctgttaatttcactgtattttgtggtcggttgcttttactggttgtttattgtataaatatccaaaactttatctagcttattcttagcacaacttctgttcaatgttatccatcttttaatattcaaaatttcaaatacatgttttgcctacaaaattaatttggtcgacaaaaccaaatcaaaccaagtgtaattaaatatggcgattggttgaggtgtcgaattgattgaattgttatgattagggtgaaggtagtttttttctagatatgttaatatcttaatccaggtattagagtgtcttgcttacaattagaggaggaattaccggggttagggtgcaccaccactcttcctaaaaaaaattaataaaaaaatgaaaattaaaggaaagaaaaaatattaaaaaaagataaaagggaaaaggaaaatatatataaagaaaacgtagtaaaaaaaagaaaagaaaagaaaagaaaagaatattaaaacaataaaaaggaaaaaatataaaaaaagaaaagaaaatataataaaaataaaatgggaaagagagataaaaaaaaaaagaaaggaagatgataaaatgaaaaaaataataataaaaaggaaaagattaaagaggaagagagagaaagaacacaagggagaggtctggacacaaaggaaaaaaaagaaacacaaatttcaagcgaatataaggagtcaaaacaattgtttcatttggtaaaccgaaaagagttttaggtatcttctcattcctttctttttccctcattttctctttcttcttcatgttgttattcttctaaagatttgcaactaaagtctcaagatattgtaccttatgcactggcggaggcagaaattttattgagaggggacgaacataaaaaaatatatatcataaataaaagtactccgaagacaatacaaatctaatacacaaaaaaattttaaaaaaatatattacagaaattaagatcacttcacttgttgactcttactctacgtgttttcatattgttaaaatcatctataattgaatatgtgttaaaactcaaaacaatttctttttcaacttatgtaattaaagaatcatcaagaaattggtctttgattctatttcaaagtctagtcttaattatcttcatagttgagaaagatctttaagtaattattgtagaaaatagaagagtgaatacaagtctaatcactttataaataagagggtaaatgatggactttctaggtcttgctagcccttgagtaaataacaatttattttattttaaaagattaacaacaacaataatgagaaataagagaagaaagaagaaaaagggaaaaaaaagaatgaaggaatacctgaaacccttctctttcattaattgcattaccaaatgacacaactttttttgacgctttctgttctcttgggatttgtatcttctttttctcttatgtgtatttatgtgttcagatctctcccttttataatgttctttctccctcttcctctttattttttccctttttattattattgttttttgttttatcatcttcctttcctttttccttttcctgttatctctctttccctttttatttttattatattttctttcccttttttttatatattttttccctcttttatgttttctttcctttttattgttctaattttttttaccacgttttctttatacttttttctttcccctttcacctttttttaatattttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcatttttgttttatttttatttttttattaattttttaatatatatatatatatatatattttcaaatttttaaattttagggggggcgatggcccatcctagcccccctaattttgcctttgaccttatgaaggaaattatgggtataactaaagtcttttgtcaagctttgcgacgaaagtctcaagatatttcaaatattttacatttggtttcaactacaaaagagttacttcagtaattaagagagacaggttaggatgctttctttgttcatgttcaagaattttgcataaaacatgacattgacattccagatatgagtgcaaaatatgttggaaggagaggtcgtgctcaaaatgaacaagttgatttttctattgaaaaattttatagggtaaatatcttttgtgctacaattgattatcaattgcaagaattaaatagcaagttcaatgataatactgttgaattacttgctttgaccatgactttagattcaagaaacaagtacaagtcatttaacagtgcaaacttgttgataaattttattcaagagatttcacagaacaggaaaaattgcatttgaagatggaattacaacattttcagcttgacattcctaaacatccaaatttaattaatttatcaactacatctgaattatgtcaagggctagcaagaactggaaagtccatcatttaccctcttattgatagagtgattagacttgtacttactcttccagtttctataacaactactgaaagatctttctcagctatgaagataatcaagatcagacttcgaaataaaatagaaaaccaatttcttgataattctttgattacatacattgaaaaagaaattgttttaagttgtagcacgaattcaattatagatgattttaacaatatgaaaacacgtagagtaagagtcaagtgaagtgattttaatttctgtaatagtttttttatattaggtttgtattgtattcaaagtacttttatttatgatatagtttttgttatgttcgccccctctcgataaaattccagcctccgccaatgcttacaacgtagactaggactaaccttctctggtttctttaataaggatgatgctgaggatgcctttgaattaatggagagacaaacatagaaagtttttcttaactctggtctaataggatacgtggtatggataaagccacctttagccaaacaaatgacttatttcattctttgttccattacaaaaatgttttccttttgaagcaaatgaaagaaagggaatttctagttagctgacattgagataaatcaagcttgtcacttcagttgttgtacctctttaatggttcgaatatttctcatctcaagtatggatttgcactttctagttttacctctattagtctttcaaataacacataaaacctaaatatttcccaattttcactcaaaaagtgcaattcttaagacttaggctcatattgtgcaaccttgattgctaaaagaatttgacgaggtcataaatatgatcttcttgagtgcttttgatgatcatatcgttaatgtaaatctcaaacatctttcaaatctactacataaacgatttgttcatcatttggggtacgttgcttcaacattgtttagacggaaagacattactttgtaacaataaattgtcttttcatgtcattaaatgttttttctctttgtctaatataatgtattttaatttgattgtgcactaagtaagcatccataaaggtagtgatgaatctttaatgacaagctctttaaaagcctatagacattttataaaaacctatcttttgacatctctaatgataagcttaagcatatataggtgaacaacttctcggtagtttggggtttattcttgacatgtcaacaaacatctatgcaaacattgacaagattgtactttggttagaatttactcacaagttattgattaacctctgctttagttcatcttaggtgtcgttaaaccttagtagaattgactaaaaccattttagggttgttcctcaagtgttagaaaaaaggctccacatatttttaggggagatcaatgggggcttttttttcgttaattaccatttagggatcggttttgaattattataaaaaaatggataagtcgtaacatttattatgactttcgaattgaaaatcgtaaatgatgttataacttctaatttatttatttatttaaatgatattttacgacttatagttaattattttcaaaatttatgactttaaagtcattggatttttttaaaactagtttaatttttttaaaatttatgactttaaagtggttcgatttttttttactatttgaaagttgtcaattttttttatgacttcaaagtcgttaaagttttttttttacgattcaaagttgtaaagtttttattttattttattttttcaaatatttataaaaaaaattataaataatttttaatttaattatttaataaataaatttacttttactttgtttactttttttaattttttaatattttttatatggtttcatttaatattttctatattttttaatattattttatttaacacatttttatatggttttattaatatttttaaattcttggtatattgatttataaaatatggaccccaatattgaggtaatttattttcgtttacaagggaatgaaagtgattctaataaactttgtaaatatttttcaatttgtatatatggtcaacaaagtcagcttaatttaaattacaagaagcacacgctcacttgcaagcgagtaagaaattcgaaatgcatgattgattacgactttagtctttttaaatttaagtcttttgcattattttttaatttactaaacaaataataattcttaacattagtaaaaaaaaatatagataatatattagataaaaaaatatactaaataaattaatatactcaaaattaagaaaatattaaataaaataatataaaaatagagaaaatatattaaataaaagaatactaaaaaaatatagaaatattaaataaaatcatataaaaaatatattaaatattaaataaaactaaaaagttaaaatatatttatttgttaaataattaaattgaaaattatttacaatttttaaaaaattatttgaaaaaaataaaaaaaaatttatgactttgaagtcgtaaaaaaatcctatgattttaaagtcgtaaatttttttaaaattaaactgaagtcataaaatattttacgattttggttttaaaaaaattagtgaaattgtaatatattttatgacttcactttaaaaaaatagaaatcataatatcgattattcctttcaattcagaaatggtaacaaatgttgcgatttattctttttttttaataatttaaaatcgactttcatacaataaaaaaaaaaatctccattgatagtttcccccattgttaggtctcttacacccatgagcatgcatgagcaaagatttgaagatgtccaagtgctccagactctccaaagggtcatttatgtcattgtattaatctaggacttgctctacatttgtttggcacttgaaacttgaaactacggtctaacaagggttgattagttaccaaaactacctctacgtacgtcatataagatgggttcaaaattgggttcctttttcgttgagattaggggatagaactaacatatactaggtggacgatggtgtgccttctacaaggaaagcatgcacccaataactttgagtggtaaattatttataattattatttaatttgttgcagtagttttaggtttaaaattttatggattgcaacattctttttattcctacattgctgttcaagtaggaatttctaaaaaattaataataaataaattagcattagcttagtcgacataaaaaaaaacattaattttctgcatgaaaaaaacctttaaaatagtatatcacattttatttgtcacatcattaattaacagagttacatataaaaatcaatcaaaaaatgttagctaacattttataaataatttatatagtgacataaatagatactattttataaatatatataacatatttaagtttatctaattttatttttatgtatattatgtgcattctcttgcaagatgatgtcatccttaagtttaacaaaatgatacataatttcctaattttcttgacatttggaggtttttattaatacacatgtatttaataatttatttttgtaagatcaatttaagcctacggaatattttaaaatagcttctaagaaaaaatatcctagttttcaaatcgaatggattgatgtgttaagtatgctattctatttgaactaatgattataaaaattatgtttaaattttcatttaattttaaaaattgtaaagaaaattataaaatactttttattttatttaataaaaaatatatctttacagttattaaaataatatatcaattctaatttgagaaaatacatcatatatatatatatatattgatggtaattttattgattatcataataactatcttaaaaaaatattaattatgatttctaattagttaacaatataaaaatagaatatttgaactctattttttattaagagagagagaacccaaaacaaccctattaatttagtgctgaaattgaaaatgtttcctttttctctttggtcctgatcagtgatcagctagaaagatgcgtgctttatatggtcggagctttatacggctgaattgattaattcttgaactcaaaggcaaaaatgaatcacatgtacttaatattttagtcaaagatgatcagtaaacttagtgtaggtcctttagggagcatcaattgatatatacaccgacacaccatcgtgttcatgcctaaccagaccctaaacccacgtttccttgtgtaatgacaaagctctacctcattttggaatgaattttggtaaaaaagagggatagagaaaaaggaagaaaatgtaaaaaaataataatagaaaaaagatagatttgataactgatgtgatgataaaaagaagacataaataagcaaaaaagaacaaaaaaatgagatagaaaacaaaattgatatatatgttgagtattttctttgagacccacgctgatgctgaacccagtattaaagaagtatggaccataattaccactagtgaatgatatagtacgtttcaatgcatgcccttccaaagaagtaattaacaaaagaagtcatctaaaataattactgcgagtttataaatgatgcaaggttaactaattaaaggggcatatcatcattatgtacttacccgagagatataagatgagttggtatgattaatcaaaaagaaaaggaaaaaaaatatgaatttattttttctgctaaaaaaattaataattaatatttattgataaaaaaaaatattacatacttactaattgacatgaggaaaagttataaaatatcatatgatatgcaagtgattgagtgaaactaattcttttaatatataataaaagaagaggatgggggtttattcttaattattttaccccaaaggttttaagcctccctgatcatgtttcacctgaaataaaagaaaattcctgttgtattttttcttttaatttgttctttttcgtttattttgacctcatctagtattcttgaatggttttcaaattttctttttcttttcccttccggtttcatatctttctgtggttccaaatgattcgtaagggtctttagccatgtttgttaacttcatcattatgttaggagtagagattaattagatatgtaatattataattgtaaaaaaatatcatataaaagtattatgaaagtttgaaattaatttaattattatataaattcattgaaatataaaacactttataatttgcaggagtgaagaatatgtaaaattttatatcaaaaagaagataatatgtgatgaaaaaataaaacttagataaagtatataattttttaatcttaatttgatcatccaaaccaaattaattcaataatttagttcaaactacgtacctcataaatatctgtagggattaatgatgatcgtatacctaaaaatgtagattatagtatatcatattgttttctaaaccaactaattcaagatgtgtttagatatgcactagaatcatgttgaatggagaaattatacttttcaaaacaattatgttataactttcatctgaaagttcattatcattgaatttaacttgttctcaaacacacattaaatcaagccaaaatagagtcatgatcaatttgattaagcataaataaaaaatcatcttttaaagaagctagcttgagaaggtttatataaatttatacatttaagttaattttaacttataaacatttattttatttgtctttttattttttcttataattaattaggaagaagattatccaaacagattaattgtatatacagtggatcctgtaagaatcgatcaactagacttttaaggagcaaaaaccactataatatttaaggagtaatgtaactaaactaaaatatttatatatagtatataaaaataatatattatatatctttatgaaacataaacacgtgcatataagatgtatgaagattcaattcctcattattttggacaccttgtcaaaaaagcatggaagcattacatccattcccgtcaacttcttttctttcaacccatatatcactttgcaatggagacaaataaagtttgcaataggttaacgtttgaaattaggtaggtctaaaaatatatgccagatgtccttttaacacgatgacataaataatcccattttggaccacttatttgggaatataattcttaaaagttatttatttcatcgaaaaactctaattcataaaagttatttgcacacaccattttaacattgacttagatgtatattaaatttttttcatgataatattaatgtggagcatttaccaatttaattgattattaatctttgttaaaaatttgaatgattgatcatttttagtaagattaccctttccaatcatattattttcatccacaaggtttgaatctaagaccttatttaagaagatgaaacttagggaaattcagaccaataacttattaatagatgtacattaatttaatcaaacatataattaaccctttaataattatagattaccaacaattttaaatcataatttccttaccacaaacatttagattataaaaaagttatacataattaattcaaaataaataaatttaaataaaaaaaactaattgataacatgtgtgactacttaaagagagttaaattaaatgattaagtcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgatattattttactcatgaaataaagggaagtaattaactttaatttaaacttgagttttaaaaatagactttgggaagaaaaggaacacttacactctgtttggtaagaataaaatgagtgaaaatggataagttagagtggaaatagagaggatgtttaaaattagggttgtttagtagaaagaaataatgagaaaaaaatgtaaatcttgtggattctgttattaaaatatttcatgtacgctctccaaggatggaattgataaaaaaaaaaaatgaagctaacccattccgttttgttattttacctaaaataacctttttttctcactcttactgcataattaatttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctattatttttttatatttttattaattatttttttaaccattacactattttataatgttaattttaatattttaacattatacttcaagatatcgataatgatagcttataggtttattttattatatttttccattattttttgaacatttttcatactaaacaattatttaaatcatttcaagatattttaccttgactctaattaatataatgaaagttaatatcaatttaactacatactgtttctattttatattaaatttgattaaaaatgttttaagatataaaataattaagtttaattaaaaatatttttatgttaattgaaactaaaaatgtaattaaaataattgatcaataaaaaatacatgaatttaaaactaatttaaaaaactaaattataaataactccaaaatgtattttatggaaaaataaaaatatcatataaatatatgtatgttcatttttatcttttaatatttatggtttagtttaatatataattatatcaaatacttataattaataataactttcacctatcacttttagttaatttttaatttttagttacttttatcaaacataaaaaaaatacatgtaaatatattttaattacttatatgaaaaacaaaacaaagtttactttaattactaataattggtcaaatattaggcccactatgtaacatccttgtttttcaacttctcgattactctcacactatgacactttactcaacatccttattggtcagaatcttctacagtttagaatccttcgtaagtaacccttttcgagacctcaaaaatcaactatgtctgctttcaggatcagtgattgtctctcacaaaccaacacatgacttttcagcatactttgtcttcactcacatgtttttcaggaaacttttcaaaagatcattcatctcatagctactccaagtcaaacaactaaattatggagttcttaagtgttaggctaccaaaaagtatatgcatcttattggtataggtagtagcagttaatttttttaagttattctcagttgtacaatctcatacttgcacaaccattggatctctctcattctggtgtgattcgatctgggtgttacatgtccaccagctttcgtcaggtccgtcctcgaaccacaccgtattgggagagaggtttgctcttatactgtttgtaacatttctaattttcaacattttagcggctctcacactacgacatttcactcaacatccttattggtaaaaaccccttataggtagtccttttcgagacctcaaaaattaattatgcttgttttcaggatcaatgattgtccctacaaataaacacaaaattttttagcatgttttgtcctcactcacgtttttcgaaaatttttccagaagattatccatctcataactatttcaagtcaaatacgtttaacgtagagttcttaagtgataaactactaaaaaatatatgtatcttattgatattgataatatcaattgatttttttaagtcattctcagttgttcaatcccataattgtacttccttttttatatctctttcattttgatgtgattcaatccaaatattagagactccacatttatacatgaatggcatttaacatcaacatcacatcatattatcttattatcttaggtcagtttttcttcttcatgaatacaacttaatggttgacactttcttatgaacaaaattgagaaggcgttataaagagagagaaaaacaaaagagtagtcatctaatgttaatgatataatttttaaggttaaattcctaatttttttatccgtcattttggtctttatattatttttagcaattttggtaccattttaaaaaaaatataattttagtctaatccttaattttatattgcttttagtctaattgaaccctaaatataacatattcacttaaaatatcataaaaacaatttaattaattaaaatttagaaaataaataaatatatgtaaaattgagagatatcgattttttgaaatataaggatcaaaattaaaaaaatacaaaaactgtagatcgagaactatactaaaaattaatatttagtctgtgtttaaattatttaaattactaaaattttattaaaataacactcgtataaatataaagtcaaataaaaatatcagtatttgcacaaatttataataagattatacataaataaatcatcatcaccaagtatatgagtttgttataattattatgaaattgttttagtttaattaaaagttttgaattcaaatcttagacatgtagttacatttaacgctgacaagtgacgttagacttaacctttgaaaattaactttaagaaaattcctatatctcactaattaaacattataacatttttcccaaatatctccccaatgctatgctagctcgtgacccggtcacgaaaacagacgaaagtcaatttagtacccaaccattataacattcccttttggggcttgggtgcccctcacctcatgccatcatgaccccatcgcttttattcaaaagcaaaccagatagctagaattagtacagaatatataagttttttgttgaacttccaatatcctcccctcaattatttatgtactttcaggtaaagctaaatctagaatctagatatatggctttattgtccgcagagcccaaacttctgtcttcttactcaaatcctctattaaattaaccaaaagatctcccaagtatatatgtgttgtgtggttattcggatgcaaatcatacatatattgttgatggtcctcttctgcaatagctttcatttactataatggatccaaaagatatcagggacataaattgtattttatacgtaaaataatttacagaatccttaactgattctttcaaccaggaaaagaagaaaatgaaaaaatattaaattacatgaatgaaaaatatatttaagtattaaattacatcaatgaaaaatatatttaagtcttatttatataatgcttttctctattattcttcattattttaattagtgtttttcctttttnaaccaggaaaagaaaaacaaaaaaaaaaaacaaaaaaacaaaactaccaactgtcgagaaccaccaataatttcgttgcgagtaatgtatggtacaagtaatatgctttcctattgggaaaaaataaatagtatgaaggccttttccttctttttctattttttttttacttttacttattttatagttatattatgtataattttagatacattttttattcttataatttagtattcttttcattttcgtccctgaaaaaaattgttttagtttcgtacatatatttttccttaaaacactttatataaaagtattttaaggaaaaacaaaaaataaatacattttataaagactaaaacaaaaataattgtaaggacgaaaatgaaaaaatattaaattacatgaataaaaaatatatttaagtattaaattacatcaatgaaacatatatttaagtcttatttatataatgcttttctctattattcttcattattttaattagtgtttttccttttttatttttctccttaattaatatatatgttgaaagaaaggaagtataatttttattttattttaagtttgtatcctcctctgggcgggccctctgcatagtccaagggtgtgaccatccaagactcataactaaaaagagtccaaaaaaaatataaaatataataattgtgtagtaacaaaaatttatattattttcgtaagtaagttgaaattattatttttttttgttttatatctctttttattcagattaaaacatgacatgtaagtaaaaagtaaaaagaaatatttttttctaataagttataatcataaattcatctaaataacaaataagtgtgaaagattaacgtgtaataaagctgttataataatttaaattgtttattttattctaacaaattatgaaacacatgcaacaatttaaattataaaaaattaaaactaaaagttagtattataataaataataataatatatgatgtgaagaaaatagaaaagagaaatagagagaaaaagaaaatgaagaggattttaagaaataaaattgcctaaaaaattatatatacatattgtgtataacttttttctttaaaacgtgatctcatatataaatatttgtgtgcctataattttttatgacataaattgaataaagattatatgcatcttactcgttgagatttattagaactattttgtttgttaaatgtaatcaaatgtataatttttaatgcattcgtgtgtttatttttatgtaaaatatgtttacatcttaaaatacttatatataagatgaattaggattgattttcttaaacaaagtttcaggtctaaccttaaatggaagaaaaaaaacatgattgaaaaaaatacactattaaagataattagttagatttttttttataatttttttaattataaaatcaatatatacttcatacaaataacataatttatcaatctattacatcaaccctaaaatgtcaaaagtgaccttactatgtcttctaaagctgagctactcttcggattcctttcagtgtcgcgcatgcaatctcataaaagaaggccaaattcaccaacaaaatgaaatcaagcaatcaacaaaaaaagaattaggtaacaaaagaatgaatttgacaatagcagaaattggtatttgaaaaaaaataaaaaactaatcgagtttggtcaatatgtgccgattgaaaggagtgcaaataagagtaacagaggatatttgtattaagattttgcacatggcatgcaaacgtatgtggacactctttgaagtggttggatatgtgctatctcgaaagtggggcatcttttttcaaggacatgctggccagagactctgcataattagaatttgttgattgtttatcattctgtttccctttagttcttaattacgtgcttggattagaccacacgcagaatatgtattccatttggaaatcgtaagttatctatgtagtgaatagtcacattaataaatcttttgtccctttagacattaattataatataacaccgcatttaattattgggtgcaacttttcatttattacgaattaaattttttaaagtcctttcttaacaaaaggagttgatcatattcacttctcctctacgccgttgatgggaatgttgcacattttccttttctttcatattaatatatcgtcattgagattgtcactgagtgtttttatcgtccagatacatgaaccggacatattaattaacttttaagcaccgggagacatccttttgactaaaatttccttccatttcatgtccttaattaattgctcaagtattatatatacattttcttttatgatataattatatataccttgataaatatggcaagaacttaattatatgcatttaaagtgcaatttgcgtttgattcacgacatcctaaaacaataaagtaaatgttatattcttcaataaaatacagtaagaaatattatcactataagcccaaatgagttatttactatcatttaaaataaatgaatttggtatggattagaatagaagtcgtgcatggtaggggtttttcatcaatatggagtaatttacttttaaaatttctaaattagtttagtttattgctttagaaaattgtggaacaaagtacaacttaattatcccgttccttttttcatgtaatcaatttactgtcacaaatctttaataattttaaaagaaaattatcttagtttaattttaaaaaatcccgtggcaatgtttgttaatagttttaaattgctctcttttatatttctcgtcaaaaagctttacagagctccaaaaaattcaaaaagttttctagttctttttaaactgaatcttctagaaatttttaatgcagttgaccaatctatgtaattaattctaatgagtacatggatagtatgtcacgaattagatgcgggtcaacctatcctgctgccgtgtctaataattattttgtaatagaagtcaatgttaatacttttttgttgctgaataagtcaatgatataaaactaatcaacgggggaaaatgggcaattcgatgcttattttgcaattgaaacgatgatcaacgtgaagaaaaaaaatgtgattagtgtcgcgacaataataatgtacgttgacataatattcaaacttgacataataaatatggatactatgtacacacaaaagaagctttgaatatatactacattcgtataattaagaagattattcacgagtatctttcccacaaatatcaaaatccaccacgtaattaattccttagtgacttagttaatctttaaacacatgggagccataacgaattaagcataattaaaaatgacatactacaaaatatcttaatcatatttgtgataatgttttcccagtctcaacattgagcctagacacaaagaaaactttttttttaagttaaaagtttaggtgaatcaaactccaatagtatattaaaataaaaataaatttcaagactcaataaatttaaatgaatatttactaattagtcaaaatccttaatgaactgaccaaccttcgttgatactgttattcgtcattattatgacaattgcaagacatgcaaacacaaatatttatataatactgtgtagctgtagttagaacttgacatcaacagttgccatataatataatatagcactttgctaacaaatggttattatgagttctgccataatttgacagaattaaaaaagaaaaaaaaaaaaaaaagatgtgacagtgctgctggtgccacctgttgatcgatgttagttacatagaacagatttgcgtgtggtataatttcaatggggtgcgatcgaggtattctgaagaagcaatttgagttatgcatcgcttacaattacatcaaaaccaagcatccatatcaacagctttttgtggcagaaaagcatatctatctaaaattgatggtagacacaacacaaaccaaagagtacaaactacaaagcgaccactcatccgagtgccatatcacaatccaaaatgagttcagctcaatgcataatgtctcgtatgtgctttaggtataattatgttttataattcttattttggcacaatttcatatttaattttaaatttggagtaagttttacgaagttgtgaattacacttatgactttattgagtcagtgaaaaaatttaagaggtcacaattataatatatgatttatcgtaaaaaagagcatgataaattactgaagttgtgtataacatgcatatatattagtttaaaaattgtagtaaattaaaaaattagtttaaaatttaaatatattttgtctctacgaatatgatttctttaatttaaattataatgttaaagattaaaaatacattattttataattttaaaaattaaaattatgctattttttacaaaaatttccttgcttaaattattggctgacagtacggataacctcactggtcactgcaacatacatataaaattaattcaatgctaaccagttcaaattcaaggaacaggttacaaccctcgaaagttcgaacatagaaatcattgtggtacttaccccccaaaaaaaaaagtcattaatatattgtggctaaattacagcatatatatgcttgaatgttgttacaagtatcatgtatatatgtacgttatataccaatgaggtatagttcattgactgaaaaagatgtgagttataatagatcttcaatatatgtcttttgatttttatggataatatatatatatatatatatattgtacaataatatatagcttgtcagtccggttgaacgttcattgttgtgaacttgaactaaaaaaacacttacctttacattattttaaaaactttaatgtggatttattggaaaaatgtggatcctgaactcaaattcaaacaagctataagtcacgttgcacatcaaaggcaaataatcttgtctgtagttgttgggattgatatatatcgtgtttagtttatcgtttacttttcattggatccacatatatctatctcgaagcaacacttaatatttgttgcttctgcattatcttgatatttcgacgtgcaaaaggtggttgaattgaagacacgtacaactacaagacgtcgaagtaaacacgcggtgagagaggtatgcatcatgcccccaccccaactcagattattcgtttcaactttctttcaggtttatttatttctgaccaaatttaagcgtggaaaggtaaatgaaaacgaaagcatagcttagttaatagttagtggcttcaaagtactgactttttgggctggggaggtgccagactaccgtttgattcatgaaacctacctgaaggctgaagcttgtcattatcatgattgatatagcgcatacggaagagaaagcaatgagacttagtgggtattagtgtagtttgcgtgaaagctataccaagctaactcaagcatgccatctcagaagaatgttcctatgcattcacggtatacgacgaatttatgttctattatgtaaggatacgaattctaaaggtttggagcaaagccaccttcataatttgctctaaactcagataccattttaattatcacgttcacccaaattagctataggatttaaccaaagtatgatcccaaatgtattttttttcttttacaaagcagacaagtctacatgcatgttaaataactcagataatcttgttcaagtcgaatacaatcattaatcatgcatgttaaatatgacaagggtgtcacaaataaagaaataaataaaaaaacttactggcatttgatttcttcattcctatataaattccaagtctttatggaacttttcaaagatttggaggagatcttatcaaaatggttttataacatttaacaatagagtctgagataaatggtgaaggaaaaatatggttaggtcacattagataatggggttttgaacatactcttagaaatttgcatcatcctttgctcaaatcattttggaataagttactgcctttgaaggtcaacacttatcttgaaaagtcgtgttggaaaggagaccaactaaagagaatttaactaaaaaaagctgtaattgacccaataaatgaattttgtattatctgtggtccaattctaaaaggcaaggacagtttttcttctgatgtgaaaaatctttgaagatgtgaaatattagttgtaatgtttagattatatgccacatttcaaaagttgagaaaagagcatcactttcaatttgtggactccctatctttgattctaaatcatgagcagtgttgaatttaattatgcacacaagtttatggtccattattaattggcttcttttaagtcaaaacattcaattctactactctagtaatactttagacttggtataaagtttagattatggtagcggattctatcaattaaaccaaatttctgatttttcaaaatcgaatgtttgaagggttatactgcaatgacattttacttctctctctttttggtcaattaaacaaaaattttaaaagggagtttaatctttgatacagtggtggagtggagttaggttttgatttatgacctatatatgatctaccaaaatctctttaccaggagtgaacttgtataagtctacgttgtcctcccatttctcgcatcctgttatcccatgtccagttaaattccaactagacttcaacataggcaagagtcaaaacacaacttcaactttattaatagtattgttagggacgtagagagtgaaatggaacagaaacgaaaaatgaaagtcgttctgagaaataaatagtacataatactaacattttcgttattttttaatatacatgactttagttgagcccaactgggatgagcaagttttgtgttaagttatcgacatgtttcaaatcaaaccaatgatttggtaggacaattgttatatccactctctctctttgcttagacactccccttttaatttgttatccaaaaatattctctttcaaaagatacactcccctattaatattaaaccagtaggatatagcacaaggagtacccccatccagtttcagaataatacaaacatcaaaatcaataggaactacttccaggaactatctggtttatccacctctgtttttctttttttataaaccaaacgaatttcatttacagttatgaaatatccaaggcctcacccctacataaaatatagcagcaaaaaacatgttctccctctagttatatggttctcaaaccctgcgccattgtcccctgcactcctattatcgagccatgcatctcccctacccatataaagtctagtgctgttatttcttcatagaatcagaaggatgccttctttcacctagctgaatcataaaaagttgctgtgaaatctacctttttagctttaaccctagaccagaccttagattgacagatttcaaaatgtgttgcatattatctttattgcctcttggtttatttcgaaactgtcaacagtcaacatgggagtgtatttttttttaaaaggaaacatttttggaaaacaaattagaaagaggattgtctaagggaaaagagagagtagatatggcaactggttttgttggatatctgaaattgactcatctaaagtttgggccgaacatttttttctaaagtagtctcttattctcttttttggagcttgtctatttttgttatacgttgtaagttgtaactgtgtgagaatgctttcgtgagagaacattcagtatatttttctgaaaagcaaatttaatatcattgataaagagcatttaggatattaattaggaagtgtgtaaatgacacataaattaaagaggtggcaacattgttgtaacattgatgcgaccatgtaaaataagaaatcatatcaagagaaagcgaaatttaaattaaaacagtaatggcaagaacttaaagatattatgtattccatttgttgttttccatagtcacaataatatgaacagcaaaagagtaattaggaaaagaactttaacaaaaataaggaaaggaagttcactcaatcaatatagtacaatcacacactgtacaactgcagctaatcaccaaaagacccttccaacaaaggctactcacttatcgtcatgccccaatcttaatgcaatcattactttaataattttaaacccttgtatttactaatgcaacaaataagaaaaaaaaaatacttttgtgataaaattgggaacaaaaacgattaattctttagagttactcaaataataaaacctatgtaattatgagaagaaaaaacaataaaaataaaaaaattatattatagttgaatagtaaattaaaaaataaatgcacgactttaagtggtaatgtgactaataacttctaatatttatcattaaattttatccaaatgtttgagtatgggtttgggtcagtaacttttaattggaagaaaatagtaaaacttaaaagagaataaacatgctttataattacagtacagttcccgtcaatgaaagggtggaaaatattaaaaaggaatcgttcatgcttactgtacatatgacaagggattaaacatcaaaccctctcccatgtcatttacaaaagaaaatttaaatgttaaataaagcagaaaatgttatgcgaggtaattgtatatttgaggattgctcttgtccctctctagatactccctgtcaatgaggctttcaatcctttttttcaaatcagcaggttttattgggaatttcagctgtacaaaaaacaataaatacctaaagtaagtattatatccccgaaaatcacacaaaagtagcatcaagtgtgtggtttttatttaatcaaaatagaagggatcatgatgcattttacatcgttttcagtagtaaatcggtacaaagtggcttcctnnnnnnnnnnaaataaatgcacgactttaagtggtaatgtgactaataacttctaatatttatcattaaattttatccaaatgtttgagtatgggtttgggtcagtaacttttaattggaagaaaatagtaaaacttaaaagagaataaacatgctttataattacagtacagttcccgtcaatgaaagggtggaaaatattaaaaaggaatcgttcatgcttactgtacatatgacaagggattaaacatcaaaccctctcccatgtcatttacaaaagaaaatttaaatgttaaataaagcagaaaatgttatgcgaggtaattgtatatttgaggattgctcttgtccctctctagatactccctgtcaatgaggctttcaatcctttttttcaaatcagcaggttttattgggaatttcagctgtacaaaaaacaataaatacctaaagtaagtattatatccccgaaaatcacacaaaagtagcatcaagtgtgtggtttttatttaatcaaaatagaagggatcatgatgcattttacatcgttttcagtagtaaatcggtacaaagtggcttcctctaaaactaagccatcagagtagcaggaacacattattttgaaatcgaaatattaggagttgacaaagatacaatttgaattaagaaatgaaagataagaattgagttcacctgttggaagagttcagtaataagaagggtgtgactaagcacttttctagtcttcattatcctcacaatagcagcatcaatctgaaccatgacaataatgaaattttttgttacagatgataaccagttttaagaagagttggttacataaacatttgatcttggatacactataccaggacatcctggacctaagataagtataacaggtttcttgtgtttggcattacattgttagatgtccaagcataagtcattgagatatatgtgtacatatataaagacaaggtggaaacatcgcaacttcaaaattagttatcattgtaaccaaaaaaaaaatgaatataactattattctgatacactaaaaaaaaattattattctgatattcatattttgtaaaataaaattaatgaaaatatatttggtaattaaaacttcctccaatcctatttataagacccaattatctaattcatcaagattaagaaaaatgattaatttagttgataacaataaatgtttaaattttttttcaaaattaccattttcattaatactcctctctattttctaattgtttgccatcacaacctctatttaattagggatattttcgtcttaaaaaattaatgcaaggccattatggattagtcttataaaaaggagcaagcaccggttgtaattttggtcctataaataggactggagagagtatatataatatcccatgcctatgcatcttagattctcatgaatttgaaagggtaccaaatgtcagacaagatagcactgcaccaaacaaacaccttgattctatgagcatcttgtaaggttgtgtcggataggggtgagtttttttttttgggtgaattcggataggggtgagtgaaattgaataaatgaattctaacgaaataaagcgaaatggaaaaaagaccacttccatctcattcccccaaataaatagaaacggaagaaaaagaggtattggatggaaatcatggaataaaatggaatgcattctatttctatcaagttccatttcactccatttcatccccttttactaatccaaacattacctaaaccacagcatcaattccaaaaaagtggggaacatttgaagggaaagaacattaacctgatactgacggtcttggaaaactctttcggtggtgcttgtgttctcctcgactgtctccttcaattgaattgcattcacctgcacttcataacttccaaattagtatgaaaaaaacctgattaaagacaaatttataccaaacttttaactttgaggtagaattaaaacacaaagttcagattcctccaatatgagaccaagtgttcaaaagcaatgagaaatacctttatacggtaaagaggagctgtaaacccatcattaaaaacaaatgagtcatcatcctccacatctcttcctttgggcatctgttgcatgttcattaaaggggaaaatattgagaaatatacggagaccataattacaaataaaaattgtatattggaaattatacaaatgattacaaacacaccttttgtaggacacgaactttaccacaagctagtgattgcagagtccttctgagttccttatcctcaataccagtagcatctttgatatcttgaagacttagcttctcagcatcattgaataacattacaacaacagtctggaggacagccaggcatgcagattaatattaaaaaaaatggaaatttatgcaataaaagatgctaagataaactgcaaaaataaatggagattttaacattttaaatgatggtttttgaaaacctgatatagggacacagccaactcctttcttcctttgggaaactctgccttcaagacacagtgacctagtgaattttgccacatcagacgtcttccactgtatttgcttagatagaactctttgaaaatatcctgaagacccaatagaggaaagaaaggaccatgtcaagggaatcactcaaactaccaagaccacagttaaaagagaaatcagtcactagcacgtgcagaacctggtaaacattcaattcatgaggaagtctaacatccatgggcggatatgttggccagtacctgcactcatccaactccagttagattctccagaaatctttctatcgacacacacacacatatatatgatgagaagacacaacgcttaccctgtggttaaaacatgaacactcatttcaatccctgatgcaagttttgacctcgcctgtgatgactgtttgaatgactcatttatttcttttgataattcaatgtcctgatttacaaaaatatgagatgtagttgacagaagctgtgatgttaataagaactataacaattcatgaagtttgtcagatcatcatcattcaaaagatcatcacacaaaataataaaaccaagcatatgatatataaatgtacttttcatcaacaaacgtactggaatctatgtttatgcagaatgtttaaaatttacatgtctgatataaatacttcatatcaatcaaacaaacaaaaacgccactatgatcttgctgcacattactgctagggaacatattctatacacacagaagtatacaccataaaagggggtaacaaatgaactaatatcataacatcttcccatgcaaattttattacatttaattaaatgaataaatgacttgagtatttgtctatatgaccatttcccacaactagatatttaaatcaaagggtgtttggttattcattggaaagttgtttcacacatgcaaagaaaaaatcatggaaggaaaaattttatgttgatttatatgtccattaggttctattccaacaaaaagacaaacacacatcagatactgagtttgattttgattcctctagaatattttttgagaaattaaaataatcttctctatatcaaaatgaagtaatgcacacctacatttaaagcctactaaaatcctccattaaggcattaaccattaaaaacaattacaaaaataaccccaatttagtacctttttttaaagaatttgaccaatatcatacgactctagtactgttttcagttaaagaaaaaagatcaatgggttatttgtagtgatttctttttaaattgtatagggatgcttttgaaggtattgaaaaataggggaaatatgtgggcaatttcaggcaaatgctgggttagtgggataaactgtctaaatgttgaaaaaaatattggacctttcaaaataggcaacaacaacagaagctctgatctaaccctttgagaaaggggttgaaaagggtttctcaatggatttgaattccctgtaaattggcaggccaaagaaaagtgaaagtgataggtaggagaaagaaaagcccagttgatgattgccatcaatcagtcattgccacccaagcatggaagtgacaaaaattataagaaaacatctattgaacagtagtccacaatttgaatcaaatctttaaattaaaaattgactccaagaagaatcatgtataccttaaacatcccttccagtttgtttgtgaactggctgccacactcagtcttcaactgtattaatgaaagaaaactattaacattactaataatattgctaagaaaccatctattgatttcagatgttaaaataggggaagagaaaccttgaccttggagatcatagatttctcagcgtcaatagaagcactctttcctaaaagcagtcttttagcaagatctttcttatagaatgcttcaaatacatccttgccctaacaataaaaaatcaataatgccaatatcagcatggagagaaagaccaataggaatgcctgattatggcagaagcctgaataaaaaattcagaaacaattaattatttgctattccaataaaacattgagcatacctgaatgaacctgaataacaccaggactttatcaagtgtagcctccagttcctcttcagaagtacccttattacctgcacgaagcttctcatccaaaaactttgcaatcaactctgcaggtcgattctgtcatatgaaaatagcataacagtgagttgattgcaagtcacgtcatacaccaaacatcccaatttgagtgtaaatggttacttgacataaaaagtttaactagctaatgacaaaatggtacgtgttagctatatgtcctttcctactactaactaccgtaaaaaaagttttggtgctaattgttcagttccttgactaacattatgttagtggtgatatactatggaacaaggaaagactagcacaaaggtcaacccaaaacatatcagttcaagctttctatcttgaggaatttccacatgttagtatggaaacaacaccacacaaaagctataaatcataacggaaaaatacataatacctgacgaagattgataagatactcaaatgcatctttaattgaattgctgaaagcttcattcttgaaaaagctttcttcccatattgtgtcaagagaagccttaaattcaagaagggatgagaccatatctttatctttctcctcatccataacaatgccctgcccagttctcctgatgtatgaactaagggcctgcttcagtgattcaagagcattgacccttgaaaagagtgagtgcattctctgaaggtcttcaatacgattcccatccataagcatagtaaaaccctgtaaaagaagacaaaaataaagtaaagaaggggaggggggggggagttgcaaaggaaattttaccagacaaaaatccaaaaattgtttttagaaccttgtcaagaatggcaggtatatgacgttcaagaagttgcttttcagcagtcgctatcaatggtttcctagtgcttgcatccaagtacaacaaacatctttcatgttcctcttgcaatcttgtctataaaatgagtatccaaaaacatacccacagtaaatacaatgtggaacaaggatgggattgaaattaaaaagaaagataacttgtatggtcaaacaaaaatatttaaagtgaaaagttttggcatgatccattagttaaaaaatacaaaagcagcatataggaatgtcaatgattaaagctaaaattataatacacaaaagtaagggaaaagaagcacctcaacatgcttcaagtaatctggagcatctgattgctgcatgtatttcataccttcagcagcataaaattcggatgtgcattcaaggaatggcttctcgaaggtttctgcataaattcccagagcagtaaacatcttcaaaagatgatttagaagagttctatccactgattcacctgatctgaaaaatcagacaaaattgaaaatgtaagacttagagtatgttgaagaattatatgccctaattcatatacagatggatcagctagtcaactccctgcagtaagagtgaaaattactggccaagtcacataattattgtggaagatgagaaacaaaaattttctgaatatgcttgattgtgttttctacccagcagaatggcctgtttatattcagatactactactacttcctaaaatgcattgaacctagctaaaccaagcatctaggccacaatgccacaatgaaaaacaaacaataaagaagctctaatatcataaaatactcccatttccaacaattatcacaataggaatctctgtatggtgtttattatatatcactattctgaaattattactttaattatacactgatggacccattttttggcaagatatagattctcaggtcacaaggcagcacctttaacattttaccaagtctctccatcctgcccaacatattcaataataaaaaagtggagatatgattgactacaacagtaggcaattggtggaagatgggtttacaggtagttcaaggattatttctttcaaaaataattatgaaaaaagcccatctctaacaagaaatccattccaaacccattcagaaatctcgattctagttccctcatgtcagagtgatgattcctgattttacagaataaaaagcagagtggtaacttaaggtctcaccaaacaaatggtcactctgcttggaatattaagaaaattggatggccaataaggtaattgccacaaggaagggaatgggaattaaaaggggtaaacacacatgggtgaggaggacagaataaaaaataaagggaatattcacgctgttaagttttctgcataaccaagagctggattgacaaggaatagtgggaggtcccggaggtggaaaataattagggaaaaacaaaaaaaaatatgattgaaaaatatgtagtgcatagaaggcacgaactgagggcaaaaaggcaatgggcttgggctagaggtttagtatatctgcattttgcaaaattctagatttatcttttattctgcacttctgttcttgtaaagaagtagtttttgttggctttatcagtaacaactggttcccatcacatgaattcaagaatgcatatacaaaatacatgcagaagaacctgcacatacactgttctagtcattttcaaaactgagattgcaaaatataaattacctttcacttctgatcatacgaagaagaccagtaacagttttatgttctacttctggagatagagaaagatgtttgcggaaaagttgcaaacccatgtcccataatgactgtacatttgttgtttgtttcacatacgtcctatccagaaacaaggctataccacgaatcatcaacatttggtcacaaagatcctgccaacatctctcaactagcgatagaaaaacaatcaaatctgggctttggcctactaaagactgcagtgctgcagatatatgtgcttcacactcctttttaattcgttgataaagatttccccccattttgtaaaggcaaagatcattcacagcctatggaaaagaattgagttcccataaaactctaatgagctaatgtgtggcgaatattcactgggctaaattaaacccactacctgataaaataaaaaggttttccatgattacctgataaagattctccaagtcacaagaaacaggttgcttcaagaatatagcaccaatagctgacttcaattttgcccatgtatcctcctcaaaattttggggcaatgttggtataccttcataagaaaaaacaaagtataaaaaaaatgtagtagtcatccaattcaattcattaaaaagagggtgattcattggacaagattcccaccaagtgtggtctagggaaggtagacacatgcagcctaactacctcaagaggggacgctgtttccaagatttaaaaccatggcctccaactcacaagacagcaaccttatctatgtgccaagcctcacccccaatcatcccattcataagataaatatttaatatttgctatatattactgtatcaatgaattaagaaaaaaaaatgaaactaagaataaagttcaaagaaggaaatgaaaacgagctctctagagttcaaatttcactttccaaagactaatacgactaaaaacgaaagaagagcgctgtgcagctgttgaagtataaacatcggagaagagcacgaagcaaaaaagcaagaaactaaaatgcagcttacaagtgaactaacaaagtaataaacacaaatcgatgaattcaaatattgaatccggcatctgaagagagcaagaattgaggaaacagaagagtaatcgattggtcaatagtgaagtacctttgtgaaacttaatgagaagcttcttgggggggtggggaggagtggcttttttgcgagacaaattggcggcgacgagagcgggcgcattggggtcatcggaggcggcggcgggggattccaaaacggcgtcgtcgccgttcttagagtcgatggatttcgccttcttcataggcggtgagagtttcgtattagacatcaacaacaacaacgcattgagtgagtgaagctaaacagaagaagaggtcgagggaggggtgtgagagagagattgagttgagacgatgatgagaagaagattacaaaatcagactagcacaaagttctcatttttaaatctatttttatatatttattttccctttttttcttttattttcatttaaattaaaatataaaaaggttcaatgaaaatcatttcagaacttttttcttgtatatcaacaattgtttaacagaaaaatggatatgtaatatttacatagttataatcataatttatcatgtaattttgttggcttttaaaaattttattttgaaattatttaaacaataatttttataattaaataatagtataaaattgttttatatatttagacgttaaaatcttaatttaatatataaaaatattagggaaaaaatagtatatgctttcataatcaataagaaagtaagaaattatatcatttataatagcattatgttaaaagttatacttatattatttttaattaattggtaatataaaatattttataatatcttacataaaaattaatcttaaaaatatcaaaataaaggaataaaaagtaactactaataatttcaagaaatttgagataatgaaatatttaaaaaaataaaataaacttaaggtaagattgaatttaacgaatagatatacgattaggaatgacaaattatatcaaaatcttattgatattgacaaaaatattcataaatgaattaaatattaatcctacaagtatataggatacaaataaaaacataactactcataaaaaatttaatatatagaatttaaacataactacgtatataaaatatattacaagccatatcaaaatacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattaaataagtctttttttgtctttgttctgtcttcatgcatatttttcaattttttgaacaaaaaattaattttgttagtagattgtcattcatctaagataattttatacataaaaaaattaaatacaattttttcactgaataaatcattttcatgtgaaagtaatgggtcttacaccagtacattatttttttcttcttctttataaacctaacttagaaagcatgaagtgagacaaaattgttacttattttataaaagaaaatattcaaataagaatgtgataatagtattccattgtactgtcactttcaaaatttaatatttttgtaaaattgtttatgtggaaatattatttaataataatatccttgatgatattattttatatttaacaaattttatttcttcgttatctcgatgaattaaaattttgttatgaatttcaattaaaaaatcaattatgttattttattatgtattatatcttagtatgtttgattaatagaatattcattgttaatttcctcatctgttttttgaataacttgttaatttcctcatcaaagattactaattttttagtcttactcactttgaggtatgagtgacaaataaaacttgacccagcaatctacttggtatgtcccattttgcctaccaaaaaacgagcttaaaaaagggcgagataagttagcttactaggtccattttttattttttaaaataaataaaatatagtacaagaatttggattttagtttcattttatataaaggggatgacgtaataatttaaattagagatgattaataattaaaagtaaatatttctcaattaattgtttttttattaatgtcggtattggagacaaagcaattgcataagttagatgaaataatacgactaaaaactagataaacaagtgtaattttaactttatactggtatcagtttacgtcagtaatattgtttcaacaatatcatttttttaaaaagtaattccttataggcacactaaaatattaaacaattaatatcatttttaatttattatattttataattattttatttgatacattaaattttaaaattttcacgttaattttttaagtttttataaagtatttaattttaatcctttcttctaaaaacattaaaaataaataaaataattaattgaatataataataattaaaaatcatcgttatctttattttattttaaaaaatataaaagaccctaatttctaacctttattcttcccctgacaccaatagagagttggtttttctaattagcgaagcctcaaacccaggagtcgttgttttgaatatgcataagaagaacactttcgccaccaataatgcaagtagcagattctttgtcataaacccaaatctggctgagtccgtccatgtacacttcccccgaatcgctaccactagagaaaaatcgtaacacaaggaagcaaaccacaaaagggacgggcagtgttgcaaaaaacaagcaagcgattcaaaaggggcgaaggatctaggtggtggtccggtgctggtggtggtgttggtgttggtgttcgccggtgtgttgtgtttttgtgtgtctgtgaggaagatgacgaggacgaagggaatggactgggacaaatctgctggctttttttttttggaaaaaacacagtgaagatttttaacccttatcantggctttttttttttttttggagaaaacacactgaagatttttaaccctttttattttaaaatttaacagaattattaatgttgttaacggaaataggaaaaaagattaaaatcagacactttgtaattaaaagatcaaaataaaatttttgtattaaaataaaaaaattaagaaacataataaattaaaaattacattaaactaatattaaatatgaatgtttctcttacttaacaatacttaaattaaatgtgagaacaattacttaatttagtccactttacctaccctcaatagttgttaagaaaaacctgctaaaaagtagtttgaaataatttgcgtaagaacttagactgaagtcttcttattgccattatacatattttaaaaaatagttattgaaaaatgctagtaatttgatattatggaacactattttgtacaaaagaagagagaaattaaaaacaaaataagagaaaatgtggagatatagttatgattaatgtaattgataaaataaagaaaaaataatttataaagttaaatattttatataaataaatggtacatgatcattaatgtgctatgcgacacctaaaaaaagggagaaaaaagagtggaaaatacaagaaataaattttatataatgatgtgataagaagagaaaaagagattgttggggctctcggtaaaattttctaagcgtaaagatctgtcatatttaaaaaattggctaattcgatttgttatgaaaaatactgctttttcaattggtgatttgaagatgagtatattatgacaggatggaaagcaattttatgtgagttgatgttgtgattaagtatcgacattagaattaagtgcatatatattgtttagtaagatttgaaagccattcgattacatgaacataagaggatttaattgtcaatttgaaagaaagtttactagaggtgtaatgactaatgttaatttaattggaaaattcagggttgatcctgaaaatttttggcctgagacaaagtgaaaaaaatgggtccataatacacattttttttaaatacaaataatattaattaagggatggaaaaaatggacattaacatacaaattttttgaaatacaaataatattaaaattaagggatgaaaaaaataggcccttaacacacaaattttttaaatacaaataatattaaaattaagggatgaaaaaatgggtctctaacacacaaaaaatggaccctaacatacaaattttttgaaatacaaataatattaaatctcagggatagaaaaaatgggtctctaatacacaatttttttaaaatataaataatattaaaattaagagatggataaaatgaacccctaacacacaaaatggacctctaatataaattttatttttttaataaaaaattttacttaaaccacccacacaaaaatttttaggccttgggcggacgctctgcttgccctgccccagggccgagtctgggaaaatcaaaaagaagtttgatggaagtgtaatgctcatttccatggataatcaaaatgtgaaagttgataaagaaaaaaaaacttacaagaagtgtattgctcatttagatggataattcaacagtttagtaaaaaaactataaataggcaagttggtagcctttcttttaggcagaacatttgcacaagtattattttttctagggaagaggctaccaattatatagcaatgtgtatgtttaaattcatattttaatgcaatttatcttttctattattcattttcttttgatcaaacatctctttttctccatttattctccaaactcttactcttttattttcttcatttcatactgcatttcgaatacccaaacaattatacttttaattatgcacacttttcttattgtaaatgtaatcgaagaacttttgttttgattttattaacgatatatctttattttttaaaatattagtttcacataattttctgattgtggacataattaaagaatttttgttttaatttgatcagtgtgatatatcttttctaaaagatatttgtttcacataattctctgattgtaaatataattgaaggttttttttttcaatttcataaacaattatatctttatttttgaagatattttaactttatataacattttttatgcattattagttgttcaaatattttttttaattaatcttattattctcctagttgaaagttaaaacaatactagtttaaccaaaaaaaattataattgtgattcagtcttattaaataaaataagttatttgtgattgatgataattatttaataaattttcatcataaacaaaaatattagaaggatgtttaaaataacgaaatatctctatatcattaatttttttataaataacataactgatagttcttttatgtattttaatttgtcggcttgtaaatttcattttcaaacgaaccacatgtatgataatcaaagaacaatcaagttgaccacattccaagttgggtgcttttgacttggcatggacaagacatcgtaacaatttatatagtcccttaagactgccaagttcaaagcctcacacgagtactagccctggtggacgcacctcaactacacctataaaacacccacatatcctcatgcactttttcaaccctcacactctccaattcagcatttctcacaagattgaagaattagcaaagttatagctagcagagaagctaaagggtacctaacttattactaggcttcagattctattcagcaacaagctcactgcatcacacaacatcatgacgagtggaccaaagatagtgcacatcgaaacacggtacgtggaaaccgacgctatacacttcagagatgtggttcagcacctcacagggaagaactcctcaacaacaaattgggtaggaaatggtgcctcattctcatccgtggcatgttcttcagattataataaaagaggaattgcaaatggtggtgtcagtgccaagccacatgaagatagcaccaatgatggtaaaaagaatagtgttgcatcttccatgctactcatgaacgtgtccttcaaagactttgagggtttgttgtctgatatgcctcccatggaggagttgctcatgttgtaggtggaggaacaccttttttttcctactagttttcgaattttctctattttatgtcggtattgctgaaaatcatttaattataatttattatatataataaatttattaatttttaaaatatttatcttaaattaatatttcaaatagaaatttgtaattgaatgagagtataaaatacataaacattacactctatacataatgtcgagtttgtacaagtagaacagtttgatgcgtttaactgctgaggatgagactttactagatgcataactgttctgtgcaaattttttcatcttaattcgaaatcaaataaaggaaaataaaaaataaagataaaataaaggaatacttttgagttaatatatatggaactaccatatttttatttcttcaagtcatgaaacgataaattttgaagactgcattccagaaaattgcgcaaactgcctgttgcagaagttttattgattgtggggacatgaaaaattaggagttgtcccctctatgaaaaggaaactctgtacgacggaaacttgaccatatatttttattcataggtcaattgtacagactcgcgagaggatcgatctaatctaagagacttttatactgtttaaataacatgtggtagtaggaccgtatatattaaatggaaaatgatgggtggaaatccagttgctattttataaaaagaaaaaagaaatagagataaaaaatgacacattgaaagagataaagatatattgttttaggattactatttgaaagtgtgatttattatcacttaggtccgacaaatataagaattttaaaaagatttttaaaagtataatttatctttcattttaatttaatcattaatttttttttaagttaacatctgtgtttacttgatatgttatctgcttacgtgataattgataatacatacatgaatgacatgtgataattcgatatatatatatatatgcaactaacctaataatatacatgtatgtgctagtttaaccaatgataaaaaatgataataactgttaactagtcatttatgtgtacaaagtcaattattacgtatgtatcatcaactgaaataagtatgcatcaccaagtgacacaaatattaacttaaacaaaaatattttaatggtaaggttaaagtgacaaataaaatacagggatttttttcaatttttattaatttccagacatttaaatgatggtgggttacactataccaaaattgatatttatcctgtcggtttaagatttaatatataattgggtcttaaaattagatctttgaagctggtttatgactgcttaaaaaaaaagggaattatacaactccggccatgtattggacagtcaccacactaattaatattacgttaatgtttaaggacaacttttgcagtaatacgaaattacggaaaccgttagtagaaaaagaattgcaattgtgttattagtataatctaaagaagacgccaaaagcttcctttttgcatgccttctagacatgtattctagtccttttcttggtttcaaattatttttcttattttccttttttattagctccttatttactcgtatggaaaaagaagaggttatttatatttttcaatggtaatattttaatatttttttcattattattattattattaaggacaaaatcataattacatgtcatctaacattaaaacagataatatcttgaatatggtgaccttaaaaatatttaacaaatttgaagttaaaataatattaaaaaagacttaaatcactcttgaccctaaccttgcctgagagcttgttctataatgttaaaagtttcatatcttaatgttaaaaagtaaatactgataaatttgtgataaattggaataataattcttctttctttcattcattcactccattctcttctatgttttccctcaacatgatgttcttatataagagagaaattcaacaaaatgctaataatacgggataataacaaactaaacaaactataacaacctaacaaatcctaacaataatttgaaatttaaattatacaattcaacactccccctcaagttggtacatgaatatcggtcatgcccaacttgtcaattgcttcttcagacacactagacatttttctaggaatgactttgatcagcaataggttcaagaggtgcttcaggtgcttcaggatagtccacgtgcttcgattatgtgaggtagaaagaaaattgaaatacgagaagtgattcggaacaataacatgttcatgtcaataaatttcagggatggtctatgaagattcagaacaatacaactgacttcacatcaatgaccttcaaatagaatacgtgcatggagaattgagatacgagaatggatttggaacaatcacatgttcatgtcaataaacttcggggtggtctatgaagaactcagaacaatgcaacgagcttcacattaatgaccttcaaatggatacgagaaggattcaaaacggaaccaaaaattgtaaaggttatgcctgacaaaaatgaaatttgtgataataataatcataatttgtaaaggaatcaaagaaggtgaaagttgaggagataaatagttgcatataaatggaatacattgaagataagataaaaagacagaagaaaataaatatacttttgggggatgtgaataagaaagactctgattcatgaaagaatcatgactctcattcatggaggaaaccatggctctgatatcattaaaaagtaaatactgataaattggaataataattcctctttcattcattccattctcttctatatttttcctcgacatgatgttcttatataagaggaaattcaacaaaatgttaataatacgggataataacaaactaaacaaactataacaacctaacaaatcctaacaataatttgaaatttaaattatacaattcaatacttacaaaatattgtaaccctagcgatttcaacaaacgtaaggtcagattattattattatttatattttattatcttttgaggagatatcatttgattccgtactaattggtttagcttctatctatttcatgtgctcgaatgttgaatgttcttaatcttcttatggtcaacgttttcattagccttgatgttaaccctgttggtttaaatttcatccttcatttgaaattgtgttggggttctggtcatagtaactataccgctctcttcgaataaaacaaaacacggctcgttcattgtgtgcagttgagacacgtcttaatacagcataagattcaacgaattgcaagttgcaactgtaatccaatcaccgcaaacttcttttgacatattttcttctgtaattgtatataaaattaaaattacttagctcatgtgcatttaagagaatgagatattttacgtaatcttactcttagcaatgcaaaaattttgtttttggattcaaacctttcttctgtaattatatataagtaaaaaaaattaacttgtatcttagatttaaatataagtaaattcaactatttttatttttatttaactatattattcttaaaacatcatttattttgttgtgccaagaagaagaagatcaaacacactctcacagaagtgtatcactcaagcttgatcagaaaaaaaatctcagagaaaagataaagaacacaagatcaaagagaagacagatttatatgagcaatgtgctcatgtttcaacaagctatattctcttattcctgaggaggaaaactctcaatgataacaatcgttcatctaagacagagatacagattttttttttcatcctggcagagatccttctctcttagcttcttttacactgcactctaggctatatacaaggaatagaagaactattctgatttcctagctaataaccaacttaactgtcacaacagaaagttaattaggaacagctttccaaaagtaactaactagtcatgattgtttgagaaccagcaaacaacatatttaattgcaaattgcaatccattttcaattattctttttatttataataataaattctaataaagaatattttatgaacaattttatattttacttaaaattattaaaactaaatagcatcaactaactttttaaattagtgtaaaattaattatttttacttatatacaaataaaaagaaatataatcttaaattttacaaagacttccaaaggcaaatgacatactatgaatacatcaaaattgagtagctcattaagttagaataacaagcatttatataaaagtataacaaataaatataaatatacagtttggactccagaaatctcttagaggatggctgcaatgatttatcctttgaatcttagatacaatgtgtgtgtgttgagagagagagagagagagaggaagcatgggctcaaagccagaatggcatacaccatcactgtcgccagaaaagcaaatcatggaaaaaatatcatttaaaaataaatcacctaaatttccagttttgcaattggccaagtacatatagcattcctgacagctttagattaccatatagagaaaaccaagccctctgaagatttcagatataaaaccgaaataattttgttgttggcatttcatagtgtttgtcactttaatcctatcattaaaatttcagagccgctctcttgaccaggttggtctggttctaaaattggacactgacattgtttttcaatttctctaattatttttttgccagatattgcataaaacatatcatacatatacttgataacccttgtcaggacagtatataacctccaaccgcacaccataaaatggagaaggaataaggggggttcaagaatttgcgcaagcttcgcaattttcttatattggaatgctaagaaacctttaatataatctgcaccaacaagtatgtgtaaagttgtttccattccatcatggaagaatgaaatatgaatgagataattaaaagaagacaggcaggcactcattagaaatttgattgtctaaatgtataaaattaaaccatcaactacaaatacaattttatcataatttagattaattgaagctaattatcgatgtggaacaatcatccagacgggggcatggttgacagaagattaagaaatgagaaacacgaaattcaattcaatggacagatagactaattcttatttggcatactcttctagcttgccagaattatggctttcggcaatcttcagaatcaaggacttgtatgttatttccgggtttaccaaaaaaatagttgagtgtcttagaaaaactaaatacctttgagcccaatctaaattgggccacccatattatgcccttgtgtaacaagatggattctgttattaccaccccttcttttgcttttttctctccatattttgtttgttattttttttcataccactaatcttaccccttcatccttgtctggctcttacacgaaattgagactaaaagctataggtctggctaattcactatcacaattaaacaatgtagtggcagaaaaaggaacatgaagatctataaatataagtcaattataggagctcacaagttattgttgcaagagttgggtattctctttctaaatatgagcgagacacaatgttttacttctttgatatccaagaaattaaagaggatacaaggaaaatacataggctggttatggattttcttgtagtggggtatgatacccaagtttaggaccaaagggtgtaattatgaagattatggaaaggataatccttgatgtagcaatggattctttgtaggctaaataaatagaagtttgcaatgttcgagtaataatcgagttaatccgcaataccattgcttagccagacattcttttcttagaaatgggcgttgcttggagtgtccacctattaattgcaatggtatctcactgattatgatttctctaaagtgtctttatttgagatctggtgttacttttaatgggtctagactatagtttcttccatagcaactactaccaaacaaagaatttatttatttattgaaattgaagtgaatttggcatctaaacataaaagcctcaaatcaattattatcctaatttgaataaaatgttattagataagaataagatatatatatatcttatcttattattttctattgtatttgattttatataaacaaccatcatattatcaatcaagcaaattgcaatctacagcatttagtatatcaatttatttatagattttgttttaataattttactttcttaaacttaattaaaataaacaagtgagaaaataaatcattaatcagatattttctacacttattttcattgaatgcgagcttataacttctttgttgtataccgcattttaaagaactttttatattaaattaaatattttgtttgtcttcctttcaaaaacaaaatactctctttgtctttaaatattagttatcagatcaaaatagttttaaaattattttaatcaacatttaattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttaactctctcggttagatatttttaacttttttttttcccgcttttttcatggaaggtttattccacacactatcactaaaaaatatctctcttaactatttgaaatacggctctgttattattattctactgctaactatcgttctgttatctttacatgtatacttgatatcttcattaatattttatctttttttacattcttgcttatcttaacttttcatatcttttaatatgctattttcatctttatttcaaacttcaattcaataaattttaaaaactatcaataactacaacaaattgataatagtaacttattgagcagaaacaaaaccctaataagagactcaccaatacccttccctatataaataaagacccgcaccttattctctgaaagaaaccaaagtcttctttgcttctgaggctcccctcccctctctctgaaatccccaaattggttgtgaatggtagaaaccctagtcattcgatttgatgctctctcccttttgacatcaagggtgagcgcattcggttcttgcaagcaagcctggtactaccgatgcctcggcctcgacccctgaatttgaacaattcataaccacctttcttcattcattctcgattttccttttcgactcgatttgttgttgtttccttgacgaatcatgacgatgagcaagcagaagaagaaccagaacgcgaggaggctgttgataaccatcaatgtgctggggagcgcggggcccattaggttagtggtgaacgaggaggagtttgtggcggcggtcatcgacaccgcactcaagtgctacgcgcgtgaggggaggcttcccgtcctgggaaacaacaacaccggtttcgtgctttattgtccccatcttagatctaatggtacctttttcaatttctcaatccaaccctctctgtttatttatttggattgccattttttttaaatcttaaactgaattggagaaattggtgcgttgtttgtggttgcgagatgttttcagaaattgaattggacagattgttctgttgtggttgcaagatattttcagaaaattgaattggagagattactgtaaccgtctggagtcatgaaccatgctaataatctctgtctagtgacatttagttgttttattaaaaaaaaaatcatgaattgaatttttgttgtgtttgagacatgaattgaaattttcggtgaatttctatggtatgggcgtgttttaaaaaagaaaactatgagtttcttaggtgtttttggtggtattctcctattagattaatctttcatctaagcgatatttataaataaaggtctgtcttcatgttcaactatgttaccaaagtaaaattctgattagagaacaacaccaaaaacacataagggctaaggaattagtacacatctaagttttgtctttttaggtccttttaaaaatttggctttttgtattgggtttgttttgttctgaattgtgtgtgatggtgttgaagctttgagtccatgggagaaaattggatcgcatgggatgaggaatttcatgctgtgcaagaagccagaggagggtgtggcggatgtagatggaagtacagcactttctcgcagcagcagggggagtaggagctggaaggcttggttcaacaagttcctcaaactcaaggtttccacccactaatgaataaagctctctgggaattgaacatgatgccttttgtggttaatgccactaataatatcaataatatgtggtatttcttttggttgtttatgttctcgctagccggagaacccctctctttaggaaattgttcaactttgacatttagattttgattttgatggaatagaataagttttgattcctctcttccttccttgtcattttttattcaaataaattaaacttaagatagtgaatgcgagctaatattccaagtatattctcttctctttatgttgcactgaaacgtgtttgttttttatcctctcattggtgtatggcgctggttatggttttggcaattcaaaatgtatttgtagtcaacaaagtgtcagcgggaaactttcttattatttatcttagaacttagaaggtgctcatccacaatacgcggtgcaaggaaaatgcatttgagcagtaaccctgggtttgtaattttgcttgctggcaagttagagatgattttggaaaataaaaataaaaattgtagagttgacaaaaaaaaaaaaagccctgtttgtacaagattttaaaacaaacgaacctctaatttggcttccaaaagcaattttccgtgttcataaagttgccgaatattaataatttaatacaaagagtactctaaaacaaagtatccaccaaagaaaagctttcttagcttttgcttgaaagtggtttatttttaattcagaaccaacctaatgctaagttatgagataaattaatgataattaagataacaatgataagttaataataataaagatgttttataacctaatgctacattgatcggtgcatgttccctagatacatctatttttaattcagaaccagcctaatctaagttacgacgatgataagttaatgataattaagataataatgataagttaataataataaagatattttataacatatttttttgggaatcttttagaaatttgatagtatattatatttaaatttaaatttttagatattttaatatttaacgatctattatctttaattttaatggttattattaattattttcatgttttcataatgttcttatcttattcatattatatatatatatatatttaaaaatatgtaaatgcattttatgttattttatatttattaactaatttgacaaaaaaattatgaaacatttctatttcaacaaatatctttcagataatttttttattactttcagttaatttttcaattttaaacttattttttctttggtcaaacaccctcttagttgatttgttttgccgaatagatcaccgaattagagatgtatattttggtgctgctacattgatcggtgaagagaagataccactttttaaacaaattaacataaaatgtagagtttaataaacgcaaggctcaaattaaagaagagatggtttcagaaaaagatcaccccatgatttgagaatcaagaaagtgacgaggaccgtcctccagttgcaccaaaatgtatgttttaaatttgagttatatgcaaaataatgagtccttcttcgatattagtcatgtcttccacttgtagataacgaagttttggaattgaaagttcccacgcaaaggaagagtgggggctacgtgtgtggttatatattgctatcaaagtgtgtgcatgatcatatgattccattctactcaatttcactacggccatcccttttgcgaatgcatgcatgatgatacgcgaatctttgagattgttgttttcttttgtctatgcaagttacttcacctatagcagtatatatgcatggtctnnnnnnnnnnnnnnnnnnnntttttttttttttttttttttttgtgtgtgtgatagggaaaaacattcttttcttttaaaatgacatcatatcaaactatcgtagaaaaaattcatgatacaataactcgttttcttgcttattatctaacggaattctaacttcacagccaatattaatcgcatgtgatgaaacaagaatttttaaagaatgtaatactatatgaaagacgccttaagttgttttctttttttggtaatgattttttttatcggtagatattagtttgttaaaaatggtaataagtagattttttttttatcggaattctttttgatgttgcttgttagagtttgatgatgttgatgattagagtgattctgtacgtatattcagaattgtttttatttatttatttatttgatgaactgttttttgtttgatttccatgacataggattttagatggacattgatcagtggtgataggaggggaatggcaatggtgtgtggtgatgggtcgccggagacggtggaaccaccgaaaaggagaaagagctgctagaaagaaagtgagagaaaataaaattccctttgcacatcgtctaaatttgtatatattaattagtttttgtactttgttggctcaaaataaaactcccattgcaaaattcttaatgcaccctggtaccttcatccacgcgatcaaattatcaacatcaaacaacattttgatacgatacaaatttaatccagtgaaaaattggacggatattacttatttgtatacatctcatgttaatattgagtaaccatggctgtatacagctggctctgtaaatggtttaaggcacccatttgtgggctcttgcaccatggtgcaacttttttaaaaagttacaataatagtatattttttaaaaattataaaaatggacaaatcatactttaaactacgattttactagaaaaaaaatcgtacttcaaagcatgattttgttcgtcataaacttattacacgtatttgggtatattattttatttttattttattaaaagttgaaattatatgttaaaatgcattttaacatattttttaattattttagaaattatattttaatatacaatttcattagaaaaaagaaaaaatactaaaattgaaatttaacataaaagttcagttcttaaagaaaaaaatattttaaataaataagaggtgaaataatactttgatatataattttttttattgtgaaatcgtatatgaaagtaaaatttattcattttcatgaaaaattttaaaaaatattcattatgctaattttttttaaaaatcgatctattttcgtaattaaccctccatctgtgcatttctttattatatacaaatacctttttttctgattaaaaaaaaaaattgtagggtcaccaaccgaaagaaatcaaagaaaaagaagggtacggtacgcaaatcctttgtacctgaactcttcttatgtcgttatctgtatatgtactgttaatcttttgcaattgggggtcattttctttatttgataatgcgagacactcacaattcggaggatttttttttttttgttgaactattcggtggagtttgacacctcctttttgaaaaagaaaaatattctgttttctgattacctaatatattttgtttaaaaattcttctaaataaaataaacgccaaaaatcagacattgtttagaaatttagtgtcctgatggacaacacttttctctatttatagtatagacaataatgtcaaaataattgcagaaagtaaaagaatatcttgaatcaagtagcttttacatttctccaaaaacacacaatgatttcccacgcatatatatatatccaaatactaaatgtaattgaatgacttcgagtgatccaacgttaacaagaaataccaacacttgatgacaacgccggctcatcccttttggcaaaagcaagctttaggacacagcttgctgctagtactctattttcaagtcctacaaaccaaagacaccaaagaacaaaagagaatttattttagtaacacgtgtattacaacttgtaatgttaagaaatatgaacactgagcaattccaaaattcacattatatgttttattattattattatcaattcaacccaagttaaaccaattaatgacttgtatgtctcttaacaagttcaatttaaaaaattaaaaatactggactagagaatttaagaacatgcatgagaaaacacaaaataaggtgactagaaatatcaattaatgactggtgaatatgattatcgcaaaactgacgacctaaattgactagtgaataaagaatgccatcttcacgcctatattgagtttggtttcatttacaaaatgacttttcagctaggtttatatagcagccatactccatatagagtttcataaagctccattgaacttgcaccatagattttgctcaacttttacaatatgaccactagcctcttcaggaactgcccctacaattttatgctagcccttaaaaggaactcactagggcctcataaaaagtcaaaagaggttgtttgagaaggattatatgtgggaagaatcctgacagtatttgaacagcaaagctattgactaatctacaactccattatgtaccaatttaataggaaaaattacttttatatataacccctaagttgtacaaactttatcttgtaatcttacacgtaaaaatcatcattttcagtccatgtaaaagtacttttgaatttcttttagtctcgttacaaaatatcaaagattaaaagataaaatttatatatcgaaaggaaccaaaagagatttaaaagtatttaaaatttgtgtaaatgtaagaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatcccttagaaaaatgaatagtattattaaatacaaccatctcttaaatcatttaattcaatgagtgttttcgaaaatttaaatttataagattattaattagaattaattaatttaactattttaattagttaagatgaattagaattaattaatttaactattttaattaatttaatatcaaatatctatgtttacccaaaaagaatatcttttacgggtccatgcaaatgctagtacatgtcgtattcatcagacacatcagttttagcatatttcgagtattaaaaaattcagtaaatactttattaacaataaaaatgtaaatgttcaaaaaaaatattttttaattagtaaattatcattttaatgatgatttgtaaatattatatatatatatatatattttttttttcttgaagatgatagacttgaatacatttggatttgatgtgaacctcacacctgctgtgattggtggtgtcgtcttgttttgtgtttatgaattagggatctttaacttcaaagagatctaaaatgaaaataaaaaattgtttaaaaaaattcaaaattgaatcgaaatgattgcttctcaatttgtttgaattatttgtttctaaaactaattgatttgttttagtttgttttgtgtttatactaatatttatattattttagtcttatgcattttatatgtatataatttgagtctcatattatattgtagtgctaagtatataatatttatataatgtatatcattttttttaaagattttttttaaaatatgtttggtttaaaatggatacaaacttgctagatttttaatttgttattagtaatttttaaaatatattaaaagatgaaaaaaaaagtatatgaattttaataaaataatattttagtaaaaattatgaaattgaatcaaatcaaattgtaaaatattggtttggtttaaattttattttaaataaaaattgaatcaaatagaattacatatatttttttaatttgattcgaatgacaccaaattgaattaggaatgcccctattatgaatgtatgttgggtcttgccatgcttatttagttttttttggcttatcttatattcttattgatttgagatatttaacttttaggtccatgatccatgattaaatattcaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatataaaaagcaattctttatggaataatcaactactctttcagattctatttataagactcaatcaaaattaatgttttatcttttcataagataaatttataatgtttgttatattaatttattttataatatattatcctaaataaaagaaagattgtaatatagaaatgattaaaagagagagaaaatggagtattgttaacgataatagtagtaatttgaaagaaaaaaaatacaaattgaggacatatttattgatattaattaaattaataatttttgttaatgtaataaattagacaattaaatcttataaatacatgagaccacaaatagtatatggtttgataatcaaactatgagtttaatgatgatatagtaacaaaataaaatggttttacattttcaactaatcataaataaatgttgttatgatttttaaaatagttattataaaagtgaataaatttatcatatataatagattatgattgaatgactatgtaaaaatttttaaaatattatttactgcaaaaattaataacagggaaacacaaaatttaaaaaagaaccaatgatattttagtaaataaatattaattaaaaattatgaaaatatataaattgataaatatacaaaaataaattcgtactaaataggatttttcaaaactttttttacacttatttgtacatcacctattttctcgtcaattatggtgttcatatttgccgcctcaaattgtcttaagaactaaatattcgatttagaagcggcacaaatcgattgcctcattaacaaaagcctaaaaataacatattaagttactattttttgtgttacaaattttaacatatatatatatatataagtaaaattctttcattattatagtaatgtactataagaaaaacactgtctctgtatcttacacaaccaaaatcaactaaaaacttttattaaaattgtttttggaataattggactgaattttggaaaaagtttttacaatccaatttacccctcttggatttgcttgtcatttgtctaacaagcaggacatgacaacccaatgtcatgttgatggaacactatttacagactataggtcgataatggttaaggttgccaaacagagcaaggcctaaaaatgctacgtgacaaatgagaaagaagaaagaaatattttttttaagttaaatattaaaaataatacccctataataatttaagtaaaataaaagaaacgattgagatttttagtcttaaatttatgtataggttgctaataaggtcttaaatttttgtataaattactaatgtactacaactaaaaaagtttgaacatattagaaagtagcaacctctctctctaaatatatactaaaaaactgcatcacgattagttgaattagttagcagtgaaacagataacaaattaagtttaaatgatgggatgtgaaaagcatttgtgagtataagtgatgttgaacaatgtacagtgactatgtgtgttattacaggcgcttgatttttgggattgaagggagtcgcatgcatcatcaagaggcatcagagttaatgagttgaatatgggagtgaaatcattcaactagaaatttttattttacccttttaccattttatttaaacaattattgttggtacaacaagtgtaataactccagcttattcaatttttataatgataaatcaacggactaaaataattgagtttctatcctgcatcatgataagaatagaacgagttcagattataaatagttaatttgagattttgtgattgaaataaattgagttggatcactttggatgaaacaaaaacttcttgtttatattagatatgtgatgatcattattttaaattgcgattgcagttgcagtaagtcagaaaacttttgcagcattggaggcaattgctggaaaatgtggttgatgcaatagcaattgcagttggggtaagttgaaataccttaatgttatggccacaatttaaaacgataatgattaagggtgtgcagttgttggagggtcttgatgtttagggagtgtaagatcatcacccaaaaaggatttgaacaagttggccataatttatccactaaattagtagtgctggttttgtttataaggtatagggttatatagctctaatcaaaacaaccggttttggtttttatcatttcccgcttactgttttaccttgttaccctatctctatatgcatctatactaggcttaatttccatggacagattccttttaaaacaatattgtcttttgggcaaagggatacaggaatggaaaagttataaagtgtatcatgtgataaacaatattggaacttatatattaataatttgtcttaagagattaatcaattgatacaaaatgagtatgttcttccaattaatcagtgaaatctggatcaatgggacttgttgatactctctgtcggttgttttcagctaacaggataggaatctctttaaagtgatttaacaatttgttgatgatgtagttcactttctagataagggttatgaatattctttctttcctcaagattttgaagactatctctagtttgtaggttaagtttgcttgctttggctaatttatcatgtggaccagctactatctaattttgtggcagtggccggtttgtcaggttctgcagtagtttcttactttattattggagttactttgggtgtggtaatatccactgatctttcgaggttatagaaatattctatcccccaaatatgttccatttccctatcccaccagttagaattgatcgaacacttcacttgagatgttttttgacccacccatgtctatttagtaaaatgtgtatagttaagtgtgtttggtttatcattgaatgtgggaaaacaatcgatggaatgaaatgacatgttagctttctggttatgttctttggaaagtatgaattcatttttgcattaatgcaaacaagtttccaaacttgtatagatgcattttaattatgtcgaatatttgagagaaattaattatctattggtggaacaatctgagtgaaggtacaatgtaagtacaaattggactcttcataattttgaacttatctgttgtcctgttaacccaagacagtgggacactaattttgtatttataaaatggactcttcataacgttccatagcaaaaggcaagaaaaatcaaattaacttttttaactaagtgtataaaatcttactgatattaatacacagatcaatgtacgtatgaagaacatataaatataagttctaaaaatcatttgagatttagttattagagcatctcgtgctaacatgcacagctcactgatgttctgtccaagtgaaggtacattgtgatacacatcagttctaaaccaatagtttcgcatatggacttatgcaaaaaggttgccctaagaggaatggttattagcatgaaaagggtagtatccatgcctcgaaggttgtactataggctcccgattgcagcctttttagcattcattgctaaataaagagtgtttgttcaatgctcgtctcaattctggtttagttctatcaggttcctttccaacaaatgacaacattcttaatttggatatatatgatatctggacagtttctcgttagagtggttagcacttcccttttcagttaattcacacacaaataaaataaaatcgcttgatacatatgatgtgattaatataccttgatttcatcttggttttttacataaaaaataatatatgaacagaaagtgaataaaatctgtttcacagtgttacttattatgataagttagttaattttattacagatatcttaaaatttaaaagtgattaattaataatataaaaactttaatttcaaaatgctaataacatttaattagaatatttgttaatgatttttagagctaatgctttccttgacataagtctggaatttctttgtctattgagcatttgatagagcatagaacccgtttgttaaatccctaacgggttttgcagcgggcttcagatgtaatctttaggaacccaatacacattatttcaaaatctgatataaaccatactatataaaagatattatttgtgggctgtttgtggcctttttattcttaaagaccaaagaactataataagaggctgggagtggcccaaaaaaaatgaaggaaaaaaaatcatacttttttcagttaattaagtgtgttttttgtttgactttaaagaattaattttgcgtccagaaataattttaaattaaattttacatatcatgttacagaagattttaaaattaattctaagttgaagtttccttgagtaatttgtatgttaaatcaaaaaatttatactgaattttattcttaaattttactcttatcttgattctataatgaaacatccaaacataaatcaagtaatttcaaaattaattttaactaaaatcaattttaccaaatcaattataaatctcttgccttgtgatttcgctttagtcgagtccacctaagttgattcacatggctataattgattaccaatttgtatttattgctcttccttgcattaaattcgtattttttttgttttttactttcaagggcagtcttaggttncaagggcagtcttaggttttccattcaacaatagagataattgtacttgttctagttttttaaaaacactcaccacccctacgtaacattaaagaaggggtgtgaatgtcactttactaagtaaaataagggaaagtgagtgtctatttaaaaactaagagtgtctatcattttaaaagacttcaaagtgagtctaatctctcctaaattattttgtagaatgttgcatctttgtatttattttattcaaaaatgcattcagtatgcagaaccgtttaaatatggatgctaattgcttataaatgactacaatataagtgtgtgagttctctgcaaagcatcaatggggggacctgtagaaataatttggtcaagtgtacaaaatatcaccaaagttataattgatgaaatttaagttctgacctctgacttcctcaatgtttttacaagaaatcagtattacaatatggaaaggattctagggattggtgctgagttttggtttctgtgctaaatatagatactatatgaattttttgcatttatgatttataaagtgttgtggactggtctttcattctttaaatgtcttgttcgaaaaagaaccttggtccggttattgtgggacactcaactgtgaaacacatgttctgttcaatgttataaatgcctacagcaccacctatgtaactatgtctaaatggtgcatctggggttactagtccccctatagcgactgaagcatctggtaggacagaaacgtgtttctagtagtatgttagaatgttcttattttaatattattaggtaattgatgctacaaacaatggaatcaatgtgtatgaggaccaccatatgtgaatcacacacatttgttctcaatagtagatggaaggttgaatctggattgaaatttgaaagattctgctcagtcagtccctaagaagaaaatgaggctttaattttcaatgtgccataactctttgctgacagcgagtgtgaatgtgactccttctcaagtatgcatgtataatcatatttggaaaaacagctgttatgatcgtgattcgtgatatatatacatgcatgtatagcaaataatgaagttgtttaaattaaatcaattgattttctcgtagtgaatataaaattatgatgcagtctaaatccattaaaattttttcatcaactcgtataactacttaatttagatgagtctaaaaacatactattctgccatatataatataccttttgctttggattgtataggccaatgactgtaaactaggaagagtgaagagtgatttatgaatattgaataatgactatggcgactctttgaatttagttgttttactgtgcctcccaccccaaaacatgcaatgcatttcatagctaccagcacagtcatttgtactggagaccctcgtggcaaaacaaactgttgaatccagtggagaaattgttgttttgattctgttcagcaagttggaaatttattccttgtaaccattttttaaattgatccattcaaattatacctattcgactttcttaagttctgaaaccataattttgaggcctcaatgagtacaatgaacattgtaaagacatcaatgtttgatatgagtgatatcaaacatatgatatatatagacacaattgaacaagtttaccaactacctggtgaatgttattgcctcagtgactgtgactgattgtggttggttcttactttttactcccaagtgaataatgtaagttttatacactggatgcactgtggtctttgctgttgtgtgacagctgttttgattgaagtgtttccttcctttctaactaaaaattaacataatattaggtactattatgagcaccaacaggcttcagttgttgcatatgtgacctagaaattgtcatgtctggaccatgttcagttattttagtaaatgttctttaaaattgtctccctgctaaatttctcttcctctaacctcctaggtgttggctgcatcagcatggcaattagcatgaactgtcaagaggggtagtcatccatcttgtgtttttgtgcaccagaggacgtttggagatgtaggcacaagtcacttggtgttttaaaagtttttcacaccatagccatgtttggcttcgcgtatcagacatggtttttcacattccggatttgatttacagaaactaatagttatagcttctacatctcaaacgtaattataagatgatttgatggcgaaagaaaaagaattgtcaatgagttcaaatttttctactaacaagaaactattaactaacatttattaataaaagaatatcttaaaggtaatttctttattctcaaaatgtttccataaatgctaaaagttacgttggtagttgcgtcaatccatcactcccagtattttactgggccaaagagcaatacatgttccactaataaatcttatatcttatatacagactacgtgcaaagctttatgtatgcacatttttttatatataaatgtcgatttgagtgtaaaagtagtattcttatatcataatggggtaatttaaaaaaaaaattattataaaatttttaaaaattacaaaaataaataaatcttactttgaaatatggttttattatgaagaaatcttgtttcaaagcacaattttattggttaaaaaatcattagactgaaatcatatatctacatataatgtcagttttttattttattataaggtggaatctattttaacatacaattttaacatttttttaattattttaaaaatcatattttaacttgtgattttaacatattttataattgttttaaaaatcatattttaacatatgatttcattaaaaaaactaaaattatattttaatatacgatttcagattttagagaaaaaaatattttaaacaaatgaaatatgaaattatattttaatatatgatttcttcgttgtgaaattgtatattaaagtatgattttcataatttttaaaaaaaatatacattatgataaaaaaaaattaaaatctatccatttccttaattaaccagtcaaagtagctttaaagataattccacctttatcgtcgaattggaccagcagagtcctcatctcacagatatacatctagtaaccttaccaatcatttgagctccactagatcataaaaaatcaaaatgttaaaatatgtcttttttaactcataactataaaaatgtatttaaaaaaataaattttttagtatggttttattctcaaaattaaaatgtattatttttttttacaaaaagtattgaatattcaaattcaaactacatccattactttattttatcaattatatgtataacgaatataaaaaaacatcaaatttacaaatttcaattttatgagcaccaaaaatatactaaatttttaaccaaagaaaaaaaataatattttaaccaaagaaaaattactctttacaagctctgctaatttcccttccaatagttttaagaaacgatgtatttttaagataatatatggttttatggtatttttgctcttcccaattgtcaaatgtcaataggaccactttgtcaatttcaatattattaacccaaatgaccttgatgatagatcgaagaatcaagaagaattagctataggagatataaaattagttatttatgtgaagactattttttgatagattttatattgttatttaagattgaaaatttttaaaatttcttttatttttctttagtaataaatattattttgaaattttaaagaaagaaagaaaaaaaattattttttaaataatatatagatattgagactcttttataagaattcattcttaatatttgatattttatgaaaaatctagtgaaaatcaaattttaagttcaaaaattttattcaaaatttagcattaaaaatattctaaattgattaaaagaataattgcagatccaatcgttctcgctaacaataattaaaattaagaaataatatttgtcaattgtcaatataaaaaaatccggtcttaaccagatccgaaagtacttcatgttattgttctcatcaccgatggactagggaatagggatgtctctcatctgtagaactataattgcacttacaaattttgtatagatttagcgtacacataattaatcaaagatcaaaatgccacgtagtacattgaaactttgtacttttgagtgtacaaatgtaaagtgtgtttgataagttattaataatttatttaactaatttatgaatttgttcaactaaaatagaaatgtttggtacaaatttgttgtactagcttaattatagcctttttcatataaaatagagtttaaatttatgacattattattattattattctttcatttttttatctccaatacttttataaatgtcctcgcttagcatctcatttcatagaacattatttattttaaattttttaatacaatatttgatcattaaacaaaaattacaaaagttttatataaaaaatgataagagttcaaaatagttttaaacattgtcaatcttataatttaaaaagaaaaggttaacttaaaaggttatgagctaaggatgcggagagtgcatgggctttactcttgagctcttatcataggtttataatgtattcagttaataaaaatatttcgaatgaatatttttctttaatgtagtacgagttcgacagatatttatgaatatgtatgggtacttgtgaatatctattagtttattaaaaaataaaagaaatgtaaagaatattttaaaaaaacaaattattggaaaaaattataatagtaagtactaattaaatttttaatattaattaaattaattttttgcaggaaaattaaattttatttaaatagttaaaagtattttaagtaatataacgtgttggttatttattgtacgggtatttcattatccagtctcatcttgtttaataaatgagtgtaaaagtaaaacacatgctttctctaggaaggtggaaaataaacttcccaaattcattctatatatagttttatttatcggatatagataattaattgtgacatccactcatcctcacatactagaaaaatggggaatgcatatttttatgctaaaatttcacatcacattgtcacgcnnnnnnnnnntcattctatatatagttttatttatggatatagataattaattgtgacatccactcatcctaacatactagaaaaatggggaatgcatatttttatgctaaaatttcacatcacattgtcacgcgaaaattctagatttaacttctttaaaataaaattgtataaaaaagtcagaatttatctcagaaactcaacttaatttaaatcatcagcaaacaagtcatttcttctcactttatgtatctccttcctttagaagagtttagttgaagcatttggtttatctataattcccccttcagaaacattaaataggtcaggtgctatcaaatttatgaagaaagataaacataaaactttcatacgacaaagtgatatagaatttattaatgaaaccctgcaggaaattaaacagcgagagtggcaaaattttgcattaaggacaacacattcttcatgtttcaagcacaattcatttctatatttttttatccgctaacgaaacgtggcattctttaattttattcctgcgtccccaaaataatataacgaatgcacactacaaggaagtttagaataggaaacaagtatccgttcgtacttcgtacaatgaagtggataaggatgaacaaggtctcccatgaaaataaaatagccatctgggtatgtatggatggtgataaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctgggtatgtatggatggtgataaaaaaaaaaaaaaaaagtgggctatatatggattttaggaaactcataaagaaaaggaaaaccaagagaagcaaaaacgtggaagaatgggagatagatagggtgagaggtccaagcgatgttatggtcaaacaaagctcaaagggcatgcacaaacaattcagcattgagcaaggtcacattcaggtcccccacatgcttaactgttctaaccacacgagtgattcagacattgtccatcataaccaatgtgactctccacacacctaactcccacacacatttatgctgaggcaccgccgctttatcattcaccatcttaagttccaataatccatcttgtttaacaaacaccttgacttctatatacatctatgtatgtagcactaagcgcgtttatcaactgatacgagattattttaacttaacttgtagtcttgaattcgaatttgaattctcagcatgcaactgttttatcaagagaaaattttattgtttaataatttaataggctcaaacagaattgactttaaatggaaaatagatgtgatttatatgtatgtcctggttgtcaaccacagcttccacaatttgaagaattcgcataccaataatgtctttgactaagttaacccctcactcaattttttgcataattagttccatgatccaagagaaggccccagcaagcagcaattttggtttcacttggcttctctaattaccactcactcataattgttaaaaagattttatggagataccttttttttttctccatcttttttccttttaaaatattgtggctgatgtgtgtaactgaaagagacctcatattttctcgtcggtagaaaagggcgaggagaaaaagataataaaagcaacagccgcatgtggagaattaaaataggtaactgatgtgagcagctacagaaaactttttaagatcactcaacagtggaaatgctattagaataagaaaaggtgggggcccgaccaagtaggaagtaacatgtgtatatagtatatggttcattatttataccattagaaggtggcaaacatataccaagtaagatggcccaatacgtagaaaccaatatcaatatgagcgtgagtgctacatatagatctttcattcactgactcgtctactggcctgcaaaataaaaacataattaaatgatccatgctgatgaggcagtctcttttggttcatatgattgttccttctcaccctggtgggcatggagggaagtgtcaccttattgcatttttaagttttgtgcttgttatcactcaattattgttcaatttaaaatttttcctaactttaatcaatttgtagtttgtgatatgacatgggtcagctaaattaacatttgagtggttagaagcaatctatgtaggaatgaaatgaagatattctcttatcatttagttttattctaatggactgagtgcccggccaactgggaggggttaggctatagatactgatcaaatacgttactagttggaggaaattggaattgcaaattcacagagtctacacctgagaatgcttaggtcatttattgttttggtttaattactacactagaatataatagagtaagtagagtattccatgcgatattgatggttcattctgcacttgccagactgttcagatttaaatttgagggaaaataatttaaaatattagagaggggataagtctagagaaaggcaggaaaaaatttgcaggtttcctctgacagatgatctcaggaactcgagattcctggaaagtccaatactatactaatattctgcagctggctaagtacaatcaaagttatcactgagttaataaaggaattagccaatggtgattttgattcttgccttgaccaatgatcttatgctgctttatttaagatactttcttggttaggtatttaggggatattaataaacagcaaagttatgtacaagaccagttatcaccatcatcaatatacagaaaatcagatcatactatggaataaacccagatgattttgatataaccggcaaaggagagaaagtactgaaacttgaaaaggtggaaaaagtatggcaatcaatctgtaggacaataattacaagggaataaccattaaaagtgaaactttttaagggggggatagcattaggaagatcttggacattaaaaaagtgggtgatcctttttgtttttgaattataatttaatttaatttaaatttttcactttctgatgactgaactttgtctgacacaaaaggggtctcggctgagattgcagtaattttgttatgcaaaatacatgcgtttgcagttacagttccatccactttgatgctgtgtatcactcaactcttgaaatatatgccgcacaaggcaaggtgctttatccgtgctaatgcaatgcaacaagccgcggattctccattttggttacttgtctgtcataccaattcaatcaaagctggccggctccatggcccagacagagggctaccatcattcttaatttgacaatgatggctcatacccatcccattcatcaaaaaatcacttgcttcaaataaaaggaaacactaaaaatagattctaatttattatatcaccagcaagctacataatactactaatatattaattaaaccatgatcaataaatacacattaagccttttgatttcccaaccctgaaaaattacaagagatttccacccaacccatcccaaaagaaagccaagtaaaataaaatcaaggtttacaaatgaaaaccctaaggcaaatccaaaataagtaaattaagggttggacagagagacataagttggggcaggaaaatagataatggtgggtctcagtctcatgcaatcagtgctcacagctcaacatagcacatttacaaactgccctctcatccccacaagttcctttttctttttttctttttttttcggtgggcatgattagaaattaatttaaaaaataaaataaaataaaaaagctggttgaggaatcggcgagtcgactcagtgagcagcaaccaccggttttgcagcgagttgccacacggaggtggcaatcaagggcctagtgtgccatcccaacatgagacacccattgttctcttccactctatacccatccccacccccgaaaagcgcgagcaacatgctagcctgcttgtacgcgttcgaacccaagtgaaccggagaaaacccggtcgaaccgaaccgattccgccactggttcagcgtctcgtgcctttccacacggtccattccctcgcacgccaccacgttgcagatttgcttccctaagtaaacctccgacatggccttgtcgttcgggttcacaggcgaaccctccagcgagtcgaatagagttgaataatagtgcagtgactcggtgaaccggtcgacaaaactcagtccgttgtggttcgcttcttgctcgacgacggtgaggatctccggccgaatctgccgaacgacggagaggactttctccaccgcgccggggcgggcgaggagcttgtgaaactcgaagacggagttcaccgctacggactcgtcttctcggagatcgagcatggaagcgtcgagatcggcgaggctgtttgcgacgaagccgcggtactcgaactgcacgtggatcgtctccgccagctgcgcgagcttccaacctacctcctggaggtggtcggagttgtccgccgccggcggtccgattccggttagccggaaaaccggaggaccgtcgttgcgaagcgcaagggcttgcatcagcgccggccactgcatcccctggttgattccgaaatcaatcacgtggacgcggtttttcccttggaacgcttcgagaatcgccaggttcgcggtgaagtgcgcgaacttgaggtaaggacaagtttcgtagaagtgaatctgtagagaatccgagagagagtgctgcagagggacgactctgtagattcgcctcgcgagcgcttcggcgaagtaggttgcgactttcctcatagctccgacctgcgacaaggctaggaagccgatctgtttcaccagcgcctccgccacggcgaggttgttgttctccaccgcctccgcgcacgccatgaggctgtgcacgaggcggattccgttctcctgcaagtcaacgaccaccaccgcgcgcgttgactcgtctgttctcacgcgcttagggtttggttgcgcgtcgctaccacctccatatattgctttccccggaatagccttgagatcgtagtccgacgaggcggaatccttctcgggctcttcggaggggagagggtcaaaattggaaagcatggtttggagccagttggagatgtcggaagggttgtaatgaacggcgtcgtttgaaagctccgtgaggtcatcttggacatttcccatggcttcctcaagacgctccagcttctgcgccacttccgccatgtccgatgacctcaccttgtaacccaccaccgcaagaagctcgtccatgcctccttcttcctcccaaagattcgattttccgcttgaataaccgcagcttgaggtccctgcgttggaaccaagctgctcgcgctccctcttcatcctttctgtttgctaactcaccaaaccctctcttttcctttctcttctattctctgtttcctttctctactgtaactagttctactgcatctccctcacttctcacatgactcgcacccaaatatcaatcaattattatatagttataaaatagtagtatatgtgtctataagtacaatcctttctttttttaaaatgtcctcggaataaaaatatttaacctggaaaaaattataaaatatttcacaaaacgaaaaaggagaaaacgctcgtgaccgagctcgaaccccaatgaaactccacgcaacctcctctaacagataagatccaaaaaaatgcatatttgtgttttactttgtttccatttctgtgtttcacttaatttaacaaataagtttttattgctgcttgtaaaaaaaaataactacttgtttgattaagtttaataactatttgaaatattgaataatgtaataatatctaattaagattaaattatttatttgagttgacggtataccagtctttttttatattttgcgaaggataatagtataacatattaacatttcccaaagagaaaaaggattcaatatcgggaaaatatgtttggactttgtgagtttattttattttataccactgcgcgccgctaatacttcattgttacttccgttaaaagcttaaattaagtacacgcaatacagctatggaaattgtatagactctacattactctatttctaggcgatgatgagatagaccttataggtgaatttggctacatggtaaggaccatgagtatcttcattaattgctaattaacattccgtagatatgcttagaaaaatggaaaaatagtagtgtttagttatagatgtttatttctttaattcatttatgatcttagttttcatatttttttaaaggtaaataagctttattttaacattaaagtgaatttgctctcgttgttattttatgataaaagtgttcttctaacctttgtcacaactataggaaagtctatcgaaatgtactttaatacaattaacacgcacatggtcaatttgtttatctttggctcaaaattaatttgagatcattggaaatttttggctcaacttgtgtatggtataatatataatacaagggagggggatttccatctcttatgtacctcacgagtggatgttctaattacattatcaaaactggttctttatcaatccatattttggtaattaagcataaaggggcagtgacagatagtcaaatttcaaccgacattaccacgaaagtaattatccttggaaatcaagctttattaaccgccaccgtctaagtaaagtcacacggaaatcagctagtagttacaaaggggaaaaaaaaagcttctactgattcaaaaagtcataaatctaggaagagtaaatcataaagcaataagttgaatgcaataatcaaagagaatgtccctacaaaaattgttagtcgagattcagttaccattattaactacaatcggatcacaccaatacatgacaacttctaccacgcatgatgactatgggcattctaatacaagtagactctcatgtaagaatcataaaagaatcgtgtgaaaagtgcaactaaaggaaagaccttttagggctgagctcctacacatattgtctacggcagcaggtcatggaatgcacaccacactagcatatgttatttgagattattgattgttggaaagttttggctcaatggtatatgttataataaataatatgagggacaaaggtctccatctctcatataccttgagtagatgttatggtcacattactaacacatcttacttgagattattgattgttggaaagttttggctcaatggtatctattataatatataatacgaggaagggggtctccatctcatatgtatctcacgtggatgttatagttacattacattactagagcttgtcctttaccaatccatatttcgataattaaacataaagtggcaatggcaagggtagaaattcaaacttccacggacactactatgacataattttccctggaatccaggctttattaaccgccaccgtctcagtaaattcgcacaaaaataagctagtagttacaagaaaaaaatgatagttttcaccaattcaaaaagccagaacaatcaggatatttagtgatatattttaaattagaattttagatcattttttttgtgaatgtgagtgtcaattagaattaaaaaaaattacttttttaaatggtaaatctcattttaaaatattaaaaaaagagaaaaaattacttttttgaatgtatatatcttcatggttgttttccaaaaagtcattattcatgttgaatatctttttacttggaaaccatgattttttttccaaaaattcattattcatgttgaatatctttttacttgaaagatctagtaaagattatatctaaaattcaagatctaatactaaaattacttaaaaaacaacaaattcgatatactaaccaaaaaaaaatatccctacaaaatttgttagacataatttaccattattaaccataaagggtcacaccaatactggcgacctctaccacatatgatgattatggacattctaatacaagtagactctcatataaaaaggacaataaaagatttgtgtgaaaagtgtaattaaaggaaaaaccttttaggactggactcctacatagatgcctaaggaagcaagtcatggaatgcacaccacactagcacatcttatttgaggccataaagaggtcaatgacaaagtcaaacttcaaccgacgttatcataaaaaagttctcccaaaaaaattacgccttcttaattgttactatctcgataaattcacatgaaaataagctagcagttacgagagaaaaagaaaaggaaagttttcaccgattaaaaaaaccataaatctatggagattaaagcggaaataataaatccaatgtcgaaggagaatatccatacaaaatttgttgaacatgattcgattactattattaactacattgggttgtcattaagtgacaacttctaccactattgatgactatgcacatcccaatatagacaaattctcatgtaagaatgacaagaaaagaatttgtgcggaaaatacgactcgggaaaaaccttgtagggccaagctcttatatatgcaaatgtccaatggaatgcatctgtgacattatatagaaatagtactcgttgatatcacatataggctaacagattacctcaaaattaggtctttgtgctaaaaaaattattatatcaaacattataatcttgcacaacttggtctttgcattaggaaaaaaaaagttgttatgctcatttaaaatctttttatcattcttctttgatattctccttgcttagcgcattgaatttattatcttccaattcattttttttagtatgctttcccattctctctctctctctctctctctctctctctctctctatatatatatatatatatatatatatattctctgtgatattctactaaataattgtggtataaacgttgcgggtaagagatcgtagaagctttcttttttatcagtagaagctttctaaataaataaataaacatcgctaaagtattatagcttaattattttcttgggttataggagacatgtcgaaggtgattattatgggtctcattcaagaagttactgctaataaatgtataccaagtattcgtaaaattatttttacaaagacgataataaattttaaattacatacaaattatttaaattttattttttaaaattcaacgggactaaaaatccggaaaaattatttaaactttcaccactgtaccaactctactgcattaaatagtaatgcgttaaataaattttatttagttatcttttgtgtataatgagtgcaccaaaatttaaatttataattacatgcatattagtcccaatcccccgccactatannnnnnnnnnatatcacatataggctaacagattacctcaaaattaggtctttgtgctaaaaaaattattatatcaaacattataatcttgcacaacttggtctttgcattaggaaaaaaaaagttgttatgctcatttaaaatctttttatcattcttctttgatattctccttgcttagcgcattgaatttattatcttccaattcattttttttagtatgctttcccattctctctctctctctctctctctctctctctctctctatatatatatatatatatatatatatattctctgtgatattctactaaataattgtggtataaacgttgcgggtaagagatcgtagaagctttcttttttatcagtagaagctttctaaataaataaataaacatcgctaaagtattatagcttaattattttcttgggttataggagacatgtcgaaggtgattattatgggtctcattcaagaagttactgctaataaatgtataccaagtattcgtaaaattatttttacaaagacgataataaattttaaattacatacaaattatttaaattttattttttaaaattcaacgggactaaaaatccggaaaaattatttaaactttcaccactgtaccaactctactgcattaaatagtaatgcgttaaataaattttatttagttatcttttgtgtataatgagtgcaccaaaatttaaatttataattacatgcatattagtcccaatcccccgccactatannnntataattccatgcatattagtcccaatcccccgccactatactgaatttagtggattaaatcttatttactttaaaataataacactcatgcatgcgtagaaattttaagaaaaaattaatgcctcaactttattgtaacaactagttaagaacttcaattttactttaatgatcagttaaattatttaagtttaatgataaaatgtttgaataatttcatcaattaaaaaagtttatatgaatcataaaatgctattttttattaatcctcatgatattctatataaaaatattaaacatataaaatatatttagtttttttctttatttagtaagtaggaagagctatagaaaatgttatggaaaaatataaaattatccataaacacaatattaattaaaaatttaaacacacattattaaatgctttaaatttttaatggttcaactaaatgctttgaattgatactttaaaaggtaagtattgactttatattatgaataaaatattttttaattttaattttttatcacatatatatagacacacaatagaaaaatttgtaaataaataaaatcgtgctgaagtaaaatcataaataggtttatgccttacacattgactttgattatagcgagaagagtagagtagagaagccctacaaagccgaaatatagtaacctgcattgaaagtttagtacctacactctacatccaatgcatccacaataaagtcataatttcaggaaaattatgggattgacgtacgggtaagtaagtcaaaaggagtgataattaacgaacacaatatctatctatttatctcttctttcatgttgcaagttgcaacttcagttcactctaagaagcgcgtgagaaatgctaatgggcacgtggaatgagattaattattgtaaaataagagattaatgaaactctcaaatgtcagctctgccccacatgatggagaccatttcactaagacggccccgccgtccacgtcagtccccaccctttacgcgccgtcagtctccgttatgttatgttttaacctaacgtccttcgcaacgcaggttactccattttatttttttgatctctagatagaatcgtaaaataaaaattgtaataagaaatcatttctttttatagaaactgagttatattattattagagtaaattatgcatattctcttttgatattttgaacgtaaacaacgttgaagaagaaaggtcatctgactagcacatgagttttattgaacatttttttaaatcaaaaatactatcatcgctttcatttaacatttgcaaacagaggatccttatttgcagaatacctcaagaacacaaaaaaaatactatgaatatcatatttgtgcgtacttaatttttgttttttgtcaggattttttagttgacatcaaataattacacatcaagaattttaaatcaagtcaggtctgaatccacgtattgcttcaaactacttcgcgaaaaagatgaggaacgcgtgaataatgcttctcccaccctcgttgaatcctatttcgaatcgcattgccaccactacgaaaccaaccacgcgtccgatcccctcatgaattggaacctcacgcacaaacaaccctaaacccaaaaacaccttctgaggttgtgaccaccaccgcaagttccttgcccttcttattcgacgccgcatctatgtctcccacagttcgagaccagatgttgatttgatgagtagaaagcagatttggcatggaggaggtggcgagcaccgacaatgagggtgggggaggcggttagatcagatgatggagtatccagccaaagaaggttgtggtctgagaaatgaacactccaaccctaatctctcaatgttgttgagaggaacaaatttggtttatgataaaattatatttaatttatttatttatttttaaataacttaacggaatcaggatgtcatttgagacaggggttaaaaataatgttctaaaacggaagaataatacatataataagcataaacctcagaagtgatcagtgtaattaatttgatcttattgctaaataaagattgacagcaatacaagacgaaaactcgaaatagaaagggtttgtttaattataaacaatctctaaagtttggtaaactttgcaacaacaaaccacagtgttgaacagtaacactaaattcagaaatagcataattaaccagatcattttgactctctcgttattcgaccttttaaaaatcactaataatcaaatacgtgaaaacattatgtttgtttaatatttagaaaaattaattaaaaagcactaattgcacattcttaaattttttagttacttacaaagaaatattgaattattttttgttttgaatataattaatattttaattttaataaaatatattaattttcttagtgtataaacttgatatatatataacagataaaaaactgttgacaaactttataaatgatagaagtgaaaattatttgaattttatttataacagaagtttaaagattatgtgatagcattctcaatttttcctgatatatcatattataaaatattcattttaagtagttgatggttatgaatttttaattaactgtgttataattattaaaactttctatttatagataattgttttctcattgtaattttttcatcatatgtttcattgaactatataataataataacattaatattaatatggcatttattaaattaaaattatacaattttaatatttctatattttaatttatttaaaatttattttttagcgtacacacatgagtgatatactgatactatcacatatttatgaaaaaagagtgataacatgacaggctagaatgaccagaggcggacactgacgattagggtgagcactgccctcctaaaattttattaatataaattttattgtatatatatatatatattaaaaattaaaaaatagtttaataaaaaaaattgtattacttaatataataagatataatatttttaatattatattaaaaaaataaaataaaatatttttaagattacattgcataatataatagaaatttttaatattatattacataataaaataaaatatttttaaaattgtatttaaaaataagttcgaacatttttaatattgaattaaaaaatatgatagaatatttttaagattgtattacataatataaaatatcttaatttaaaattacattgcataatatgataaaatatttttagaattacattcaaaaattggttaaattcatatgcttaaattaatataaatagaaacatatttttgtatttatagtatacattccattccaaataatgctagagttttagaaagtttaggtttgtatcattgagagaattgttatgagatcatatataaacgtttgacaagtctgattcttaactctccattaggatttaaagttatattattatagtagagttatctattggattgattatctaatttggacgttttaattttttattcaattgggtttttcaagttaaacctgattatgtcttttttatctattattttcatattgttgttttgaatttaattttaaattatgaattattttattaaaacacattagactttattaacttattcatcaatccaccctgtttacctttatgtagtttgcaatttgtctcttttatatattagatttttattgtcttcataatacttttatttatgatataacttttttatattcgaccccttttaataaaatttttacaaaatttttacttccgcaactgaaaatcacagtataaaatagctacaaatatattgtaggatttataccattatccatcttttcctacggacttttccttagcatgactatcgcaacaccaccagcatgtgtggaaagaaatgatttttaacaaggcatgtgtgccattaagtgagaagctccaagactcgatttgtttgtactaatctacctaacattaattttaaaataatgtcaatgtgtttcatgggaacaagatatatttgatttaaatacaattttgttttttttatgttttttaatttctattttttgttcttttattttaaataaagatatttgattcttttatttttaaaaattaataattatggtttaatcatttgcttacattttattttttatattttaatataattaaatttagacctaacatattcttttaaagtatcattaataaataaaatagttaattaaaatataagaaatatatagataaaattgatgattgaatcaaaattgtaaattttttaaaatagatgattaaatatttctatttttaaataaaaagaccaaaattacaatttaaataaaatagaaaaactaaaattgtatttgagcttaactctaaatggtatttttttgggtatgctaatttgattttagtgaaaaatatgaagttggtgacaccgtcaaatgagaacattttatttgtggaagcacacgttgtgtctaatgttttcctcattcacttgattattatcaggaccaattttgttgcttgttaacgaggggtgctgtctacggtgaagtttctgaaaaattctccaccggtgaggcaggttggtcaccggaaaaaaaaaaacattttttatttcaaaatgaaattatataaaatttataataaaaaaagcctcaaattacgggagagtctcatattttcctaattcttcttccccaacccaggaggccaggacgaaacttccatatctactggtgtttctcctctgtcattttaatagcttggtcaataacatttctactatgcaattttcttccttgccgggaacggagaagacgtccctgttgttgtcctcgacaaacatgattctttttcttcgcagatcgatccagtgccagtggtggtggtggtgccgttccaccggctactgtaggagagagagtttacgaaagagatagggtaaaaatccacctctcctctatttttctttttctcttcctctcatgaaaaaatccaccttgttatttgtacaatttccttttacttcccgaagatctcagcacttaaaatatgaaaaaataatcatcaacttcatcagtcgaagcttatctacaaatataaataatgaaaaagagataatgaacctccaggaaattggaaagtgaagtctgttcacaattcttgtttgctatcatcaaacaaattagtaggggcctctggaagtctagattttttctttgcgaggatcggagaagtatttgaaacggtgccgagttcatttctttttcatttttcagaaaaaatgaaaaaaaaaattacctattgatccagttaccattcttaaatcttaatcattaaatattttattaatatattctatggttatttttattgcttcgtgagtgtacctcaaaataaacaacttcatattagacttggccgttaacgagggttgaaaaggagattaatggctaaagtttggtaactgagaagaggaagaagaagaaaaaatacaaagataatgagttttaaggttgagaaggacaaaaatgtatcctatagcacgagatgcacatgaatcatttttcttcaaaacatctcaaaaactaaagtcaacaacctcaataattttgaagaggatggtaaagacttactctaatttgacgcagtttttctcaatgcaccacgctaaaaaaagatttggggacaagcaaaatcattgagcacgatggctgtcaggaaaggattatacggaatggtttgcgataaatggtttttcttttggacgaaaatcacatctaaatttagcagcgcagccaaatgacgccctaattgtcatggtgcacttctgcacaaccatccaaacatgtccttctgataggactgtagtaactaataactaagcctcattttcaggtattcaattttaaatcaatctaaaataaaaataaaaaattataaaaaaattgaaaatcaaatcaaaataatttttaaaatttttgaatattttgttctcacacatatctgtttgatttaatttataatttatgattttgaaattaaaccaaatcataacacttatattattatttatgttattttagtgttatgcactttatttatatatatatatatatttatatattggtgttgcttgcattatttttttcttctataaatgcaatgcaggatttattaatcgttcatcataaatatcatgcaactttctttcgaactttataaaatatttaaataaatcagtaaattacacaacatgatctatagtcaaatgaaattattaatatttttttatttctatcaatttgtttggtattgatcatctttttttgataattaaacgtttatcaaagaatgactaacaacttttttgggttttgtccaataccaaagaaatcgatagaatttatcagatcaaacaattttaatcatttgaatagagtaaattaagaaaaaaaagagagtaaatgatcatgtttatcctcaaaaagtgcaagtgttgttagtttagtcttgaaaattgaaactactaaaatgatcaataaaaaaagttcataaaattattatgctattattttattcctaaacttaattatttattattattttattttttaaaatttgttaatatcattgctttaattacacaattttttaagttttagactaaaaatgggtgtcaaattacacttgtaaagagatttttgtcattttattacttttaggaactaacttgacatgtctcatgtttccaataacaaaatttgtcatttaccctaaaattaattatatattgaatgaagatatcaaccattcaacatatacaattttttaatttaatagagtcggcctaatggtagagggattggaatacaaacacgaggacttaggttcaatactcgaggccaccaccgtaaaaaaaattaacatgtaatgcactgaagacatgttaattaaaaagtaaaataacacaaattattctttttggacaaggtttaaaaatagtttcattctcaataaagtgaatgattttttttatccctgtaaaaaaattatttttcatcttctaaaatatgaaatctttgtttttaattcctattaagtttattgtgatctatgtaaaataattttctttgacttttatctcttcaaaatttcatatcactgtttttgtcccccaactctcactctaaagtagataaatggcatttattttaggaatctgaatttttcttaaagtatcaaatattgacaaattaacacataaattagtaggtgccacctagaatggtcacccaacttttgttaaacacaaacattttacaagtgttacataatagtaaaaactaaaaataattaatttaactttttgaaggtctaaattaaaaaatatacaaaaaataaaactaaaattcacttatttgagaaaaactagaagcatatttaaatgtttgaataataacacagcccaaataataacatatataaccccttgtctttaaacgtacggttctctcgagtcctgagtaatatgaacttttcttttttagggtgaccaatatgaatttaactgaggtatgtttttacaaatttcgaaataattttaacttttctttataaattatggttcattatctttccgttcctaatttttttatttctatctttaatccataataatctaaatttaaagtagttaaagtctttaaatttttttttatattattgttgttatcaagtaacaaaattaagtgaaaaagtaacaacaaaaatattggtattgctgtaacttgtcacataattaataagttgatgagataattatgagtaatttaataaattttatttttaatttctcatcttttttaaaaatgcagctttaagaaaatcatgtgattattttatgagacttttttatgacatgacaagtgactgccaatgatattccttaaatgcaaagactaaaagtggtaaaaaataaaatgtttagggattttagttaatcaaaatttaaattaagtaatataaatatacattcgaaaaagtttagggagcaaaataataaaccctttaaattaacgttttaaagttctcattttaggcgcatcttgtgctttaattttatttacttttaataaaatcatcgttgtctataagaaaattaacattttaaatttaatcaagaacttgttttaatgaagtctacatcaatctatatctctgacaaatcacaccacctaatcatattttaaaatatattcaaataaaaaaaaaactaacatgacttttaatctgctgactgtatatatatgatgggtgaactggtatatttgatctgtgaaggaaaattaattaattaatctattgatggtgtttgacgttaatgccggcctttaacattttggacgagtggaaactgccgtccgtgcaagctttatagttatttaatgttattataaacagaaagaagatcacgctcatccatgatgtgagcttatctatctataaatataattgagtcaggtataatcattttttcactgtgagagagactcaactcaacagtggtaatcattcttaatttcaaaatcaaatcctggttacgatagttaaacaataataaaattatgatttatttaaaaataaatatatatatatatataattaaaaactaaaaactatcattttaaaaattactatttaaagtaatattttaaaaaacgtttaaagttaaaaaagtgagttcattttgatttgtctatttaacagacataggatttggttgggcaaccaaatttacagtctaaaaaaactgagttaatccttcctgatttcattctttgattcactaggtttaagccgaacaaaattcaatgtgccaactctaattaaagaattatgcaaagcatgcattatgtgaataacaaaatcaatgtgcatcttcgtttcataatataaaacgtttaaggtttttatgtaagtatgaatataatgaatttattaaattttaaagaaaatattagataattttttaatatattttttatttctctaattaaggattcattcattcttcctatgcactactcccattaagtatttattaaggatattttaggaaaaaaaatatttaacataacattggttttataaaatgacatattttaaaataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctctaaaacatcatatattctggaatagagggagtattaaaatattcatttatttctaaattatatgatgtttttaagattttgacacgtgaattaaagaatataattaatttattgaatttcaaataaaatattaagtaattttctaatatatcatttatctctttaatcaatatgtcatttactcttctatacattattcctactaagtattgattaaggatagttttggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaatattaagtaattttctaatatatgatttatctctttaattgctatgtcatttactcttctatacattattcctactaagtattgattaaggatagttttggaaaaaatatttaatgtggccttgattttgtaaaacatattttgaaatatttttttctctctaaaacgttatataatttgaaacgaaagaagtattttcaattcaattttctttattggttcaccaaaaaatcttttattgatttaggtgatgcaaataacctctatgcaataatttggttggatatttttcgggtaactgtcgtagttagattccttgatttttcagtgggaccttgaagtattcgtaaagttttgatctttaaattaattataaaattaatcattttgtttgaatttagttatatttaaaattcattatctttctctaagaatgtatgatgtgaaaatcaaattcaatattttcttataaactcataatgtattatcaattgatttacaccaacaaatgttggacataaagaagttgaaagagaatggaaaacaaatcaaattaagctacttctcttgtgtgaataataataataataaaaaaaataaaagtggtccaacattttctcaatctctccattttggaaagaaagttggtcaaagatgataaaaatattaaattaaccttatgcttacatatctattttttttattaaggatatttacatgattttatatacaaatttttctttatttctactttctacataacaaatcaagagatgtaaaattttgaactttatttcttttcattctgacttctaccaaccaacctaaaaatcatctcattatttactattttttttttcttttctttcacctttcatttttttataccagacaaagcatacaagtgggtgttaattatagctaggcatataaaaaggagaagggtggcctagatcatagatgggtcatgggtgattcatcgttctcagcacgagcgaactagcaaagcatgcatcactatcaatcctcatttataggaggaaaatgacgagcattgtttggactcgtctaatatactttgcagagttaaaaacaaaattccgtactcagggagcacatcaaagtaaacatttggaataaataagtttttagaataccatgtaattaaaaaccaatattatgctagttgaattaatttgacaacaatatttgtataatttcacggtcaaatagaaaaaataacattatatattttggcaatttcagtttggttagtatacaaggtatatacatcattcatatgatatggatgttctcgtattaatatctagtaatgacattttctgagaaaaaaaaacaattaataagtttcatcattatttatataggacttgttaatttcaatttttaaaattttcctctcatatggcattatcatgttagacatttacacgaggatcttgatcttaatacataagggtcacacaagtatatgttacattactgtaaaaacaaaaaaatactgtaaaaaaaatacatatataagaatttgtccagcccattcaagagaaattgaggttttagataaaataataatagtattttttaatatgataaaaaattaaactcaaatattatttaaataatttaattttaacttgaaaatattaattatatttgtatccaatcacttaattatagtatcaacatttttttatttataaatacttctaacatcatataactgattgtctgattttcaagagagagaaaaaaaaaacatgtttttgctttgatgatggatagactgcattattcagccaaaaataaaataaaaatggatggactgcatttattttcacaagacgttttatggtaccctcttccctctatatactagtagatggatgggttcaaattaatacagattttaattaattatgcaaaatttccaacacgtcaatttcttaataatgttttcatatcatcgaatcaattgagcacttcattgaatatattaaatggttcttgtctgcgggtggcaatgtgcaatcgtcctgataggagaaagaagaccaatcccaaagatagactatactgcacttcttttctttgattttcttagaagagaaaataaagagtcatagtcgatcattcaagacctaattagtagtacatattgaagaatatttaatatttaaagctgatgtgaacatataacagaacatctaataaatataaaataatatagttaaattaaaatattcttatttaattctagtattttttttgtaattaaatattattgtagttattaaatagagctacagataaaaagtaattaatgtaaaacatcaacgataattttgattttttttttaaaaacaatgaatatgaaatgaaggtagtatatatgagaaaaatttaaaaagatctaattggattggttgagcaagatctaattcgattggttgagcatcatttattataaacccttcacttcacattaagcaaatgaaagcaaattacaatcaacggatcaagtttgttagttttataatttttcaactcaaacatattagacttatcgtaacgtataatctatcaaataggatttggtgtatttctttgtacttcttttctggtttgagacactcctttgttaaaaaccagttttttttttagtaatattcagttttgtctttaaaaataaaaaaaaactcaaaacttgccagacataaattgggtttgtctttctggaaagctaaaaattgaataaaaattgatcaaaactttttttttttttttttaaatttccgagtcaaattaattgagatccgcttaactatttttcaatcactgcatcaacggcgtcagagcttaacgttataacatctcgatgtttaattcaatggccctcacatatcataccagtatcttgcaggtggaagtagaattgtttcgatgttactagtactagctaataaggaacagaaaagtttcactttctaaaaggaaagtgaaaaatatttatgtacctaataaagtaacttagcattgaaattcaatcattttcttatgaaatttacttaggctttccaagaaagtcgaaaagttaatgcacttataataacccttgactttatcaactttcattatttactaggttttttcttctctggataaaaccaaactgtagttaataatagttaatgacccaatctacagagtaaccataaatgaacaatttcgttgaaaacaattgtatccagataagaaaataaagagtcccatgaaattaaaatttctgtccaatatctcacaattagtaaaagaacctggattagaaatcactaggttttgtttaattatgaacgtcggacaagagagtaatatgactctttcctgttagtcaattatttagctatatatgttaataacaagaggtacctaatgcaaatgtacttttctctaaaaattgtttgatcattcttattttctagtaagattttttatatcatgctctagctgaatatatttgaaacagaatggagaaatccacctttgtttcaaccatcatatcaaagtttttccccaaacatcttataacaaacattttcatgtgctatatttattttacacattgtctcatctgatcattgttgggccgaaagctacccacgacccaattgatagagtttcaactaatccaatccacaaatgatatgtatcatgatttcgtacttacttggtcctatatcccaaaaatttgaaggatacactctaataatatcttatctttggagaccacaaagatatataagatatgattaaattagatcaccacctaaaagactagtatataattcaagttggatctagagataagggtagattacatactttagataaacaacctcaaactccggaagaagccctatatcaaaaacataaatattttctatctttccaaactaattttgactaaattaaaagataaacacctattaactactgtccaattacaacaatattttgtgtgtgtgtgacaaaaatattttaattttaataccatccaaatataatgaacattagtggacagttatttttgaccactctacttaaaaataataactatcttatatatagagaatcttaatgtttaaagttagagtatctcgaacctaataatcgaattccaggcatattatgcaagcaaaactttgtaaaagatacttaaaatacatatggaaggaaaatatgaggaaaaatcagaaagacaatataacatgtaggaccatttaatgttcagaggcatatataattgtacctttcaaagattcttccgatatttcgtttagggtccaagagttggttggattcatgcatttgcactgagggaggggggaagagaaccatacattggtatctaattggggccacaagatagcgagatttaaccccctgccatgtgcatcatggtccatcttagtaatctagcttggttcctgcaccttagtgtgtagcttcccaccaatcccatctcagaggctcagaaagtgaaaactcatttgaaccttaggggagtgtttgttgtgaattgcttttggggtcccgggtttcaatttagatgcacatgaaatgaaatcataaaataaaaaaaataaatgcctttaagagggcatgccatgttttactttcacccttggactaaaccaaagtgggatcaactgctactttgcttcaccaatcccaaccctgcccatatgatcatgtgcatgtgatgtttggttttccacaatccgtggcccgtccttgactactaatgaaagtgattttttcacttctccttctggtgctgatgtctgccttttagttttaatcacgcagcctcatcaactcatgtctttgatggaggggatattcttgaataagcacggttatagctagggatcagttgatatggggactttttagtatatatgacaccaacacaagattgcccatgtctagtgtgtgactatggtaggtggctagtgtttacttgaaattttctctagattaagtgctgaaatttgagaatagattcatttatatatatataagcaccaagagaatgtatgtttctttgcttatgattattctttattaaaaatttgtttaatcatttttagtagattttttttattttaattatattttttaatttataagatttgagttgaaattttatttaaaagatttgaatctaatttcattaggatcaataacatattgataaagaaagtatgtgcatttaacttacactgcaacaaaatttattttgaaacaattatattgtgatataaactaatggttggtacttagaaaaaaactatggcttgtaaaatattattagattataatttgtggtaaataagcattagtatgtaaaaatttaatttatagcattaataggcaaaagttaataaaatggttttttttttttacaataaaatgattatttacgtgcactcactaaaattttcagtaatccttttatcatcctgaatacactaaccataatctaattgttaacaaatgttttagtagttatttaaattgtcactaaaaggcataataattatcacaaaaaataacgtttgttatagttgtcttgtactatagaattttataaaagcaagtagccataatctagcataagtaacaaaagagattttttgaataatctagcataagtaacaaaagagatcgtgaatcattgattattgtattgcatatttttttaacaggcattcgatttattttttcttgtcgacgtagttgcggaatttggagcattgcatcaatgtattgtatgtaagaaatatgaaggaaaaaaaaagtaaatttaaaattatattacaaaatattatattttgttgataataaaatataaaattaatttcataatattatttccactacaattaaaatgagcttcaatttagtcaccatataatgaaatttagacgaattttaataagttaaaatacatataaattgtacaaacagacacctaagagagtaaataagaaataaacaagttagtgactcaacaaaatatattcctctcaatttattttatgttcaaagataaacatgactcaaactctagattatttagtcaaggaacacaatttttgtctattattatgaaaagtctatctaaatgtcataatagtgcttacttgttttgtgaagaacgttttgattttgcattttcaaactctcctcaaattggatggtggggaatctcacccctagtagcaagtagtgtatggataggtttgaagactgtccccacatcttgcattcgacccgtacgaaactacgaatttgaggctaatcccttctgcttcagcttccacttaactcttaaagaaataatattatgtttattattgttactaacaaagttatgagcttaaaatctattcacccacaatgtaaaaaaaaccttgcatactcaattaatcataatttcataaatgatgttaggcatttaagttaattatggtaaacgtcaagaagttagttatttaattattttttccctgtttaatgtttgttttgaaattcttcaaatttatgagattggttagttaatcataataacgcaaattaattgtataaatttattttaaaatattcataagtattttaagaaaagccagaacaaatgcaatattttaagaaaaaaaaaattctgagaaaaatgctagttttggttcctgacattctttcccaaacctaaatgtaattatcactaatcactatctatcggttgagaatgattcctcgttggtcattaatcaagtttcaagtgtctttcactctttcttgatataaattaggttgctttgcttggattttttaggtttggacattttttacgattacaacatatctgtcgacttcttattgttaattgtgtgggctaatgtaattgtaggctttgattatgggtgtatttttctttttggttggtacggttagttttgatatacttatatgagctcagtatatatttattgtgtgaacttataggtctataagactataactttatttatgttctgtgaagtatttttttaaaatgtaaatattgttgaactcacaaattaaataaaatttatatctacatagctactcctcgtctgcattttagtcttccagcctgtaccaaaaaaaggtcactgtacaaataaaaaaaatagtcatccagcatttttggtagccataagatatgagatagagtatctaaaaagaaagatacgagatagagagcgctttgggcttggacaaaggcttttcataaacatggagaagcccatgctgtctactgatccatattctgacccaaagtgtatttattcaaaagatccttttgaaattgacattagacatttttaatttattttttttgtgtaaaaaattataaaatatcatattttttaaattttattccccaaagtaatgacttaagagaaatttttgtctgatgtgagaatacaagctgaaagaaagatcattaacgtgttaaacgtacaacatctagctgttcattttcaaccgttcaatatattatgaactagttctcaaactgattggtatgcttgaaataaattcaacttagtttctgagttaaaaaacaaagnnnnnnnnnnnnnnnnnnnnnnnnnnnnnnnnnnnnnnnnnnnnnnnnnnnnnnnnnnnnnnnnnnnnnnnnnnnnnnnttatttttaatattatattaatataaaaattttataataattagactatacacatagtacattgacttgatttagaaaaaaaaattattattttgtttcatgatttagtttacttaaaaaaatttattccttaaatttaatgttttctccgtcgctagtaagatataattgactaatttacatttattgaaaaattagttaagttaataattaatattgaatttataatatttttctaattttattcttaattttattggaaatctattcatcttgtttaattttcatgagagagaaaaagataatttaggatattttaataaaaaaattaaagtatgcgagaaatgaaattaagtcttataacaaaaaaacaaaatatttatcgattatctcttggaaacaaggatgcagggagtaaatttaatatcaattgagttcaaatgaaaaaaatatatttgaaagaatgttatatttatttttctaatattaaaaaatattttagtttttacgaaattatgtaatagatgataaacttgagaaataatttagtgatttagtatttaagtataagaaaaataatttaaaaatactgtcaaagagaaaaagttgcagttatataagtgtaaatgggaaatgtttgcctgctacttttaaaaaccagcgagagatttgtaaaaggaaaaaaaaaaaaaaaagcgagaaatacaaattggaaaaagcgaatacgttgtaaaaaaacaaaaaacagagaaattgttaccatttgtgatttgagnaaaaaaaaaaaaaagaagcgagaaatacaaattagaaaaagcgaatacgttgtaaaaaaacaaaaaacatagaaattgttaccctttgtgatttgtgagtttcctacgtagtgttctcattcgttgttggtcgtgctcgtcctctttctgtcgccattctcgtcgatccgaagcgcaaaacaacctcaatccctacgaatttcgtgtctcgaactcgatcactaatatcaaggtaacaatcaccgattccaaaatctattgttctgttcgatttgcatgttaatcttcgtaatgattttgatgcttagattctcttcgtggaagcctatggctttttcttttgttttggttgttgcacttgcacgctcatagggatagctatgctggttgtaaagtcttgttctttattcatgtacttttgtggggttggtctaattacggcttgtaattattcaattctcattcctatacattcatatttggcttttccaaaaaaaaaaaaatgaaaatgcatgctttctgggttgaaataagtgcgtttggtttagaacactctgctgcagatgatccacggctggacgcccagttatgatctccaaaagtaggaccccaaatgaaaaaaaacataatttttctcccctacaattccatgcatgaaatgaaatattcaggagcacaatagctgcaaatcaagtaattaggtgaatatattaaatcacgagaacctactaaactctagcattagtaattttttatttgcgtacccaaatgtgccttcaaattttgatacattatggtgagtctattgttctggtaaccacttcgcaagcccaaaatcacatatctggataaaatctcaatcaattaataagggagtgatatatcagaaagattgcgtcaaacaacagggagtacaacagagccttaagagacatggccttctactaatctaatttacaagccgaacatgaattagcatcatttagccattagcacaaaacatgacatgaaagctcagttcatgtattatctcttggcaaaagttgaaattttctcagaggataagaataatattagaaaatagtattctattgcttaattaatgatgatatggcatatatatatacacacacacacacacatgaggagctcattacagcaatagaagttaagtttggcaatagaagttaagtttagcttagcttagaatattggaacatatcaattgataacagcataataatataaaattgttacacctgaaactaatgatgaagttaatgctcctacacacccacaaaaattcagaatacattcatggagcctaagtttcatgtatcaaagtaataaattcaaaattctccatgacctgaatattctctgccttaatatctctatgaaggattcgcctgtgacaacactcatgcagatagaggagaccatcagctattcccagcgcaattttataccttttactccattctaatttgtttttatttgaacctggaatacacaccatgaaagaataaacagtaaatactaaatacattaacatcaagttttctcatacaaggaatctgcaatgcaaactaaagtacaaaccatgaagaagagatcctagacttccgagtgtatatagttcaaagactagttgcatttctccttctggcttctacacaacatccaactagcctggcagtattaggatggtcaacatgagcaattacacctagctcacatagaaagcctgcggttttttcatctgtggtccctttagtcaattttttcacagctattaattgcccatcttggagacaccccttgtaaacctcagccagaccacctcttccaattatattttcaacatgtaaaaggaacgatgaaaatcaacctagtcaaactgatcccctctaagagtaaaaaagagcattagaatcaaaatgtgacatagttagggtgagatttcagaccattgctaaaattgttggttgcatttctgagttcagagaggctgaaagtaatccaagaagacctgaagttgtattgcttatttagaacttggttttctcttctgcttttgcttttccactttggtatgttgggcatactaggaggagagagagtgtgccctcgtgcttgtacaagtggtttctgattcaggtgattggtcgtgagagttaaagtctttcatgcagacttccaagactcctcttggtgatgctatatcttctttctctttctccaattccaaatgcctcaagtctagggttgaaataagtaggatgtgttgcattttgaggtgtatttttgtgttcctattttctatcacaaatattttaggggttgaaaccttttctgttttatttttttacttgattcctttgtgtatctttccccccttccccttgtactcctttagacttttgattataaagattaattttttaatttttggtaatcttttacttttaaaaaaaatgcataatagaataccatctaaatctaatttggtcagaagaggcattattatagatgaagaagggggttggtgtgggatgtagaagtatgacataatgatatgaatatgcattttcagcagtttcaggggcgtaaaggactggtataaaagtggaggaatggaatgttatttggtttgctgtgttaagggaaatttggatcaatagaaaccatatgttgttcaggcagaaattgattaatatacaagacatagttgagaatgttaaaattcattcttggagatggttgagggcaaggaggaaaggttttacttattctttgacatcatggatatcaaatcctagacagtgtcttggagaaagttcaataatttttgaataatgatgcagaattttggaggttgaaaatcacttgtataaggttggctggtggacattggaattagcagttgctgaataatgaatttcatgtgagatggcatgggatagttatggtgagggaccaaactgggtgaatgagttggtggatattattatgttcaagtttggagacttatggaaatggtcaaagtcatgaaataattctcagatatcagttggggatatggatcgaacgcatggtgggcacttggttctggatctgctatgtacataatttagatgtagatggtccaattttaaacagatacaggcagttaaaacaataaaagggaatgctttcagatgtgttgcaggaaaagaataaagattgatcctgttatgatcagaatcgtgatgcgcttttggtcctttggttgcttcaaattatgcaggtttaaagattggtaatatgctgcagcatgaagtgggcagagaaatatagttggtatctaaagtttttttctattcatctatgttggattatactctgggtgttagctagaggtattttgaactatgatgtatagtgtttctgtctttgttttgggcactacttgtgctaaaactgagtgttttttaatattatattcatcaatgtggaatcaagcatgtgaaaaattacctaaaattgcatttaagtgatatttcaacgtaaatctagagaaatgtgaaaccaaaaatgcactaagtctgatgaaaacactttcaaaggttttatatgaaaaaatattagttatttgacttgatcctgactgacccaaaaaaggaaatttgtttttgcagctggaagagatgaattggatacagcgcaagatctacctttacaatgtgacttttgggctgtatatgttggactggtgggagcgctgtaccttcagtatcctttattgcactctatagtctattctaaatggattttaactcctttatgtgttttttcctttgtaattctcttggaatgcaaaattttgatcatttcgagatatttatgtggggggtttctttaaaaaggttcatcaattgatggaaatttgtttgtcacatacgtataagttagtctgtccaatagtggttttggggtcctttggttagaaagacaacttaaactatgttagagaattatgaaaatgaagttaaggaatttcttaaattcatatgctgtcttgtctgttgtggtactgcttgttggagttcctaaatttttgcagatattgtggtgattgtattaatgtgtttcgttctacgttatgttactcagttcttcaagaggtagtgcatctcctccatctttttaattagtgacataaattgaatccgtccaagtcttaacatgcaggtagtttactggattataaaaaacaaaaaaaaaaaactacataccttattgtccagatgctcctcgctatatgaaagtaaaggggagagatattgtatgcagccttatccttacatatgaaaagagacatatttccaaatttgaacccatgatcaccaagtcaccaaaacacaactttaacgctatgtcaagactcgccctcagtttactggattataatgatatataattatttgtggttattaagtctgctagtttttattgcacttattcttgttaattagtaatgcatatcactgcagtctgcaaagaatatttaacatgcatgtagtaaaaagcacactctgacatttctccaatctccacctatgcaaactcttaaccaaatactttttacgtcattaatctcctacatttgtcgctataaagggctattagactatatacaaattttagaaaactcagatctatatgtaacatatttacggacttctacaatgatctgaagataaccattggtcaaaactcaaagttgagactttttcaccaattatttatttcactgcagtcaatgtaaattagagatcgaagccaaaataagcagagtaacatactattcttggggggattatatatttaatccaattgatgtaaatcctttgtagtgcagcaatataccattctgagagccctttatatcttagcatccgatttagctcccattcccaattctgaatgtgcaaataaatgtagaattgtagattctttgtacacaatacttccacagcctttgaataaaaaataatagtgttcaaaatcttcatttaatctattgttgcagccacttatattgcaatttttgcactagatcagcttggaaatgcgaccaaatttattatcctgcaattgcaaaaaaaatatctgtgcatgttgcaattgaaattactgtatcaatttgaccttttcttcctgtctaaactttttatgttttaaatttcaggtatgtttggtaagaagcaaaaccattgtcacgggaagaagcaaatgtagattgttacttgggggattatattacttgctgccggtgtatttggtatagatgactagggaatatcttgatatagcctgacttggaatttctttaagctacccagaaattgcccttttgatgccaaatatacacaccgacatgaatcttatttgaacatcttttcttataagcttgtataggatgccaattagcattctttacattgtgataatttttgggaatgttcaaatactaagcgttttttgacttttgaatagtggaaagtgtgagctcctccgaatgccatcaaaggtttcttcataaaaaggggaagtgtaattaaaataaaaatcacatttcgagatggaatgactaaagctagttactccctccctccctctgtcgtcttaaattattttatacgaaaaaataataaatagataaaaaaagtattaatttttaaaattaattttatattatcattaatttatttataaattttgttgttcattattaatattattaaagatataagggaaaataaataatcaatgatttcattgaaaaatgaaaatagtaattattttgagataattgtttttacacaataattataatgggatggagggagtgcaatttttgtcatttttttctaaattgaagagcatagtatgaaaattttagatgggaattggataaatttttgtattcaatttttaaatatcatctaaattgtcattgatgaatgtacatgtgcggacatggtatttcgagcatattatctaaatgtgggtacataggaagagatgagtgtaatcgtttaccaggttctccaaatagagtgcatgctttcttatcatgcttgatttgggttgccatgtttaatagactagcttcaatgtggattcttaatctttatgtattagataatttatttttagtcattttttctttatctttctcctctcttttttttcccttctttgcttttatcattttttttctttttaacctccttatatctattattggattcatctatcactgatcccaattaattttagattaaagatgttattgatattaatgtcattttagtgtacttgtactctccacaatcgctatttatctttacctttttgttcaatgaaaaaaattgacgcttcatagttcacatgcatacaacttggttttagactattaagttattctaacaagttgttgaataagatgtgtgagttgtttaatttttttttttttatatttatctttaattcttatggatcaaaaagttggtttgatgttgttttgatgcttggcattaaactggagtttgttattgtcgtacttgtccgatcttcatttttaatcatatcatattttattttaaaaaatactgataaaaaataataaagaaatttcctcagactttttaacttctatctttcaaggatgaccaaattgtacctaaaattttaactcagttgacgattattaagtgattgtctcggcggttactcatgaatattcaaatgatgcttttaagtttctaaccaagatgtttgtttatcctttaaatttaattgttttttttttttgtcattttttctgtaaataaaaaagacaaagcaagcaattaaaggataaacaaaatgcttgtttctgttttgctaaacaccaacttcgtcaattaaaactcaccaccaatggactaggcactcaaaattaagaagagtaatcctatttacaaattgttcggataaaatcttccaaagacctgattgagacgaaagattcctcactttagaatttagagcagtcaacaagagtaatatcaagtgaagatgtgcatatcatgcattcccaagtcgtagcagcatttttgaagttgattgtgccataactgatgtcataataatattcgtgattatacccaatcaatagtggataagatgatttgaagtaatcactaatctcccgccacaacttaaacacgttttcgttgatgaagtatataacaaaaatatgattataataaaaatgtgattttattatatattttgttcaacaaaaatgagtttttgttatattattacgaaaaaatataattaattttatatattatacttttgtaaagtgattaaattaatagtgatataatttttttaaaaattaaaataaaaataattaagatacaatttaccttttttaacaatagtcagtatatcatatagattatttacaaaagtaattgagttactttattaatagtaatcaaattattatgatacaaatttgtttatatcataattaatttaattacaattaaaacatataaattgtgttatcattaatttaaattttaattgaaaatataatttatatcacaaataattttattactattaaaaaaagtaatgtgtgtcatcattaagataatttgtatgtaagtaatttaattattgtaaaaaaggtaacttatattataattaaataattaaaaataaaatatatatgatgaatgatgattttattatgtatataagcctagatacataaaggaatcattgtgcatctatttaaatacaaaatggaattatgattctatttgaatctaaaagttaaagaagaaaagaaagagagaaaagtgtggaggtgaaagagaataaaatagggaaagcatagtgctgggaagtgaggggtgaggaaaataaaggaggttaagagtgtctttttggatgtttctgaaaaagaaaggaggtgaaaaatgcaagaaaatagaagtgagaacagaataacagctctccttaatgaataattttaagattgagtattggacatatatacttgtattaaatactcattatcttcaaagtaaaatagaaaaatacatttaaatgttctgttcttggattgtctagcaaatattaccttcaaaataaaactacaggtggtataattattattcaatgtttcacactagtttaatgttttccattaagaaaaatatttaaatcttaaaatcttactgtttaaaaataatcataggcaaggtcgcaaaggtctaaacaagtaaaaattaacatactacaatcagtctaggaatgaaatttgggtaatataggcaagttcctaaattcaaaccttgtttgtgccattgtgaaaaaaaaaatacaaagtaaaaaaatgtggttaatttcgtattttcattagtgagtatttggtacattatatgattattttaaaatgaagataaaatataaaaaagaaagtgttgtataacgtaaaagtgttttacactgtattactattaaactcataaaaatatgaattaaaagataaaaaaaaaaaataatttctacagtgagttatgctgacaaaatataaatatttgaaaaaatatactaaacaaaataaaagaagaataaatgagaatattttaatcatattataatattttattttaattaaaaatatcttcgtgtgtgtattaaccttaaaaatcaataactttataatatattataggtttaactgttcataaaaaagcattttaaaatgcactgttcattccttaaaaaaaaacatacggttcatattgaataaattataaaaataagttttataacatactattaaatgatatctttttaacttgtgtaaaagtatttatttttttgtttcgacctttttcctattttttcagacattttgataaaaacttctttatatatcactaacttttaactagttaaaatcatgatacactttattaaaattaaaattaaaatcaatgatgaatgcagagttcttggtttacataaccaaataggtatggataaaactaagacaatggaatcaaacatgtgctgattaagctagcataatggtgtcaaacacgtgctacaacgtgcggaatgcagaaatagtatatttacatacatttcatcaaagaactaaatatatcatccaatgctttacagaggaagttttctgtgatgtctaaccgaaaatgatattttgggaaaactagcatctacatgataatatgatctcataaaactattaacattatattaaagaaacatgcaaattataggaagtcagtgaccatctttcgagaagctataactagcatgtaaatctttcaactaggggttatataatctgcaacgagggttgtcatgtcatgtgggacataaaaatcaccacaaaaaagtataagaaaaatataccacccactacacatgttctcatcatcagcataaacaacctacgaccttcacacctgggtcaatgttgttgttgttgttgtaccagactcttcttgtaaatctctaagtttgaagtagccacagcagacaaactataaatctcagtagatcgaaactcatcacaatctgtggagccattcttggtgaaaaaagcaatcagagtattcatcatcctactcacagctgactcaaattctttctgggcgttagccgtagaactattgccactacttggagctagattatgtacaaccgagccgaccggaaccccctccacgtatgatttacaagctctcagtatttcaaatgctcgggtacggaaatgtcccgcaaccaactcctcgaagtgctgcatatgaaagaaatgttacacaagattgtgatttagacagttcttcagttaaggctccacacacatcaggtttaggtgtgtttatatgaccagaaaaccatataacctagatccaatagttaagctcacaatatcagctatctatctatatattcatgaaaataacagagtaacatataaatgacctatgctacacagcgttggaataatagttggagagtgacaattcacaagtacttggcgtttcctgttaattcatcaaagtagcaaactcctaacatcctagaagtctcaaatcaaataataattagtaaaacggatttcatattaattctttttttttttttacttaatagagaaagggtcagttatctgttacagttataaatatgaagaattgaaatttattcttgataatttcttaaaaaatttataccataggcaaaagtcacagcaagtgatcatccaacacaattgaaccttcacaaattcttggtcaaaataaatattccattttctcaatcattatataaaagatgagtcctgcatgaatctcctgaataatacatcaggagaaacctaaagtacaactgactacatctggttaaaattagaaatcagtcaatattgcccaaaaagctaatacacaaaagataacccgatagatcaaaattatatcaatgtataagaccgaaggctggtaaatataaatcagtcagttaaaccataacataaattttttctattgctaagcataactgttcctggagatcatatgtatgcattttcactatgttgatattctgcacactttctttcctagtcctattttaactttttcttttttattttattttttaatagaaagataaatttatggtttgtgtttcttacagttcgcctttaaaagaataattataaattttgtttttcattaatagtttttatttgatttttaaaagttttgtaagtttttcacataaaacacacatacctgtatcataatttttttaaaagggacatcctgtatcattccagtgttgtatccaatatccacatcagtgcttctttgctctatacaactatgtacaaggttaagagaaagatcatagaagtatgtttctagagaaagctttgcataactttaatcactgcaattatttgaatttcttttgaaggcaggtaaaatggaggtaatcctactgatcacatgcagctacgttgtttaacaataaaagttatctgagctcatgattcaggagtgcagttgactcaatatcaggatgcattattcagctcctaatatctgtagcctgtttagtgacttcataatcctcttctcgtctattgatttttaatatctagtcaaagtttaatattataaaataataatatatattatatgatatgacatctaaaatcttgaaacagatatttagttgtactggtgcaatttattgagtagacacagtatcataaaaaaggcagccaaatccatctatcaccatgtatgaaattcagctcagaatcacaacaattactggaaatataagtgaccatttggtttgaaataatgttttctattatcattttctgatttcacttttaattaccaaaataccatcttgtttttactttgtatgctgcttttatatgtttgtactttgtatatgaaacagtaaatacaactttttattgttttgtttacactatttcttacacatacaaactttgaaaacagttaacaagatgaaaacaaggtggtatttttagtaattaaaaatgaaaatagaaaatcaaaacagaaaacatttttgtcaaatcaaacagccactaagatatcaaaagtatcaacgaaaagagtatacccaaagattacagaatcatgcattattctagtctacatacctttgggggtttccgcagagtatacatcattgtcttcaaggataaaataaatgtactctcattgtactccttagatcttctttgcccctcagaaccaggatatgttgatggatacccgggctcattaaaaaaaggcttctcatttagaattagagcttgtattgaaaccaacacttgtagcatggttgatttttctggaatccagttttcgctatttctaccatgccaagtgcccaaaagactaaggcagacttttccacattgatataaatttggatttagcctcaggccacctgagtggtagtgaactttctgccaaagatagtacaagttaatattatacacacagcacaagacacaacttaaaacacgtgaaacatggatgatgcataccggtggacctgcagggtaggtagaaggaaagaggcaatcaaaaaagaaaagaccatcatggtatggggtgccttgaggtccaatgataacagcccttagaagctccatccttgattcacaaactcttacaaagattgtctctgtaaaagtaagtccatgtgcaatggttgaaaatgaaagcaaattttcataaagtttgagagtttcaccacaatgataaaaggttggatggtaaaaagaagttggacaatgattttccattctcccaaaaacgattttaaagatggcaattgttattagaaaactggattaaaaaaaatgcaacagagagacacttcaaataatacatctctaggaaaggccacaacaacaacaaatatcatcttgtagataaaggataatgaatatcttttctagagagagaaagactttacctggcagattttcctttaaaatttcccattcctcctggacctttttggcccaatttttaggcttctgtaacatttaaaaaaagccagattctattcaatcagtagcttaaaatttaaaaatacatgttggcaaaatgcaaactattagccaaaaacagtttcccaatatttatcacctgtgcatctttagttccctctttatcatagtgatgatcaggaaaagagtcaacagtatcaaattgcttaaattgttgaaacttttgcatgatgatatcttcagtttcatccactttttccttggaactagattctgtactggaaaaagcaatagcctgcttgcattcactagaagaaatgtccttcaaccaaggcagtgatgcctccaccccaggaggcaaatccacattgtcaaattggtcctgcatacttgaataatcatcttcatagatatcatcatcattgtaataaaaagcataatcagcatcttcatctccgtcatcgtcaatcatatctgcatcatcatcaatcataccctcatcattatgacatgaaatatcagaattgtaaccatttagattgtttgaattcagtgttccataggtagaactcttgcagagatcaccactcccagatgactctcccacactcacagaatttccatgatcattgatcaaagtatcctgcaaaagaagataaaccaaaaaatgaaaaataaacacatagtgctaaaggtcatgctaagcacgtgggttcatccccaatctaaacaaaaaattaaatagttttccactgccaccaagtgcaactttttcattatactccccccctctccccctgcaatgcacacaacccatattttcccccaagaaattgttctttctttcaacctcaattatgtaaaaaatacgataatacgtaggattgacacaggaagtgactttactgcaatgtgcagattagtaagtccagcagtaagcccccatgtcaacagatttttgactttccaactaagcttgggtgattttagaacactctattactaaactgttggcatgatgtatcatgaacacgaagaacataccaaccacatcacatcactgttcagaagtaatgagattcagctacaggtattggtaggctatgaagtcaactctgatagggacttgggtactatggggtgcctaagtctcacatcgggtagtataggatgcacagtgaagtacttaagtgcctagtttttaagggagggttctctaagtacttgggtgcatatcaaaatcattaatttttaaggggtaggggtaggggaaaaagacaatcccttatccatgaatttaacatgtaccaactacttattctgtatgggatcatacctagaatttgcaggccatgtaactgtcactcaaaacaaacgtccagtttcattttattttttttacagcaacaatagaaatttaataaaagcttagaagatatttccatactcccaaatcaaatgcactgacaaacacaaacacgttttcaagtctgtcttttggctattttctaaggtgatgagttcttaaaaaaacgagcaagttttatggcattttaggcattgttcccacccacattagtaagtatcgctgtaaaattattgttgagatagttaattcagttagttagttagtaactgttttagctttatatggcttatatgaaactctataaaagtgtgcttgtatttttctgcaagagagtaatgcagtgagtgaatgaataagtttttcctcagtccacaaaacctctgctctgttatactctgttctaacaactggtatccagagccttatgttcttggtagagaaagagtgagatttccactgtgtgtgaggagtgggtgagcaatgctgtgtgagaagtttacggagtgaaagcagagagtgaattctgctgtgagaagagagtgagttgttgaagatggccacctccaaaaatggtggttttccagcaacgttacccattcttgatggaaagaattgggataagtggagcaatcaaatggaagccattcttggttttcaagatgttcttgaagtgattacagaaggcatcgaaaagatcactacagcaaaggtggatgaagctcatgccaaagaaatcaagaagaagaactacaaagcactgttcattctccatcaatgtgttgatgcgggtcattatgaaaagatttctggagtcaagagtgcaaagcaagcatgggacattcttcaacaggccaatgctggtgctgagaagatcaagaaagtcaggttgcagaccttgaagagacaatatgagctactggaaatggaagaaacagaaagtgttggaacctatatcaatcaggtccaaactcttgccaatcaaatgaagagctgtggcaagaaagtctcagatcgatcaatcgtcgaaaagattttgagaacattacccacaaaatttgatgtaattgttgtgtcaattgaggagacccgggatcttgaccaaatgaagcttgaagaattacaaggctcccttgaagcattcgaaatgagatgtgctggaagaaaagaaaaaccaggtgaacaagctctgcaagcccaatccagttggagaaaggaaggagataattcaaaaattaaaagaggaaaaagcagatggagaggtggtagcagcagagggagaggccagtcaaattggaacaatcagaatttcaattctggcaggcctgcatttgatcagaaatcatatgacatcaagcaaaggagaggaggttcgtgtggtctaagaggaagaggtgaaaggaagagaatggacaagagtggcattcaatgccacaattgtcaaaaatggggccattttgcagatgaatgttggcacaatgacaagaagcattcaagaaataatgaagcccaacttgtagaagaagagcaagatgattcaaatcaagtcatgcttgtggcaaccactgaagaaagagaatccaatactgatttctggtatttggatactgactgttccacccatatgacagggagaagagattggtttgtgaatctggattcaactgtaaagagcaaggtcaagtttgctgataatagcacactcacagctgaaggtgttggtaaagttttgatcaagagaaaagatggcaagcactccttcatctctgatgttcttttggtaccaggtattaaaagtaatttgcttagtcttgggcaattacttgagaagggttatgtgatgttcatggaaaacaaaaagctgaaagtgtttgatggaaataaaagactgattatcaaggcacctttatccagcaacagaacatttaaggtgggaattcaagtgatggagcataattgctttgaaacttcagtaaaaatagaagaatggctgtggcactacaggtttggtcacctaaattttagggatttacatctgttatacagaatggtgaatggtatacctcagattcatatgccaaaggagatgtgtgaagagtgtttggagtcaaagcagccaaggtgctcgtttaaaactcaagttcccagccaatggtatacctcagagatgtggtcatagatgagtctaaaagctggaactgggagaatgatgatagaccaagcagaattatggttgattttgggtcagaagaacaagaaaaaggagatatggaaacagatgcagaagtgagaaaatcacagagaactagaaccattccacaaaggctgcaagattttgatattgtgtctgatacacaagtgaatgcagaaggtgatttagtgcactttgcattactatcggaagctgaaccagtgagtgtggatcaggccctgtaggatccaagctggatttgtgcaatggaagatgaactccagtcaattgagagaaatgagacttgggaactagtggatttacccattcataagaaacctataagtgtgaagtgggtatataaggtgaaagtgaacccaagaggagaagtgattaagcacaaagctagattagttgttagaggcttcttgcagaaagctggaatagactatgaggaagtatttgcacctgtggccagattagaaactgtgagattggtagttgcaatagcaagtcaaaggaactggaaactgcatcaaatggatgtaaaatctgttttcttgaatggtccacttgaagaagaggtgtatgttacacaaccacccggttttgctgtgacaggagaagaagacaaagtctacaaattaaagaaagctttgtatggcttaaagcaggctccaagagcttggaataagaggatagatggatttttgcagcagatcggattcatgaaatgcagttctgagtttggtgtctatgtgaaaggagaaagatcaagtctactaattgtttgcttatatgcagatgatctattggtgacaggtaagagtgagcatgaaatctgttcattcaagcaaagcatgatgaaagagtttgagatgacagatttgggagagctgtcatattttcttggaattcagttcaagaaggtgaaaaatggatatgtcatgcaccaaggaaagtatgcaagtgattctttaaaaaggttcaagatggacaaatgcaatccagcagctacaccagctgaaacatgattggtattagaaaaagatggaagtgaggatgctgtggattcaactcaattcaggcagatggtaggatcattgaggtatctctacaacaccagaccagatattgcttatagtgttggcttgattagtagatacatggcaaatcctagagtgcctcatctcttagctgcaaagaggatcatgagatatgtaagaggaactctggaatatggcttgctgtttccaagcaaaatggaagaggaggaagctgaattagtaggatattcagatgctgattggtgtggagacaggaatgatagaaaaagcactgcaggttacattttcaagcttggtgaagcaccaatttcgtggtgttcaaagaaggaaccgattgtaactttgtcatcatgtgaagctgaatatgtggcagcatctatgagtgcatgtcaggcagtgtggattgatgcattgctgaaagaaatgcaggttaaagaagaaggaattgtgaaactgtttgtggacaacaaatcagcaataaacctggccaaacacccaattgcacatggaaggagtaaacacattgaaacaatgtttcattttcttagagaccaagtgagcaaaggcaagctgaagctggaatattgcatatcagcagatcaagttgctgatattttgacaaaaccattgaagaaggatagctttttaaggcttagaaatgatttaggtgtaatgagtgttgtagaactgaattaaggaagagtgttgagatagttaattcagttagttggtagtaactgttttagctttatatggcttatatgaaactctataaaagtgtgcttgtatttttctgcaagagagtaatacagtgagtgaatgaataagtttttcctcagtccacaaaacctctgctctgttatactctgttctaacaattattaatggctacgtttcaattgttccattgcactccaaccagaaatcaacacactcgatggccaaaaattatgagccaaaatatggaagatcaaaatcatttcatcaaaaaagaagagggccaaaagaacaaaggaaaaaaagaaaaagaaaaaagaaaacaaaaaaaaagtgattttgcaaagtcagacgatcaagggtgaaggtcaaaatccaaaagggcacagaaggcaagcatgaagaagaacgaaaacataagcccatatgataaagcaacaacctttacccataatataagtacgaaaaacatgagtgatactagaaacgaaaaatgaagaagaaaaaatggaatagttttacggagaattagtggaaaggggtacctgctccggctttcgtttcttcatcccagaattgtgggaactttcgtgaagatccatcggaatcaaaggctgaactgaacccccccaacacacaacacaacacaagtagtagagagaaaggtaccacccaagtgcgaaccaagagccactcctacactccaaaagtggttaaaaaaatacagtataaatattaccagtcttgataatataaagaataaatgttttttttttaggaagagaaaaaaatgattttaagtaataataaaattaaatctttaaattttattttagatttaaaacaaaataaaattcatttaaattataatataagattgtttttagttattaattactattccaaaatattattattttatttatatattatatatacaaagtatttattaattgtcaacaagattgatccaattaataaacaacatataatagataatatataagtaatctggtcctcttttcaggtgagctctcagaaatcgaagactttacctaaactttcagtcaaaaaaaaaaaatctattaacttttaagaaaaattaatatatctacttctattatctactatatctatcaaatcatactcatattagtttaaaaaattcatgtaataaacattttttaaaataataattacatttttaaaaatttcaaatttttattatatttaaattttataaaaaaaaaagtgacaggatattaatttttactaattgtagttagagaagcataaatccaacatcgtatcattaaaaacaactaataaaaagaaactaatatttaaaataaaaaaaggaaagccataattctttcctccatttatgcaattgtatcagcggacagcggtcattctctcaatctctatatatacccataagaaatttcactaaacaacaataatatacacaacataaagtaataaaaaaattatatataacacatcgtatttgtggtacctgcgaccgcgagactttgaagtcaacaccagacggcagcaatcagccacactgacgcacaccataagcacatgtgcatacccacgtggagtctagataaccaatcaaatgccccaacgtagcatttaagacaatatcctgccgtataatattttttttctaaattggaaagttgattctccaataattttaaatcattaattttgattctttatttaaaattaagatatctaatttttctagttcttaaaataatttttttaatcctttgattagttgatcattcgggattttgatagaaattgaatgatctttgattcaaatataagataataataaatcattaagatacttgttatattttgttatatttaatcaatttataaagattatgttgtatgtatcattagtcaaaatttattattatttttaattattaaaatttataaattaatatataaattatccacataaattattttgtaaattaattttaatataaaaattattttgactctaattatataaatcgacatgactacatcaattaatataaattatacaaattaaaaaaaatattttaatatgtaaattatttatattctaattatataaattaaaaaattttaatatttaatttttcaggaaacttacatgttaacattttagttttaactataaaaaaaacatttagtattttttaaatgccaattatataaatcaagaaaattacataaattaatatgtaaattatttataatttttttatgtaatttataaaaattatgtaaatttatttttatataaataatacaaattttttatttaaattataaaaataatatattttaatttttagattatttgaatattatttttaatttacataatttctataaattacatagaatattttaaaaaaataatatatattagtttatttaatttttaaaaaacattataataaaaaagaataactttttatatataataatctattaaattatatgaaaataaaattttataatagtagtatacatgtaaaataaaatattaaatatatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataagtataaaaaaaaaaaaaacctgatggaattggcgtataatgtaataagccaaggcaattcacaaaataatatcaccattttaaccaaacaaggggcgaacttctctttctctctgtttttgtgagtttatttattttgattattgaatccaattccttttatttgttcacaaatcttcttatctttattatttacacataaatgatacttaaaatatattaattaatttattttcaattttattttaaatttttgtgactgttttaatgcatttgaaactacaaagataacctctaaaattttgagcggaaatttttttatcccctgtatatccttaattatttatacgtattagaaaattaaagaatctcttccaatccaattgaagaaacgaaagccggagcaggtacccctttccaccgattctccaaaaaaagattccattgtttgttcttaattttttgttttttgataacaaccaagtagcattttacccatatcagcttagccaaagttatcaacctttcatgttccattttggtcagaattgcatgcaattcatggaagaaaaaaatgcaatggtggattgggctaatcaagttggtgttggtgcttgtgatcctaaaatgggtgtactaaaggaggatggatttgacaaaaatcaaaactcctcaccatgctactacaacggaaatatgcaaactcttccttctcaattgcagtatgatgcaactttccagaccctaccaactaggacaaccatcaaggtttgaacttaatggtttttacgattcaaatatgcttcaattatctcaatttttttaactgcatgcatggaaggaagtagggtcatccctctactagaaacatatatgctttttgtttaggttttaattttcttaggctttcaagcatttgcttatgctttaaaaagttgttgaatttgttttcttttcttggttgagtatgaatttgaacattttacacaatatggtcttcacaacatgtgtcgaacactaacacatgtacgacacttacataacgtgtgtcacatatttcattttagagtttgaataaaagatttttttttagtctaacacgttttaagacaaaggtttgagataagtgtagtagagagtgttttgcaatcatccaaaggttcaaatgtgacactacacattatctacaaaagtcaaaagaataagaaaaagaaaagaaaagaatttgttagcaaggaagaacaaattaactaatttagccttaaattccgcactcttcattttaattgataaaacgtgtaatactcttttgatcttaatttgatttgattggatatttttcttagacatttatttatttatttatttacgtcaacacctaattttgatttaaagtgttatatattatatactttggaaatccagtattaaaaattaagagaaatgaataacattggtgatgtatataacaaagactttcatctctatattcgaagtcgccccacaatgaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccatattaaaaagggttgaaaaaataaaataaaaaattgtatcttacttttatatctctgataaaatttaacaaaaataaaaaaatcgatggttcatcttatgaaaaaagatcatttttaattttccaaaaggtatttgttttatattaaaataatatattgataaaaagttaaaaggtctcgttaaagaaaagtcaaaaacctcttaaaaagtattatctttgaagaataagtgaataaaaactaaaaacacttttgtgtaagataacttcaacttataaagaaattcattatttctatattctattgtcgggaaaacgtaaacactgacgctttgtcgctaagaaattaacgatgaacattatttttgttaccgtcttcaaacatgcattgttgtcaaatttgtgaagcagtaaataatcatttaccttcccccagaaaaattatcattgaagctccaaccttaattcggaacaaatacatattcctgtctaaatgaaaactataatccaaatcttatagataaataaatcaaagcatgtgcctaatctttagttaaatctatctttcagaaattgaagattaccaaaaagcaagggagcacagctctaggattcaaaacaataagttcttcaatctctgaatggtcattcattttctttaccaaagaatcaaactcaggatcaaccatttccttgatctcttgtagaggattatggattctcccagctattactctgcacaacataacacatattctatggagagatttattggatgagcaaatagaatcaatggctttttcactagtagaagtggtgtaaaccccaagtgcaccatgaaattctttagtggcggagaaaccatgcctcagaatttgacacacaccacattgctctaaagtgcaaagggtagaagagccatttaaaccaagggagcatgcaattgttgtaccatgaaatctcaatagctcatttccatcaaccatgcatcttgggtgctcattttgtaacctttcagctttagtccttaccatacccgtactttcctcaaagcatgcaaacgtttcttgtttgttctgaattctcaagacacattcaatctgtgctgccttgctttcgatcaagttatctttgcatatttgttggatgatcttgcaagatgaaccttctctctcaagtttgatcactgcaaaatggtacatgtagatgttccataatttcagtaaaagcacttttttaagtgaaattatatctgtaatttaaatataggaaaagaaataaaatagatttttctgtaaaagttacaaaagatcacatgaatattcttccaaatgtttcaacattgacataaatctatataattaatttgtcatactagtgtcaaaatcagaattgttcgatcgtaattggtcaaatttaatatagtgtcgagttgagggccacctttttttattcccagtccctttctcaaagtatactattgagttcctttataagtggataaattatactatgatacaggacccccacaacacgaaacaagactgattttaacacagacatcataccatctataatctataattgttataaagggaataagatattttgatgtacatgcaaatttttatgtctattttatttttataacgacattcataaattattatttcatttttataactatattcacaaaccacccactaacttgtattattttttattttaaaataaacatgaaaaaaacaattaggcactccgtgcctgttttcccctagtatgatataaagaaaattaaggagagaacaattgactcaaaacatatataagcacttcaaactcattcatgctaattcaactagttagaaaaaatacttatcccttacctgaatgttcggggatattatgatcatgttcttcaacagtgtcagtagattttagtttctcatcacattcatgatgacgagttgatattgggagatcatcattagaatctttcttcagtggcacctttttcttcgagaaaaaattacattcatcacaatcaacataatgtgttttagatgaaggtataattcgtttggttgatctaggaggatgaggctcttcttgtacaccttttccatcttcactgccttcatgagaacaaggacaacatggacaaagcataatctcaccgcttgatctatcaaggaaaatttcatggctaacatggtcccctagtgagtgtctctgcatgttattaatcttgccttgtggttttctctgagtactgctatatgccttcggatcatgaacttctgatgcatgaggtttgcaacgaagtgatttctttagaagatgccaaacctctgacatttctcttgatttcttttctttgtgacatgtaaaagattcattactaatgtttttatctattccaattgctaaggcaagtgaacaatcaaggaaaccaaatcgttattgttttcaattacagattgttttctttgtcggatcattcacaaatgggaggaaattcatggagtgcaaagtttgtaaacggtgccagctttcaatgaaaaaatacaaataatttcaaccttctcatttatttattatttaaacagtaaagattttcttttatttgaaaaaatatatataattgttaaaagaaatataaattaatatatacatgaaaagattttttttagagaaaatacttcatacacatagtagtgtaaagagattttacaattgtcttctaataataaattgatatgtgtgataagtttattttaggattttcttaattatttggaaaaaatttagttctaggaattaatgtgataacattatacattttcgaaaaacaaaatggtgatttatggtttaattttttcaactactttaattcaatttggataaaaacaaataaatatatttgaacttattttcaataaggagaaaaaatgaactttattttttattatatttatattcaaaattgcattataatatttacaaaactaaattatatttaattaactatattaaaataaaagaaaaatatataatagatttattaacttttataattaataattattttaaaagttacactaacaataatttataattaaataataatataaaattattttacactaaatttttcgttttctaaatttttattcttccttataatgacaccattattcacatttgattttatcatattatctgtccattaaatggagtaattgtatatggataaatagaatttgattttaagagttattgtggtgacattttctcaatggtagatcaaaagactaatgtaaaacgaatgcacaaagaaagaacgacaaagatgtaagaaaaggcccaattaattcttattccgttaatgtttcgatcattttcatcttataacgtgacaactatgtatgcatgccaatttagcttctactcctgcacttaacttgccaattgagcttttttaacattgttagatgactatagttaggaacgagggactaaattaattgattatttgcagtatcaatcattttgtcattattttattttagtgattaatattaacctgccattaattataattttaagaattaaattgattgataatttataattttaaaaatcactttgctattttaaaaatttcagggatgtcagtaaaaaaaaattagggaccaatttggatattataattttaaagcgtaaattggtagttgaaatcaattaataagacaatgtcatgctacacttattgaggaaaataatataaaaaattatctctctcttaggatttaatttttttttttaaaatgccaccgatattttctttaaatcggttctcatataaccaatataaaagttgttattttttgcaaaagtgaaagtaaggtaaggaacaaaatgaaactaacaagatgaaaaaatataataatcccgtaagaagatgacaaagtacaatgacatggtagtctaccatgtaggtatcacaactgggcgaggcgggagcagggcattccccgtccccattgtagtctgtcgactcaaaatccgttccttgatcccgtccttaatttctgtaggattttaaaattcatcctcattcatgttcttgttggaggttgggttttcttcgtcccgtccccgctatttgattaaaattaaaaaaaataataatatcacttttttattaaaaaaatcgaacgaaaatactaattaattaacaaaaaaacaataataaaatcacatttaaatatgagatcataatttaaaaattataaaataaaattaattaatttaattaaaagaattacaaaataatatatatttttttaatattatttgttacgggacgggtatgaataatctcatacccgcccccgcccagcttttggctttcgggaaaaattcaaacttgataaactcaggttttttctactaaaatcgaaacgaattcgggttaatacccacgaattcaagtcccgcttccattcctactagcatgacttaatttgcctatagttaagaattctgttgcaggtaaagtattagagcttggattgcgtataaaaggaaaaaatggagtaaaatacagataacacttttaaattgcggtcacatatatggtagtggttattttgcaattactaaaatggagcaagatacagttgtattgtggatggtgatggatccaatataatatgtctattatccctcaccctagaagtggtaaatggtagcaacagccaacttgcagaacacactataaaacatatatagagtaaaactgtaaagtcaatttggttatgtgtaacagagtgattaaaaatgaaggaaagattgcgaattcaatctatcatgctgacaaaaaattaataaattaataattaatgtttgtgaataataaaaaattgtgtaatagagacaatgcaagcaacatatatagcctctgtttctgcttaactcatgtaataatgtttgatcttcgtccaatcacattatgcaccatgtgctttacacgcatacaactggcactgtggcacaccgcatgcagaacatttcctttctgtacccaaagtttaaaaattaaaaaaaatgtggaggagatacattaacatgaacattatcaagtcatgaacattaacttctataaatgctgctcatattttaagatatatagagagaagatcaagaattcaagatcactatggctctagatacacgcacaaatcaaaaaaatggtaaaagaaaatattattcactagaaaaaataaaaacaacggttctagtgtcgtatctgaacctttgtcttgaatgtgtcatccgaaaaaatgattattttattcaaagttatgtgactatgtgagtgtcgtacacgtgtcagtgttcaacacatgttgaatacataccagccactacatgcaagtgctacataacaataccaggttatttgccaggttgtgaagaccattgtatgtgtaaataatgttcaaatccatactcaatatagaaaagaaattcaacaagtctttaaattaaacataggcaatgcttgaaacctaagaaaattaaaaccttaactgacaatccaaaaaataaagcatatatgtttgaagtaatgagacgaccctacttccttccatgcatgtagttaaaaaattgaggtaattgaagcatatttgaatcgtaaaaaccattaagtccaaaccctgatggttgtcctagttgattaattggtagggtttggaaagttgcatcatactgcaattgagaaggaatagtttgcatatttccgttgtagcatggtgaggagttttgatttttgtcagatccatcctcctttggtacacccattttaggatcacaagcaccaacaccaacttcattagcccaatccaccattgcattcttttccatgaattgcatgcaactttgaccaaaatggaacatggaaggttgagaactttggcttagctgatatgggtatgctacttggttgttatcactagatgggaaaagttgttgtgtttgagacatgaaatttgaggccatgtatggagtaagtgtctcagctttgtctgattttgctattctttttccctttgaatcccgctttaacatattcatcctttgattacaagcatcaagtttaacatccaaaatgctaacaaacatcctcaattgttcctctccaagagtattgtaagagtcatcccaagttgggtacatgagcttgatcttctctttgtgcactttggaaatctcaccttcaatctttttcatcctatcgttaaaatactcttgcacattatacaccttagaacacctgtcactagtggtgttttgatatttttgaatgacacgtttgatttctcttgagtcttggtcttggggccatgtttcgggttcattgagaaacttgggagcatagataactatgccaacatcaaccgcacaaagagtggaaaattcataggctttcttcaataatcctttctttctcttatcaaaagttttctcacgggctttctcctgttggatgagttccataggtattcttccacgacccattttctgcatggtatatagtatatacaacaattggcaacattcagtacataaatctagacaaatttagatgggcaccagatttttattcaaaataagcgtaaaaggatagcttttcaattcatatcaattttaattaataaaaaaactgcatgtttgttattattactatatatagcaatatctatagaacccaggcagtggcagaaatttgacttgagaggaaaaaacatgatttaatacggaaaatttaattataagatattcaaaataatattttaaataattatatatacccacactataacatctcaaatacgcataaaaaaaataataacattacaaatactctattaatatttactgtattatctatcacaccatctctaattaattagtttttttttctcgctaagtgtcaactaacacattgatgtttatacatcttttttcaatattttcttttcataaattttagaggcaccataaatttatttttataataatttaaatatagttttgaaaaaaattgggagtcactattactactcccagtcaaacccttgcctctaccactatttataacaattggagagtttggagagagaaggaagcagatatggtgaaatcaaagggtgtttgagggagaatcaattggttaaaggatcccttaggtggagggatttggcaagtatgtgtgaaggaggtcacagaggtagctggttagagaataatatataaattacatgcagtgatgatctgttagcacagaaaattacaaatattagattacgatacaaactttggtttgattctagatcaagatacaaactgatattctttacagcacataaaatttgtttcttcaatttaaactcactataattattataacattagactagagactgacattcacggtgtccatgataacgacactgctctaaaaacatgcttttttatcatttattttttgtacacacatttatattattcttgacagtgcacatcttgtgcttcaattcactgtcttagttattataatattatgatcaacaacagatttttctacacatgcatttgctggacttccttgcacacactataactttcaagttaatttcttattacttaacccctaactcttcaaactctgataaagaaactaaaatgcggataaaagacataaatttaataaactaaaactaacataacattaatatataataaaaaaaggtatattatattaaacttaatgtcttatccaaaaattcaccaaaaaaatcatgttttatccaaaaatcaaaaaatgaagaacgatgaaaacaaacatacttgtgtatccattccaaaaaaatagactcttgatttttagacatgaagaagatataaacatctcattaacacattatatttttgcaaaaaaaaaaataataatatcaaaattgtttcttgactaggactgagaaatctgcttagttttattatatttcatcaatattatcaacaatacagtcagtcattcaagctctgtagggtgaagatacaacaatggatgaagggtccaatgaaaccaaaaccacatacaacaacaaatgacattaattcatcaacatatcactatcactattataaaaatataaaactagtgtttacttcaaaaggaaacgtacctttttgactttgttccctgaccttcgttttcccgttttgtgcgatgacattttatggtggatgttattctaatttatatgagtattttcttgactcttccgccctctgatttccttcacttcctacagatcataattagtgctgaaattgccctaatttgtgataattcttgggattgtttcctttttatctttctttaatgtgacttagattatccttaattaattcgaaaattctagcccattatagaattcttcggacatagttttctacaaattttgttattttttttagtatttaatgaaaaagggacaaataaaaaattaaaaaaatttaatatcttaaaattttataaacaattaaggctttctttatttagtaagtagggaggtttgtaagaatatgtaaaatgattcccttatgttttgtttttgaacaaagttaattttattaaattgttaccaaggtaacaatattctgacattctcgcaagagtcttctgcagctaatgcatatggatggctgacatctgagacaagcactggttcccgcaatgctttccatgctccttgaactttcaccagcactctcttttgccatatgcagatttaaaatgattcctaacataacccataagttagttaagattaatagaagtatatattcaaattaaatcagtcaaataaactattaaatcttttatatatatatatattgattttatataatacgataatcaaatttattaaatttcgacgggtagttgtagtagctagaatccattcttgcttttaacttgtcaaagagattcatgatgtgcatgagaatgcagacgacatatcatggaatcatgttttgaaagagactatatatgaaaaatttgttgattagcgaaggaataacaagccttctcgattccgtctctaatcagccacggaacagagaatcacaatttcatttactagtttgttgctactttgtgatgaattagtgaggaaatatttctctcgctagctattacatttcttgtagtgagaagctaatcggattatggatgggatggtcactcatgcgttgggtctttgcagttgctatcaagtttttgaatttgcctcttcttggatttaactcatatattttgtattttttagaggatatttttttttatcgtgtgcattaaaaatagtgtcatgaaatttacaacactcacacacattatgttcaactaattaaattagactctcttaaccatttcttagatattttagtcaccttgtatattaaaaagaaaaaaagaaactagagatacttaggatcctttcctttcattttttatactccaaaattaaaattgatatatttttaatcctataatttgataataaaaaaagttttaatcctatgtccaaagtgtcctctgcccaaatgccgtcagaatgaatactttgaacaaaaaactatacatgtagtaagatgtttgataataaaaatgtaaaatcaatataggttgtcatgtaagtggcttatatataatcccaaacaagatccttaacggaactgaaatagttttttttttcaaattacaaaactaaaaaggtaatttttcaaggagatcaaatacagttatacaaactttccttgaatttaaagaattaaaaatatatctaaacctattaaattttatgaaatgattttcttattaattatacaactttccacagttatacataaattttgattttattaattttttataatttatcgtaattgattacaaagtaatgaaaataatgaataacataatttatttaattatgacatatctaattacagtaatcaaacatgatttagacattttaattnnnnnnnnnnacttgataacactaatgtaaattttaattcatatttatagtaaatttaaattgagaatttttttaagatttattttattttaatgataccaatatatgaaattgagaacataaattaaaaatgacaatttgtagggttgtgggtaaggtactataatacttaatcttttacttgtattttaaataaatctttatatttgtgtggataataactttaatattcttgtctttctttgtttagtacctcaatctccataatcgtattagttgtccatgttttaattaatatgaaaaatcaatannnnnnnnnntagtaagatgtttgataataaaaatgtaaaatcaatataggttgtcatgtaagtggcttatatataatcccaaacaagatccttaacggaactgaaatagttttttttttcaaattacaaaactaaaaaggtaatttttcaaggagatcaaatacagttatacaaactttccttgaatttaaagaattaaaaatatatctaaacctattaaattttatgaaatgattttcttattaattatacaactttccacagttatacataaattttgattttattaattttttataatttatcgtaattgattacaaagtaatgaaaataatgaataacataatttatttaattatgacatatctaattacagtaatcaaacatgatttagacattttaattnnnnnnnnnnntagaatatggaaaagtaaaaataacttgttggtataaaatattaattaattattttaaatcagtcttaattatataatctcatatatgcataatctatcaatctctcacatttcggtgtgactcattcgggttgttacattctctaataatccaaacttcattcctaatttaattactcaggggtattgattaatagagaatcaaagtgaattattgatataagttggttgagcatagtgtaagtgttttataaattcttagtattgtcttcgactctatgcataaaaaatactaacttaaattcaaaatcttttcataaacagtgtttcctcaacctctcatattttacctatgtgtttcataattagaatcgtcgctccctattaactcataagcatatccatctttaatgctatcaatattagctaagttaagcgagataaaggtctccaccaccaataaaaaaaattgtaatagttttcgcagagtttatacgtgtcaagtaataatttcactaataattatattaataaataaatgtttttaaatgtgtgacatagaattaatttttcatttataagtatttttaatcaaacaagcaactataattttcaactctaaatattaatgaaaatagtgataatcatttcaacagtattatccattgtaacaatttttgtaagggtaatttcgacaatagtttaatttatgataattttaatagaaaagtcttttcgataataataatgttaatgataaattcaatcatatatgtgataataattatagtaatgatttcaatactaataaacaatggagattggataaaattttagtagaagaaatgaatatttacaaaagtaaatatttcaagaagaaatgagaattctaaagagattaaggattaaaagagatacaaggaagtaaaagaaaacaaattttattaaaagtggaacaaagacgtacattgtgacctttgaaccaataaccattttttgtgaacaatgtgagtggtgtataaaaatttaagtggtagtgatttaatccaacgaaaatgactgtcgaagtcttatttataggcttataatattaatgatcaaattatataattttgacatgcatacaacaatttactaactccctacatctagtggcgttactcatttgttcagagtaacaattacaaaaaccaaatatgttcagagcccacaaacaagattcatgtgaaaatcgaagaacactttgtgggcaacgagaagaggaaaacactgggcactgtagtggttcttccaatgttgggttgtggggtaggggttgcggacaaggttgaggcgggagaggaggcgtggagggaggaccaaatcttagatatgagggggaaaaacgaaaaaaaggggagaaagaaaccgacgccggtcaattggtctccactaggaagttgctgtgcgttacactggccgtcgacaattttcgaagaagcagccatgcggagacgaagaagcagcaaccgccgtagaagaagccattgttgtagtggtagagttgaggacggtgacgagacgacaaatgtgacagatgaagtggtcgacgatgcaagaagagggggaggcgatggcagaagtccgcgagcttgatcaaggaggagtgattggagatgacggggagagagacgcatgggtggtgccgttttgaaataatatatgttttttattttttttctttcgattatgaaccttttatttccagacactttgatgtttcaccggtgaatccttgatttttggacttcacattaaaattcacctaaaataatagtcaaccaaaataaactaagtttttcaaactttaaaagttttcataacaatggtaacactttcacatcaccaccctgcataccataccaggacactccacaacacctaacacatcaaaattctgcacatcaacatcctgcacaacatcaactcccagaccgtacaaatcgacaccttaattagcggcaccatgcacatcgacgcccaactcaaaccctaacatgtctaaaccttgtaattgagcatcttcaccatgtttttctatttgtgccgtttggaggtttaattttataattctggcttgaataacagttgaatccttataatgtaaggttatttgtattgatccattaatttttggttgtttttattttttttcctttcaatttttggttgttataatttcccttttctttttggttttgtacttataattttttttgttagatttgacgaaacaaacctaacaaaacaaaccataatcaaataaaaagaatataataggaacaggaataattaaaaaggaaaaaagtaaaacacatggacattttcttataaaaagttatttaaggtttgaatattcttctttgggacttaggagagatgctcgtattagaactcaattagtgtcatgaataggatttttttttttcagaaagagaatgcatttagtaaaccaaaaaaatttaaataaattattatacatgataaaaaaaatttatttgaaagaaattttttattatatcaaaagtagtaaacatttattttctgaaaattctttttttgtgttgacttttttaattttttaataataaaacgtaatattttctgtttttttttcataaacaaatccaatttaaaaatatgtcattatttgagatttgagatttgagataaggtgatggatgtattttaagatatcctcttaactcgtaataatgaaacgataaacgtcgtgtgtacgaatgggactatacacgtgttaagagcctattcgacaaaacacgtgcttctttcaacccacaactaccccatggcatttccgtaattccggggcgagagcgaggtcaatttcaggaagtcaactctttgaaaaatcgaaaattccccttttcgaatttcttcttcctctcctccttctaccattttcctttcactttccatcactttctctcgtttccccttcgcaattttccccttggaagagacatcgaagaaaatcacgtcacggcaatggaggaaaagcacgcagcagccatcgaatccgcacacgccgaatccaacggcgtctctcacggcgccgaccacggttggcagaaggtgacctacgctaagaagcagaagaagaagaccgttaacgcggccaacagcgccgattcccgcgcgaattccaacaagctggttccgaatggcacgctgtccggcaacgatggcgttttccggtcgcttgagctgcaatcagaggaccggcgccggaaaattgtggaggctaagaagctggccgatgccgcgtacgacgacgaagacgcgcggctcagatcgaagcagcggcaccgcgacgacgacgaatacgactacgatgacgagaatgtggaccgttccgcggagaacgggaaggccgaggaggcgaagaaggtgaagcagaagaagccgaagaagcctaaggtgacggtggcggaggcggcggccaagatcgacgccgctgatctgggcgcttttctcgttgagatatcggtagggcattgtgaattgaatcgtgcgtgtttaggttttttgttttttggtttgatctacttggatcaggaagatgatgtgatgcgattcgattcgttttatttgtttgttttcacaacagggatcgttcgagaaacagcaggacatattgatgatgcgattcgctgattactttggacgtgctttttctgccgtgaccgcatctcagtttccctgggtgaaattgttcagggagtcaactgtggctaagatcaccgatgtgagtctcgaatatcttgttttttttttttgttctttattgtaaatattagaaaaagattttcaatttgatcctttcaagatgtttatgtcgccacattagttcttattcaaagatgggttgtcaccacattacatctttgtgaagttcagtcacattattctctaattaatagctcataaagaaattatttcaaaagtttcatagcagcaaatcatttacttatttgcatttaaattattcgagtctgttaagtacatttgcggtatagaagccaaatgttagtatctttggtgaagtgaaatttaattgagatgcatattgatgctttactaaatctattgtgatattggttcatgtgattatttaccgtatttactgttttaaaattctatctttggcattagaatcttgttctagtttctaatcttcgcctgtgatgttgattaatgaatttcctttttgctagatgccactttctcacatatctgatgctgtatataaaacatcaatcgactggattaaccaacgttctcctgaggcacttagtacctttctgatttggtctttagatagcattcttgctgacttgggtagccagcaaaatgtggccaagggttccaaaaaggctgtgcaacaagtgtcctcaaaatctcaggtacttatactatatactcttctctgtcaagaactagtgtttttttccccttctgattattattggataacagaaataacttgtattagaagataatatttattagagagaagaaggaaaacgaaacactcttgaaaactaattggagggccactcaccaaattgaaccaaagctaagctaaaaagaaaatacaaataaagaatagctgttcactctgcaaatccatcaagggggctctctggaagaacccgtgtgctgaacagctaagagatgtcaattaaacaatcttgtcccaaagcatgattaattagcaaaggacaccttcctttataaatccaaatattctcttttaaccgaatgcttgattagtgcatgactgcaatgcatgactttgaaattctatattatgccttagtgcgctttgatttattaattaatatgtttgtgataagttgttagttttgatatgattatctctgcttttaagtgttcaaatgactggggttggcgtaaattaagaacatggaggaggcagtgttgctaaattttatttttagttctattttttatttttccattttgatcttctttgatctgtacactcaatatgaatgaatagtcaatgtcaagatagataacacaagtacgtgctcttgagataagcagtaaattcacaggtgccctcaatgcatgactgacaaacatcagaaaatgaatggtgaggatgaggagtaactcccaaagagttactcttggtgtaagttaatccctcctcacacacatacaacatgcatcaaatttcctttttcctttttttcttttggggaatgggcattcagttacttagaaggtcaaatatccttgttcttagatttctattgctatttttggttgtgctgtgaatggaaaaatgagttagctttcattattcaatacttgtgtttttttctctctctagaaattaaaatgcacttgaaaatggaaaaaaaagaaaaaaaaagaaatgcttccatttgaatctccattaggttatgtttgttcattgtagtttgtgtatcttctgattttattagtttgtttttgtgatttttttattgttaaatttgacttgaaatttctttttgtaattttggtttctaaatcaaattcaacctttacatgactatttgtaggtattcaaatgtagatatacttgtctgttttgctcttcttttaagctgtagactgatatttagttcacataaccgcaggttgcaatgttcgttgttttagcaatggtattgcgtcggaagcctgatgctcttatatctgtattgcccacattaagggagagtacaaagtatcaagggcaagataagcttccagtcattgtatggttgatagctcaggtgaggggtacaagccaaaataactaagatcttataagaaatcccaaaaaaataagtttgactttttctgcgtagcatttcattttcccttcattttattaatgcttaatattttctgagtaggctgctgtaggagatctctcagtaggtttgtatgcttgggcacggaatctcctacccatagtgattggcaaaagtggtaacccccaatccagggatttggttttgcagctagtggaaaagtatgtaaatatagctactttcttttttaatatcactatctcattattgctattgtcatcaccattgtgttttctgtggtttgctgtcagaattttgtctacccccaaagctcgacctgttttagtaaacagtgctgtgagaaaaggggaacgattaattcctccttctgcttttgaaattttggtccaggttactttccctccatcttcaactagagtaaaggtagatgttcgactggttttgtatgtttgtattttagagtatcatagctctgaatcttcaaaatttatgtcaatatgctgcttttgtataggctactgaaagatttgaggccatatatcccactctaaaagaggtggctcttggaggttctgctggaagtaaagcaatgaaacaagttgcactgcagatattcagttttgctatcaaagcagctggagaaagtatggaaaagtgatttttttattacatttgtgcttcttttcttatttgatgaaatgaatgtttgagggtattctgaaacatactgtatttttcagataatcctgagttatcaaaagaagcagctggtatttttatttggtgtttgagtcaaaacactgaatgctacaagcaatgggtgagtagtttttgtctagaagcttaccttttcgagtttatgcaagtgattgatttttttggatagagcaagaatatttgttatatgaaaaaatttctttgcattttaaaaatatatatgacaatttgatacataatggttctgagtatttgagaaagaatcaaataaaagataggattttgttgatgatatgacatctcccatatagccctggataagtgatgaacccgtgttaggaggagaaagaataaattcaaattgttcctcaggatttcttgagccaatcagtgcgagatttctcccccaaaccaatctctaactaaatccaacaaaacctccaatcaactctgcctatctctatattgccgctgccaaattctgatagaattctttccgacactcaaacccttaactccctcaactaacaaaaaccagcccattgggcttattacctaacacaatcataaaactagattttacttatttggtattattccttattgtatatggacaggaaaaagtttatcaggacaacattgaagcaagtgtttcagttctgaagaagctttctgatgattggaaggagttatcaacaaaattgtctcctcatgatccactgagggataccataaagaacttgaagcaaaaggtagttttacaggcaaaagagctagactttcagtttattgcatctgggtttgctctccagtctcccaggatggactggttgaattgtgttttattgtactgaagtaacagaatgtttgaagtaaataatggattaactttttttggctgcagaatgagaaagtattggactctgagactgatgctgctcgtcatgcacacttcaaggatgccgataaatattgtaagataatcttaggaagagtttcgcgaagccatgggtgcatgacttgtttaacctttacagttcttgctttggctgtgggtgctgctgtttccttgtcccccaatttggaatctttggattttaagaagctctcggaacttttcaacgttcagcactgagtactctggagaatatcccgcattaccggtagttggttgcttccaaacggcaattttcttttcagcccatctcattcacaaatcacaatgggtacagtaaaccaatagcctcataataaagtgctcaatgcggagattgtacacttagttcaaatcctgttcggatgacagagaatagttgaggtcaacaatgctttgaggtttactttagtttgacctttttataatttatttgttgttgtttctgttgagttttaattttagttactatgcctttacattaacttatgctggcaaaatgccaattaggtaactacagctgtatcctgaagttagttattaatcagaggaattttggtggtacattgcgagatttttctctaccttttgctctgttatcatgggtggatgattgtgcccttttctgttgccttttccctggtctcgatgctttgtttttcctttaattgaacaacattattgagcttatcagatgatcgatataaaatcaggaatgtgattttttttttttagtgtgagaaaggtagaagttgataatttcgagtgaataagcgcttcttacatttttaaggctctcgatacagtagcatgatgatgccaagtacaatctttttctatttcagagacacttttatatttgtgaaaccacgtattttgatcaattttctgaaatttgcattgcatgatcgatatcataactacttatctcgattcaatgaattttttgttaaacttattacattacattaatgcccattaatttccacctcagcgcctcgctcattaatttgaataacttgacattatacatcaagattagttttattagtttagtgaacaaaattgttgaattcttttacggattccaatccatgttgttccacatagaaagtgccattttgaagggttacctgtaaattttgcaactgaatcccacttaatatattcattttgtaatcaaaatcagaaaaacaggtataaccctagattcacaacaatgtagttttggggaactgcacatctatagaacatctgatttgttgtgttttggtcttgatctcatagattatcataatcttcaggttcggcatatgggtactttgcgtatgaacttctaatttttgaaggatcttcaggtacagaccaagggtactgcaaggaagggtcccgtgggaatttcctgaagtttaaaaatggtgcccaaagaataaccctgcaagaaatcacatttcacacattagtttgctagcttttagaaatttgctgccaattcttgaaacaaataatttcaaaagtcatgcaaccaacttaatttgtagatttgttatcactgcgcacaattatactagttgcttcatccttatattataacatgaaaaatgctcctaattgaaacctgaactcagtggagttacactgtagtcatgcaaaatttcgaattagagtagtctcttgacaaagttagacaacagtacatatattttgcttttagatgaagagttgctcacccggggaagaaaatgaagacacacatgaattgaaaatacatctccagcaagtttcttcggtaccatcttttccaaagccagtacatgattattggctgcaattcactcactatgttctgctcagtcacatcttggtaagtacataagagcaaacttcaaaaattgtgaaagaaaagaacttactggcacgacaaggaaatatccaaagagaacaatcccccattgtgtcaaaacccagaggagttctggccggttattctctccagtcactgccaatactggctgctcagcctgttcaaatagccacactcaacttttgtatgtaaaaaaaacaaaaacaatgaagaatatggcaaccactgtaacctcaaagatacctgtttaaggaaactttataaagttgttttttgaaagcaaaatgccaatcaaattcaatgatactggttgaagaatcaaaagtgatattttattgaaaagtgtaacagtgcatttcactgcaatttccaatacaatctcaacttaagactttctacttgacgattctttaaacattgattagcatgatcctttttagaaatgtaagtttttttttttactattcataaaaatcaaagacaggtatcaaggaaatttataataacttacactaattactcaactaacttaagtgagttacacccctttattcttagaaaagtgtaatttaaagttaccaacacactcttatcataattttcaataaaagttatctattgattaattactatttaactaggatctttaggagcttaggttacttgtttgctggaagggtaacaaaaaaactgaatttctatgtacacgaatctcaccaaggccaagagtactcctatttgcagtgccaaacttgcatgctttaggctgccatcatcagcatgatttggtttctggctgctgcatgttatctgcaatgggactcatgagttcaagttggacaagtttttcaatgaaatgaggtaaactagaattatagagaataagttggcaaaagaaaataaaagtacacgtagtgattggcaagaactagtgttgttgtggtatgatttgtgcttggaagaaaagaagagagaagttgttccacgtgatgaagagggaagaggaggcagagctttgggaacatggagattgaatgtgaagctcatttttggtttagagctctcacagtttggctccttatcctttttctcacttcagtttcatggcaatgagtgaatagccttctgaggaaaaaaaatgacaaaattaaatgttgattgagatgacacgtggacataagactcatccacctcctctttttcttgtccattcaaagttttgatgagggtaacacaaattcccccaactctttttatagtttgtggtcaacataaatgtactgaattttgcaacaaaaataaaactacaaaaactgttgaactaaaatagaacatggatttttacttctaatattttttacaaattaatttgtttattttttttaatatttgtgcattaaaaaaattgtaatccttgttggtacattgagactacggttttaatgtgagaaggctggtaagaattcaatcactgggttttaaaagatagaagtagagtgtgggaatcagaagttccaacggggagacaattaatatggctttaatttctccttcaaacagtcgtgaacattttgtagttcaattctcatccacgtgatacatttttcttttcatgaaatgaaaaacattaatatttcatcaacaaagttttccagatgtgacacccttcccattttaggcattttcaaagttgaagaaccattgttgccttataaatggaggacgtcacacctttccttaatcattttaaatttgaggtgatgttacagttcttgaaagagtcagattataccaatgaaccttagttatagtatattattaagtatattgactcatacgacgtataaataacttctatattttatcgagagtattttagtcgtagctgttaagttgtttcctaaatttaagaattgttcataactaaattcactattattggacctattttaatttcttaaagagttacattgctgtggtaaaatttgttaaaagtttttaaaattgatatggtactataggatctataaaaaagagataaaaaattccaatgatgttcaacttttttggttttccatatgtataatttttaggaaaaaatactgtctgatatactgtaaaatactatatgtggcaacctgttttaacaaaaaattgaatattggtttgtcagattgtagatgaatagttcatttcattagatttaactttcttggttctaatggtgtttacggtttgaagatgttctaatacttttaagaaaatgaaaaaaatttaaatataaaaggtatatactttaaaatttaagtaaaaagttaatgattttttagtcccggaaaactttccaaatttttggttttagtttccgacttttaaaatattgatcttaattcctatatattttttaaatacctaaactttgctctctatatagttatttgattatactataatttatatatacacacatatatatatataaaatatttaataatatgtattttttaaaactgaaaaataataataaaaatataaattataaatttaatacaagtataaatttataattgaattaccttcacattttgattgcacttttaagttttatcttatgtttcattatatgttgtataacaatttcctctttattaaatttaaaaagtataatataatgaatttatatttttaattattttaactgtgcggcccaagatgataatggtaccaaacttgatgtgtgtatataagttaattagtaaaaattatataaaattaattttgtatgttattattataataataataattaatgttaattaatgtaaaattagttatcattatcattaaagtgataattagtataaattgtgtaaaattaattgtttatttgttattattcttataataattaagattattattatttaatataaaaattaattttaattttatgtatactaataataatttttaaattattatttattaaaatttaaaatttagacagttgaatatttataaaagatgaaaagaaaaaaaaaatccaaccccatttataaggatttctgcatctgtgcctgcaaactatcaatggttcatttgagtatggggtactttcaattctttgcaggttacagtgattttacgaaaaaaaattctgaaaagagatgaattgtgattcgtaacaaatctcaccatttatttgtcgagctttattaactaaattatatttaaaaaagatctccgccttagatactatatttcgtgctattcgtgcaaggatttattcgtacgaaatagcatcactcgctatttaatcactttcatatgaaactgttgcacttccttgcttcgtgtgaatttcgtgcataattttgttgtttttgcttaaatttctttttcacttacatagtaaaatcgatcccaaaataattgttattaattagtaattctaaaataatacatttcctaacaataaatgtgaagttaatgacaagaaaagattccatattgttggtatcaaatagttataaattataatatttctgatgagtgatgagccgttgggcatgaaaaaagttatatatttttggtttcttacatgaactgtaaatcatatgtatagataattcatgatgatcgtattgattagcttatggtggatctggcctttacgaaacgtagatcacatgtgatgtgggtataaatatggaagcattgttgttagctgtcaaactttatgatatcatattattagcacgtacaggtacagccaagtagtttcagactcactctgattctttctcagctcctgcaaaatgaatatgaacttgaaaaaagtgtgtgaaaaaatttaaatcaatatttaatttattataaactatatgaattgtattttttttataaatatgaattataattttaaagtaaaacttatcattctcctgtgtgtaaaagaatgaatgatgaatgatacattacgactttcccccctacatatttacatttcatcaaaattacactcgttaggattattctaatagctcaataaatctttgacaaaattgatataaagattcatcagcgacctagaaaaggtagatatgaaatttgcattataacatagaaaactaaattatatactatgttttatttgttttaaagggaatgctaaaataaaaatctttagttttttttttattatttacactgctctttaagtacttttagttataactttctaatcacccattagacaagttgtttttcaaatgaaatcctaatctacatttttatttgtttatttgtactaaattaaaacatttaaaaattcactcttaaaaatacagcattgttaacattaaaatataaaaaaaaacgcaataaatattctcctttttaataaaaatttaccacttttaaatacttaaaactaatattaagattaatattaatattttgttaaaataattagtctagagtgtaactatacaattgaaaatataaatattacatttctatgtttcaattaatacattgttatgtttccttaattttgaaaaccacactattaaaattgagacacattataactcctcaaccccaaataaagaattcttttaaaataaagaatacataaattcagatagtaccaattgccaaattataactacagttggataatctaaatcatttggagcttaagacagccattccttaatagccacttcagttgcgattggagagtgagaccaaccacgaaattactttttcccttttcatcaaccaatattcactttcatcctacacattcaatgcccttgattacaaatagttaacaataactaatcaccaattattacattaataagacactgacccttcctgcccttatcataacataaaaaattatcaaaaacttttgaaattaactaacagtgatttgtatctctaaattagataattcatgattaattcttaattgatatttagtatgaaataaattatattgtgagaaaaatatttattttatgtatattcataatttctaacaaaactaatcactctaattagtatcaatactatgtcaggaaaaaatcataataatactgttaaattaatagtaataataaaaagaagaaagttttaaaaagaaaaaaaaaaaaaaaaccnnnnnnnnnnnnnnnnnnnnnnnnnngggccgctaaaagccaaggttgtcggaattggatttgattcttcacttgcgctgagtcttaccgatttttccgatcaaagttcctcactttctctctcttgatcgacacccaccacgcgttagagagagaaaaacccgagagatcggaaaatgggtacgcttcagtcttggagaagagcctacggtgccatcaaggacaccaccaaagtgggtcttgcccatgtcaatagcgattacgcggtaatttccctctttccaaagataggatctttctttgctttcgattgattttggctatgtggggtggtttaattggttcttaattttaggatttggacgttgccatagtcaaagccacgaaccacgtcgagtgtccccccaaagagaggcacctcagaagtgagtgatttgtgggctttcagatccgaattaatttgatcttcttgttgttggtatggaaagatgatgatgaagttgaatctttttttggttttgttgcagagattctgtttgccacgtctgctgtgaggcctagggctgatgttgcttactgtatccatgcactttcgcggcggttggcgaagacgcggaattggacggtaggattgataatgatgatgatgacaaagtttatgtgatcgcttgattgatgtgcaatttgattttgtttgagtattcaatgatttgtctgtgtttttttggacttggattcttgttttacttgatggattgatgttgttaggtttgaagaatttcatggtaggaaaagagaaaatagagattcaatagtctgaaattgatattggcttgctgatgtcagaagatgtgatacaaacttttcaaattcaacaacatatcctgttagaaatccggctaaataaatgtgaaactaatttggattctcttttgttttttcctcttattgcgctctggtgttcggttttgtgctatttctgaattttgataatgatttgtggcatgtggcattaatgacaccaaatggtgaaaggaaatttttatgaaggattgaattcaaatctattttgatggatgatgcaatagtggatccaattttttgataattcctgttcttattcatgttcttattactatttactactaaaggctgcattttccttacattttgttaaatttgttatgcactggtttagatagccatctcttagaagtttattgtatgccaaaaaattgtattcacttattccaaacatgttatgaggttttcgttgtcgtttttctcaattctcataaattattaaaggatcaagcagtgatctgatgtccagccttcctttttattcttgtgccactattggaccctacgtagaattcctaaagtggtgtttggtaattttggtgtgttttctgatttcatttcagttgatatgctttaaattaaaaaaaacgccaccttattttttttcctgttattaaacttttgtgaagggaatcttgaaaacatttttttgacttccctagtagttaatttctagattcttccttgtgttggagggaatagggttccatgaaacaaaataaccattattttgttctcattttttcccttaaaaattcttggttaaaaagtaaaaacatggtagtttctcattcatgtaatggaattcctgaataccaacattgtgttggttattgcttaagatgttttcattatttatatgtcaactgactgaactgagcatctaatattactcattattcctcaggtcatattgtctaaggattatatataaagaatttatgcctagtcctctgcaatgtctcaattttatgagtctcaactattttcttataaaatgtattttagcatcagttgctagctcaatttcccttgtctagcctgtaattatataatgtgtatatgtagatgtagataacaagatatgcttttgtttcactaccctgcatcttgttcacaggtggcattgaaaacactgatagtcatccataggttattgagggagggtgatcctacttttagagaagaacttctgaatttctcacaaagaggacggattctccaactttcaaatttcaaggatgattctagtccaattggttaattttttggccttaccatctttatgttttgtttattttacatatgggcttaagttagatgtttctaactgtactatatactttttgccatatgatttcatttgcttgcagcttgggattgctctgcctgggtacgtacatatgcattatttttggaagaaagacttgaatgctttcggattctgaagtatgatattgaagctgagcgtctacccaaacctgccgaagggcaggagaaggtaatttcaatgaacccattattatactcttttaggataactggtcaagtttcgtgtatgttgcatctgatgatgtctttatatggattgagaagtgtttccatgaaaaccaatactaagacctaaggtgaatagtgaatactccctccatcccataattattgttgtcttaggtttttttacacagaccaagaaaaactaataaatggatgaaaaagagagtagcaattttacataattaaccttatcatcattaattatttttagtctttgttgcccatcattaatattataaagtgtataagtggaaaggcaattattattatattgaaaagctaaaatgacaattattttgagacttattttttattcttacacgacaattattatgggacggagggagtgttggtaccaagcaagcacacaacaattgagaaaacagaaagagagaaagggaagaaaaaataacacacagtgtttaccctggttcacccaatgtgggttacgtacaacgtctgcgagcggcttatcttctgaaggcgaagtatgagccgtacccaacagggagtactattttctctgactgtcacccttttccctagacaaaaatcatcctattgggagtgaaaagcttagtttgtcttgaatatatgtattctggtgttgaaaatcatcagtagtatttcagtgggtgttttatctatatgtttttgttgtctttagaattaatttggatttggataatacatttactaatgggttggtgtggtgtaatttgttctttctcttgatagctgtgtcatgtgctggtgtagtttagaaacgttagccaacttatttgtcgttatgtgaaagtttggggttcttggtgtacagttgacgtatatttcacccttggaactgtttctcaagataacagcaatattttggcaagaagtcctttctgtgtgtgtgtgtttgtggtagagtcctaaatatcaagaatcagttacatagattatcaatagttagttacagagattggagtttggaaggataggtatttagcttaaataggaggagaggttggaacaattagttagtttagtgctagaattctgcagagatctttgatttgttggtattgctaaaactaaactactaaattacgaaccccattggccggaggcttcacgctatgcgtaggtaaggagaagggatattgtacgcagccttaccattgcatatgcaaagaggctatttccggattcgaacccatgaccaacaagtcaccaagaaacaactttaccgctgtgctagggctcgccctctttgccatggtggaaatacaatacattatttacattattcgaattgtctatatttattgtttaaattggtttgcattgctgatggacattgttaaaaacttctaaatggttagttgtggatttttttgactcactattctttgattatttgcgtttttgaagcaagttgctttctgattttgtattgtgtttgtttttgaaagtcttcatgcttattttgtttttcaaacaggggtgcagcaagaccagggatttggatagtgaggagctattggagcagttgcctgctttgcagcagctgctgtatcgacttgttggttgtcgggtaatattgtgaaatgtggatattcattatcttatgttattatttttttaatttcaccagtttatatcatttggtttaatgattatttatcttattactgcttttttgtagtattttctcgtacaataaaaactgattgtatgcttcattttacagccagaaggagcagctgttagcaattatgtgatacaatatgctcttgccctggtatgttttgttgtctgtttatctaaagatcctctttgtattgagctagagatttagagtttacagataggatatataaacgtttggaatgtaccatctatattagatttttctgggcagagaaccagagagcatttatagcgcatggttgggaaagatgggggattctttggtttgactggaactgtattggttgatcttgaggttgtggaatactttttcttttatttcatggattgaaacttttaagatgtgaatattgggattagaaattgaactttgattggaatgccttccaaactttcacaaccatttattgatgcttcttccatttaaagtaggactgggactatcctccatatttggttgttgataattggaattgatatcaaattgctacatctaaaactatgtttaggaaagggaaagcatgttggcaaattatcatcatagttaaacgagtccttgttagtaaatagttgtgaatttggagttgatgtaattgatcaccaacttgatattgatctgcttcttttgttctttctaggtactgaaggagagctttaagatttattgtgctattaatgatggcattatcaatcttgttgataaggtaaatgggcttatcattatttacatgatgagtgtcaagtttaaataaaatgtgttttatactggaaaatgataatttcctttttgtagttttttgagatgcccagacatgaagctattaaagcccttgaagcctataaacgtgcgggtcagcaggtgatattttgctgcttgtatttctttcagttaaccactggcttttgcattttaatttcatgatttgttgcttgtataaaacacccaaactgttgcaggcagcaagtttatctgatttctatgatgtttgcaaaggattggaacttgctaggaattttcagtttcctgtcttaagagaggtatgcctttatgattatggcaatctcatgctttgatttaacaatttattcctgttcattttcaatttagggttccaattattttcattgttgatctttttagcctccacaatcttttcttaccaccatggaagagtacattaaggaggcaccacgagtggttacagttccaactgagccattggttagtacatcatttattgtgtttatgtagagcatagctgttatatttcctttgtaaattgatttttgcaatggttatgctgaacatttgttggccaacaatgtatgcttttccttgttttctttcacattcaagttctagccactaatttattgtgctgtatgaacagcttcagttgacttacagaccagaagaagttcttgcaattgaagatgccaaaccatctgatgaagaacaggagccaccagttcctgttgataataatattgttgtctctgattctgaacctgcacctccaccaccaccaccaccttctcacaacaattttgaaactggagacttgctggtaggtttttggatcccaaagttatctgttattttttgtatgatttattttccttatgctgtccttgttgcagggattgaatgacactgcacctgatgcatcttccatagaggaaagaaatgctcttgccctagccatagtccccactgaaactggtgagttttgtttttggcttctgctcaaactctgctggttagaaaggtttagtggattatgttccagttttgcttatctatgaaatgtgactgtttcatgcatataggcgctacatcagcttttaactcgactgcttctcaaacaaaagattttgatccaaccggatgggagcttgccctggtcagcactccaagtactgatatttctgcagccaatgagagacaattggtaggggaccttcaagtgacctttctagattgttaatattaattaatatccattatatcatcctatgaagttacattgttcaataaattgtttgttggcatatactatgaagtttactcagttgtcaatatatattgcataaatttgatttggtgttaatctactgtttcgacggacaaatgtgcattacatgcaggatttgaggggtataaataatttgattgtttatatctgctcttaatatttttaagacatttgatctgtgaatatatgctttttctcataccaatagggtccatttgttaatattcaatgccactgtatctgataaaaaacagtgtagatgcctagatggtccatagtgaatgatgagaataacataaatctctctaacttgagctgtttgtcatattttaccattgaatgtcaggctggtggattggactctctcactcttaatagcttatatgatgaagcggcatatagatctgctcaacaaccagtatatggagcaccagccccaaatccatttgaagtgcaggatccatttactctatcaagcagcatccctcccccacctgctgtccaaatggcagcaatgcaacagcaagcaaatccctttggtccttaccaacaaccatttcagccacagccgcagcagcagcatatgttgatgaacccagcaaatccctttggagatgcaggatttggagcatttcctgcctccaatcctgttcctcacccacagaacaacaacccatttggaagcactggcttgttataagaatgcctttttgaacatacaaggatgtatttaatcaattaagttggttggttggttggttttgagcaaattgtaatatgtttctcatttgttgctagatatagatgttttctggaatgggagttgtgccttgtaaaatcgagacaacgcacacggtgtattaatcattttatgatatacataatggtgggatagctttctttgaacatttcccaactcttaagtaattggaacacttttacacatgttcatatatatcgtattcagtattcatggtatggttctacactttgtattagattatgtgtcagtgtcacgttatagctttcatttgacgtttcttgtttataaatgggggcggggggtaaaattggagcagccagaggttgctgattctggtcatatctgaccaatgccaaattgccaatgattcagattggaacactaaatgcatactagtatgttagatttgatgtttgatctacatggatttagaggtgtactttaaaatataacgtgcattgtactgttgacaaaataaaaagatttaaaattatgcaaaatgcatgactttgggttgaaacttgttggattttacattctagttcacgggttagaactgggtcagagtcagtgatccgaggttgaagataactgcaaatgcagtttgacatttgtcgttttatgtgttaaaattaatgaaacagaaaccgcccgtaagcgaatttagcgcagtgtcaaggtgcgtttcctatagttttttgtctgagttcgaatctcgcagtatagggtttgcctaaacagctagttatgttggtgttgagtagcaattgtcacgactaaacactataaaagtgaatgaacagttcacaatgagccattaatgaacattaagtgctggctattgacgtgccagcccatgtgtagatgcaatgatggttgatagtttgatgacttaaaacaatatgaacacgaaaaaaaatcgttgcatgtttatatttacataatctatgacttagaattataagttgatttaccaaatttttttttgtcaagtttaatttttaatttttaatttttatcgttgcaaattatcttttatattattataaaattatgttattgtaccatcaagtacattaataaactgacagaattgttataatttaattaggtattgaatttaaatcctaaatatgtaattgtattttttttttatttaaaaaaagacatgcaattgtgttaattacacaaataaacttaatttgtcatatccaatttgatgttgggtattgatcaaaccctcaaaacaaatcaaatcaaatgcggaagggaaaaataaagacacgagaaaaacaaacaatcaagttgtttaatttgagaaaaccttcctcaatgtgaagaagtaaaaatctataggatactaatctaaaatcaaactttcattataacaataatgattacataagatcaaatatataccaaagtgatggttcactcaacctctcaaacaatggtgataatcaaactctctaaagtgtttcactcaaactttctctaaagatctcacaaatgcaaaacacgtaggtttgctcaaatatgctctcaagaatgtcatctctcgtctgaatctctctatgttgcgttgtgttttctctcattctctcagtctgatcttatctgactctaacctaatttcatcctcaactaatgtatttatattgggaaattaggtttgaggttttagacctctcaaatggacttggaccagcattggaggagtaaatccaatccaacacttgattgtcttttgtgaaagatataaaattatgagataattttaaaagaacttaatctcttataaatgaacaagtagccaaagcaaacctgtataaatttaaagttatatattaaaataataagtcatcttattaaaaaaatgtccctagacctacaatgtaggtctatccctgcctataagaaagagaaaaatgaaagtgttgttctaagttcaatgatgaagtttgtttgagcatgcttactagctactgtctaacaagtacttgagcacatgaacttataaatatgagtacggtgcacatatattactttcaggataatagttaccccttgtgtccccgtgcgtctgtgcgtgtgtaaatttgtgtggtatggcatcatgaagtgggaagagaagagactcaggaagataaagagagggttattggtaggtagaaggagaggcatcaaagagaaaaatatggttaagggaagggtgaaaaaggcaaggtgaagaggggacctttgtcctacacatcctaacactttcaagtcatcatcattgctaccacatcccttcatgtaacttagattaattaaaattaatcttttatttttcttggtaaaggaaccatgagtaatatcctatcattagcacttccatgattcttactttctctccattgtgtatttttttaattttaatcctaacagaatcctaagttttaaaataagagaaaagataaaaggcagtatttctaacgtactttgctgcctaaagatgaaaaatataactgtttggaatcttgcaaaaaatatatatcaatttgctttctgtaggttcattatatttatctatatatccatacttaaaaagaaaaggcattactcttaatttttattttcctgacttagactgttatggctccgcagacagcaggtaattcacgttagtgagtttttttatagaaataattgtttcttaattttatataaaaaactatatatttttgaataaattaaatcaaatatgtatatatatttttcaataataaataaaaacttacaatgtgccacaagaattattaagttggattcattgaacctttaaactttggattacagaaggaaggaagataatatgaccctttatagtttnnnnnnnnnnnnnnnnnnnntgtctatttttaaaataaaaaattgttctaatttttattcatttaaaattttaagacattattaagtattattttcaatatacccttattatattcatttaaatattaatattttatctacatattataaatgtgagagaaaataatataaatttgaatatcagcaaagaaacatgcatgtagcataatcattttgaaaaagtgaacatttggatcataatattatctaaatgccaacgcaacttaatctgagatgcaatgttttgtatcattattcaccatgaacatttcatagcaaaccattgtttttataaaaaaatagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaaaattgtatttacataagaggtatttgaaatgaataaaaaatagaatttaaattctatatattatcagtataaaaaaattgagaaatggtagtgaaatattagtgctctttaatatactctttctaatacacttcactatcattaaaatttattaaatcttacaaaatcaagagaatcattaaatgagaagtaaaatctataaaaaaatataattttcaacaaaattcagctaataaaaaaatatgttaaagagtatgttattaatatatataaaaaagttttattttgtaagttaattaaaaataagatacatataacttttaaatttaattattataaaaatcaaaaaatttagtgtatatttctatttgggattaatgacaatacaaaaggaatttacactatttgtatatgaactttttgctctagacaattataataaaaaactaaacaatcattcattgtagaagaagttacaccatgtgtgtgttgtgtgtgcgcaggtgcctgcgtataaagatcaaataacacaaggcattgaacttagtaaaatcaaaagtgaattttatcaatttaactacttccttcatcctaaaataatagtcatcttaaattgttttattcaaataaataataataataataaataaataaaagataataataatttattatttattccataaattggcatgggtttggtcttggtgtgagattggggtgtcagctgaaaacataattgggatgtgacaccttgccttgtgctcttatcattcttttaaaaagatagtaattttataaaattagtgttaaattatgattaatttatttatagattttgttatccaccattaatattataaagaatataagtaaaaaaataattaatgttacactgaaaaaactaatatgataattattttaaaacaaacatttttctcttttatgacaattataatggaacaaatgaaatattgaatttaaaattctcataaatatatcaaatatacaaaatttaattggtacttattgtcttattttagcatatgatatgttatttaagatataaataaaaacagttattgttgaattatatattaataaatgtctaaattataaatttttctatgtacaccatcatgattatatcacatgcatcaaacaattgagttgacaaaaaaatggttattgaatgtgtcattttactctatgtttaatacttgatggcattttatcttgtctcgtgcacgtgtgcttatatataatttaaaaatgactatttagattacttgttcgtgatacataggaagttttttaatcaagaatgttttattataattataacaaatgataaggtgaatgcaagtagctaatgaatttactgaataatagatatgggtagaaagatttaataaagcttttatcaggatcgtttaaacttcttaccgatgatgttaggatgttttagcaatgaatattgagtttcattgatcttgaaaataataaattatattatttatatttggtcttagaaaaggtattataaatttaaatattaaacttccgactaaattttaagaattatgttgcatatataactaatgagattaaggaatcataaaataaataacctcataatgactttttttcgccaaaatcaccactatatgagtgcataaaacccatcaaatatgaatctaacttcatttttacacttccttcatactctcacctatttgagtgtaagagtctttgcatgtgatcatcacgacattaccaaacttgtctttttgtcgtactttttgctgtaccatcttcaccaaccaaaaattgtctttagtctagttcatgccttcttgatattttaaattaaggaataaatgtaaaaatatttgtatatgggttcaaaagaacttgtataccaagaaaatattagtaaaaattatcttgagcattaaaagaagatgcttggattatgcgggagctaatcacacgaacaataggggaagtctatgctttaactatctttatcattatttgattttctagattaatttgaatttaaaatttccttattcctggtttttgggaaattttatttttcttttttactaaccatttaaaaaactagcatacactaattcttttagagtgccttcattaatttatttgatttagtaaaataatacatgacaattgacaaatctatgaaataatactctatttatcatttaattatttgttcaacttgatacattttcaaattttgatatgtaatttgtgattttttttttgttgtaattaaagtttaggtgaagtggatctgaagagtcttcagagaatcaggacagatatcaagaatctcatgtcgatatcaaaaatcaaactcacgtctttgtaaaatatatgtatgattttttatcatttggatcaattttaattggaccaatctttattgacatgatgtattattttctaactttattggttatcacttattaataattggaattcaatttattttttaaattgacataatggtttaatattgttttgattgcatttccatttctaccaccaaacacctgaattatcatcttttttagttgggacaatttttgtcccatttgggtgatcggacccttaaatgcttgctgattgttgtttataagagttaattttgatttaaaaagattaaggaatgaaatggtgtatgattattttgttggagtctgaattcacttcattctccagattagttctaaaaaaggttaaaatgatatcagttcagaaatacaaagcattgaaagaagtctctgtcgataacagatgtcctttcactcctttgctatgtttgtatagacatgatgtcggtatcattcaaatccatgatattcggtgcctaaaatctaaacaaaaaataaataaatagaattaaagaaagaaatagcaaatatccatcaagtttagtgtttattcactttattggttgggatatacactgatactgtggataaacacagataactgctggccatctttccctaaccaaagcaaaaagttattattggttctttgtccatagtccatacgtggatatttcgttatgatttgaaagattaagatggcatagcatgaacgttattttttatcactaaacctctttctattttgattacaaaacattttttattcatcacttagtaggtaaataagagattacacatataaaagtatagactttttttaaggatttttttatgctcatatatatctcaaaaatagactcataataaagttatgaaaaactaaacccctttcactggttaattagctaggaatgaaaatttgggaatatttaattacaataaggtttaatcattctaaagtttttttttaaaaaattttattttttcctatttatgttcacgaaccaaagatttagacattctaaccatcatccattcttatctcatctataataggatatgatactttatcataaaactagttaaattgaatgaatgacatatgtagcattccaattaaatttgtacgtaggccattaaacctttccaactcactcgtactattaggactccaattcaaagacacatcagagcgttatatatgttagaatatgatatttgtatcaatcaattaacttaaaacagtaattagcttaaaacaacgaaactcaattccacctgttctaatgtctaagatttcaatgtaatagtaatgtgttgtgcatttaatcttttattattgtcacccatcatctttttctactattcagtactttcaatgtaccatttttttatataaaaaaagtgaaagaagtaaattgcaattagattgctggtacccccttcccgcattaaaatccaaaggcggagttttttttggcaagttcaatcttttttgctaagtcggagtttgctaaaaggatgttattttcatgaatcatgatataacgtaaataaggttgtaatggttatcattgaaaatggaaaatagggtccatttttatgattaatatgtaagattaagcaaaatacttcaacattcgtttcattatgttttattaatttaaattttgttgggtgatgtctttttacccacgcaagccgtttagatgaggcctatacgggtcccaatctaattgatcaattagataacaaatgcaattcgtgagttcatttttagcttaagtctccaaatttgaaaaattcaataaaactttttactaggagctatttgccccataatttagactatttttcaacaataagtggaccaacataaccaatcttttgcgtatattattcttattcacatgtttttttttattaaaaaaaatcaaatttctggatcatgtcatgtgttcgaagtatgggactcattagcctcctgaattgcaaagttcatgaagaacaatgacattttttaagctctacttttgtttaacattctagatggttgataatcttttgatcagaataagggggaattgagattaagaaggagcaattatgagggcttccaacagaaaacaatgacattttccaatcccttcttttgtttcacattttcaaatggttatggttctttggtcagaaaagggggaagaaaatgggattgagaagagcaattaagagctcccaccagtgattaactttaaaaagtgagttttgctttgatgttccttccaagaaagatagtctaggtttgaatttaaaaccttttttttttcccgttttctttacttctttgcgcttttgcctaatcaacaatacatcataataaatggtcccatctttccaaccttcatttaattgtcacatactctagcacctttctcattaactttcaaattacacaaatacttataatgcaacccattagcacaaatattttatgggaaaacataaataaatttaatatttgccacagagcattctatcaattgaactttgataaataaattagtttattaatttattgtacacatcaaacaacactgatgataggaagaagggtccaactttttttaatttgacataaccataatttacattaaaattaaaatttgtatttttaaaatttaatatatctctccgccaagagcttgagagagatattaagatttatttaagatgttgatttcttttaacatatttttctttagatactagtctaagattgaatccctaatcacatttaaaagataagattatttctccatcatatcacattattttaattttgtatttttggatatttagatggatgtacattcaaatattatcatcaataggaacaaaagtgtgatcatatatatatttcctttgagctggcatatatgtactaaataaattttataatggcagcccaatttaggttaattaaattagcattggggggtgggggagggagaggtatctgctcaattataaccagtagggccaaatgagagacactgaaaaacttatggtgtagtgcagtggaaacttgaataaagcaaaagcaatttgttggagggccaaagcacaacattcaccaaggtagctatagattccttttataaaagagatatggaaatgtagatattattttggaaagtacatatgggtgtgtgataatgtatgggaacaaaattttgaattgtcatcaaattatattttataaaacatagggtgctattgctatggcaattagtcggtgagtgacggtgcagccatgaccccaaaagccaaattcatccctgttggaccccaaacatcggcttcttaaggctacctttctctagggtttaattggattacttaactagtgagttatttcattgttcatccaacatgaatttatggtaaagaggacaaaaatacaataaaactcaaataattgaataaattatttgatgcaagtttattttaacatagaaattcacgaattacaagtatagaaaaagacaaaaacaataattttattagaatgtcaatagtgtacaaaaattacaccattatctaattttgaattttaaaataattgaaattatatttatgttaatttttaatatgttgatgatgtaaaaaaaattatacaagtagtgtatcaaaattaaactaaaaaaaagttgtgtatatggttataaacctaaaataaggtaactcgtattcttgattgaggggggaaaacaacaaattttttataatattgtccatctgttgaagttaattatcagctttctcttaaaaggtgtcacccctgtgaaataaaattggcacacaacaggcttgtcgacaaagtaaaataagtgcaatttaacttttaagcagctatcttgcaaaccagagtttgattttatacatgatttcattggctggaatgagcgtatattaatattcatataaagaaaacaaagtttcttaggaagcatacccacataatgacttaagcatctgcaggtataacaggccccactcctcactttgggtctggtccaccagctcatgtgtgtggtttggtgggccgttccattttgttacctcaatagaaaaattgaagaggagctggcagcaggatcatcaaaataatatttttcagccacagaaaattctagaccttgaaaaagctcattacaaactcaaactatctagatcccaaaacactaatccacataaagcagtgattacacaaggacagtttcacattttctgtctgaaaaattcctcaagtttcacaacaatatttgtctttaggtacaaatgtaaaattaccaacatgatataatagtttgatagataatcatgttcctcaaacatttaaccatatgtttatatgtatgaaataatatacatgtcagaaaatattattttttaaaataattttagtatctcaaaattaatttttagcttttaattaattgatacagtaaaaccatttaactgttaaattgccatgcttcattttgtcaaaaagcattccataaataatgcttagaaaaaatatacacaaaattcttttattttctttgactcaagaacatttcatttcccccccttaccttagtcctctttggttatcattccattcaattcaaaccgcctatttctcactcagtctaaataaaaccacttgctatctacttctcttctactctctctctctctcatacattacacacccaaaatacagttttgacatcttgtctgaaaactctctttcccttaaacctttttctctgtctctcattccaatacttgcttaggttccaatctgatattccaggtaaacctttctttgtacatatcaaaaaaacagaacaccaaccatggcttccaacaagtttgcaaccatgttgcacagaaacaccaacaaactcaccctcgttctagtctatgccatcctagaatggattctgatcatcctcctgctcctcaattctctgttctcttatctaatcataaagtttgcggattactttggcctcaaaaggccttgcatatggtgcaccagaatcgatcacatcctagagcctgggaagtacaagagttcttgcaaagatcttgtgtgtgaagctcatgcctctgagatttccaaactggggttctgctccaatcatcacaaactggctgagtcacaagacatgtgtgagaattgctcatcctcgtcccaaccagattatgtcaaactctctcagagttttggtttctttccatggatgaagcagataggtatgattcaggatgagggtgctgaagatgctgttgacaaggcaattgtgaaggttgaagtggctttgaggtgttcttgctgtggtgtcaacttggacacaagattctaccctccttgcattctgatcaagccttctctcaatgttttggagtatgaccagaagcagaattcggagagcggggttggtgtagagattgatgaagatcacaccagatcggatattgtgcttgatcatcatcaggatgaaaaggagaatgaagaaaacaagggaagccagatggtgtttgaggttgatcggggtttggatggaaaagatgaggaggcagagaagagttgtgattgttctgtgtgtgatgctagcgtggagattctgtgtgatgaaatttgcaagatggatttgggtgtggagaaagggaaagaaacaattcaagaggaaagtttgaatgtccctaagcctaaggataatgatggtgatgatgttgttgctgctgctgatgatgatcaagcttgtgagaaatccactgctcaagttgattgcactagagagataactgtggagactccacccatacatctggaatttttcattcatggtgatgattgcagattgattcctattgaagtggttgactcccctgccccagaaaacaggaaacaaagcaaatataaggtgggacgtgaagggctcaacagcaatgaagattttattctggactttgataagagtgctgatgcagaagccgaaccggttgtggagaattggcacatttctggggatattgtggcagaattttcagcacaagggaatgaaaatgtttccaagtccaatgggggtgaatcagttcaattaaggaccagaggccagtcttcagagctgttacaagtagaagaagaaagtttggagcagaattgtgaagatgtgagatttgttcaaacctcggaagacttgaccaaggatgataatgttgaagtaaacatggaaagaagagatgcagaactatgttcagatgtttctctaggttctaattattttcctcctcaataagtctttttagttcttatacctttttcttctggattttctatgtgcaatgatctctaatactttcttaattcctgcagcatctgaagatgcatcacaaatggaaggtgaggaatatgaagcagaagtctcaatagggactgaaattcctgatcaggagcaagtggatgagtatcaaagccaagatgttcttttggatacaaatcaacaaatgcaagaagatccatctactagcacagtcagatttaatgtgcaagatgaaattggtaggcctcaactttttcttatcttcccttttcccaatgtccagccttaaaactttctaaataactcgcttctttttattggaatttataactaggtcatgacaaaggtgaagagtttatagaattcaaaaccatgtcacttgaagtgaaaatgccaacagtaaataaccatttgccatctttattggagcttaatgagaatgaggaagaaaaagttcctgacacacccacttctttggagagtctacatcagctacacaagaaactgcttctccttgagaggaaagaatcaggaacagaagagtcattggatggaagtgtgataagtgatatagaaggtggtgaggtaacaattgaaaagttaaaatcagcattgaaatctgaaaggaaagccttaagtactctatatgcagaactagaagaagagagaagtgcatctgctatagcagccaatcaaacaatggcaatgataaataggcttcaagaagagaaagcagcaatgcagatggaagccttgcagtatcaaagaatgatggaagaacaatcagagtatgaccaggaggctttgcaactcttgaacgagctcatgatgaagagggagaaagagaagctagagctagaaaaggagcttgaagtatatagaaagaaggttcatgaatatgaggtaagagaaaagatgatgatgtcaagaagagatggtagtatgagaagcagaacttcatctccctcttgtagcaatgctgaagatagtgatggattgtccattgacttgaatcacgaagcaaaggaggaaaatgggttttatagtcatcaagatcaagaatgcagcaaccagaacacccccgtggacgcggtcttatatttggaggaatcattggcaaactttgaggaagagaggttacaaattctagaacagctcaaggtattggaagaaaagctagttatattgaattacgaggaagatcactgctccgatgatgctaaatcagtagaacatctttgtgaagagaatgggaatggataccatcatgatcatgatgatcacaatggtcaggtaaatggatttgcaaatggtcatgtaaaggaaataaatggaaagcatcaagggaggaaaatcatgggtgcaaaaggcaagaggctcctcccattttttgatgcaatgagttcagaagcagaagatgttgagttgagtggagacgagttagactttccccacttgcaacacaattcagttgaaaaggttaattcggataggaaaaaacttgctttagaggatgaggtggataatgtttacgagagactacaggtgctggaggcagatagagagtttctaaagcattgtatcagctccttgagaaaaggagataaagggttacatcttctacaagaaattttacaacatcttcgtgatctgaggaatgtggaactccgggtcaggaacatgggagatcttgcagtataagaagtctccatgctcaaattttccaaagagatgatataggtaaaaaataatgctgatcttgctctattagaaattatttatatttctcaatcataatatcatttattgatgagtaatagtatgtgaaaccttcttatatgataagtctattaacttttacaatatatatcttaaaattcatatcaatgatgatttttaataaattaatactataaactattttttatagcgacgatgcatagaagctaaactcattatttatgcttataatgtagatttgtacattggagttgatctactagctgcaaatgaagcatgcatgcgtaccactgtggtctacatataatagagggcaacaaatgcatcacttcaattttaacaaaaaaaagtcagtgggagttccctgatggagaggggagaatccaatggtggacaagaaaactgaagtctgccattctcttttctttgtttcttttgtccaggtaagcccaaatttttggtgggttgtgcccatcatcaccttttgtgggaaagggaagatgatgagtatatgtgtgtgtaggctagtgaggtgaagccatcctgtccacttgtattttgtgagagcatcgacctggcttgcaaagctggacacatcccaaaaagattccagtgccaggtaaaatagcactagtttattagacagacagaattagggccactagttttgtcatttctttcattttttttcttttctttttttggttagagtgaagattgaggaaagtagcctctctcttttctctttctcttttttttcttttttctttttttcattcttgcgtcatcctttgaggtttgtttatttctgagggaaaaaaactgagtaacttgtatactacatgtattcatttgtaattatttataaaaaagtgagtgtttgtttatatatatactgctcggaatacatactgcttggaaataattaactttgcttcttgttatttttttaaagcttgtgactgagatagatgttttataaacaactaaaaatagtgaatggaatatttttatttgattgtttaaggcttacgctgctttcacattgaaatatttgattgcgctttaagcaaaatgcaacttcttgttagattagattgaaaacaatacaactatagtaaaataataatcttactaagttattatactgcgctgaaaacaatagaaggatggcacagagatacaagggacagaagcgtatttgtttattgataacaaatcaaagcaaatgctttaaaaagtgtgaacagcgacgcaacaattgccaccaaagcaagatatttcatcagtcatgtcacccttggatttattcatgaaaaaatggctcatgaaggattgaagatggcaatacgcaataaattgcctcagaaaaataggaaataaatttaatgtagtttgatattttttacataaatctatgaaactgtctcaacaaatattaatgcacgggacttacaaacattgaaaattccaataattcgtttctaatatatattttatttaaaatttataatttatatcccaacgcaatttttgtgtattgaagttgttcgatattctggttcaaaaattaaataaaaaataagtcctactatattatcattattttaacgtgaacaaaataaactaaaaaagtcttcaaaattaaatcatacaattgcaggggactcatgatttctttttcctcatagcgtgaaggcttactgtagttaattatgtttaattgtttatgtttatgtttagggatagggtagcatgtacagaggagaacttccagtgctggtgagtaggtagaaatttttgaggaaatattcctttcttttggtgatgatgatattggtagggataaattccttcgggtttcggcagttgttaaaattaagtttaagtatgttttacttttttttttttttnnnnnnnnnnnnnnnnnnnnnnnaataaataatttttttatatgtatgaattaggaattaaatctataattacacacttaaagagtaaagttattaatcaaatatatatcaattatgttatagcatgttgattaaacatattttacttattttcattatttatgtgtgtatgaaaataatttataatataatacatgattataatttgatcaattatttgaatttattgttaataatttttataaatatataagtattttaaaataatacaattatttattatgtgtttcttaatcaaaattaataaataattattataaaagtaaatagtacacatattaatagtaaaaagactttttatattgttattttaattagagattactagtttattacgtcttactcattgttcatttttacaattattcattaactattcactctcttactcttaaagagtcgactttaacatcaagaggaataaatgattcgaaccttaatcgtgaaattgtaaactgctagtagtagatctcgccttctgataaacaatttcactatttaattttaaaagggcaatttagacaattacaaattactctttaaaaaataaattcatttacaaatatttatatcaaaaccatgtaactagaaatctacacctttcaattttttaaagttatatttgacagtcataaaattgtatatcaccgtaacccagtggacatataagattgatctagattgaaaaaaaatgaaagaagaataaagaaattgtaggtttaaatctcctcaccagacacttctaataaaattttaaaactaatatttaccataaaaaaacactttaagtacgttcacactagcctaggtagttaatttgacatgtgacaaaaaaaaggaaaaaaaatattcttttattaaatagtaaatagattatacaaacccgaattagtgagggaaaaaaaattaaaatataataattttaataaaaaaattacgaaaatattatagtgtctaaactatttacaattgtatagcaatcaatcacatcctccttagtcttggtcaaattacgatttaatcttcgaaccttcaaaaacaaatttggtttctaattttttattttattcaattagtgaattgcatgctattttttatttttctaattacttctcttaatttcactccatcggacattccaatcaaaagctgcaattaattaaaaaagcaacaataacactaactgattataaatttaatccttgtacttgaaatcattttttttaacagtcccgtccattataagaagtatcattgtgttaaattaacttgacactcattttcgtttaaaatgaaatttgttatttaggcctttatgcaaaagatactctaactccgcaattaattcatgatttttcttaaaaaatattagggtttttttacccaaaaaataacattgtcataatcattgggtttaatagaaaaaatataacaatttaaactaacaataacatgaaataatggtttaatagaaacattgatgattaagtctaataattatctaagtgaccatacttgcaaacatgtagaaaccacatcatgtatcttgttagactgaaacaactctcatttcaaatttgaggttgtgttaagaaacttccaagctatgtggggctcagtgaagttcacaaaagcgtaacccttgttcatcctagttctgcaaagcatgaaattaatcatcaataagcagtttccacacatatcacggaaaaagagagtgagagagagaaaggttagttaaacataaggaatttgaaattaagaaaagtaattaaaaaataaaaaatatcatgcaatgcactaattgaataaataaaaaattagaaaccaagaaattttttgaaggctcgaagattaaattgtaattttgaggtacttagagacatcttttgggaaaaaaatttgaccaagtccccttacagacttgcttagagcttctcctctcaatttcgagcgtgtggccactagtttcacctcaatcggacactacagtcaaaagttatgacctttcgaagtttatgtacatcgctccgcaaaatgacacgcgtctcaaaatgacacgtgtcaacacatggtgagtcacgtttggggaggatgtgattgaacaccagtcacacccaggaaggacatgattaaacacatttagggagaacgtgattgattactatacaattgtaaatagtttgaaattataatattttcttaatttttattaaaattactatattttattttttttgccaattacaaagtcatggtgtaccttaattagaaaggactagactacatacgaccatatattttgatattcttattactgtatggtatatttgaaaggaaaaaatatgaatgatgaaacatatggtcgtcattttctgtaattttaagagagacaaaaataataattctataattttaatttgatatatatatatatatatatatatatattattttaatctctctaaaattaacgagttttaatttttttagtgtcccttatacctcaaatgattgctaatgttattattgctgcaaagtcagtagcattcttctttgttttgctttttaaacataagctaagtttgataaaattagctaaaagttgaaaattgtaaagtatatttgataaaattatttgttgaattaactgaaaattgtaaaataataaaattgtaaaaagagtaattaagaaattgaataaatatattaaagataaaaataaaaaaagaatataaaaattaaaaatataaaactaacactttaaaaaaattctatttcaagtaatatattattaattagatttttgtatctaaattatttaataataaagcatcgatactaaatatagtggcaaagatgatgaagttaaaacacatatatgttgccattaaagcatctttaatgttacatcatnnnnnnnnnnnnnnnnnnnnnnnnnnnnnnnnnnnnnnnnnnnnnnnnctctctccctaagatttcaatttgagatctagcattaaagaaaaaaattagaaagatcttgagagatctttaatcctatgtggtactatagggtccacaaaaaagtggtgtaagatctcaatttaagatttatcattaaagatattcttagaatatcaactttttaaaatataaattatttttaacataaaattagaggcattcaataaagacaaaagatatttttaccattgaaatataaacagatcaatttgcaaatagaaagagaggaaacttaaaaagaaaattgataaagcaatatttatattattaaatgatttcttgatctctcatatacttcacaataattattattatgatatgcctaattaacaagacacattgtatataagataaaattctgataaccacacaatcataaatttattgggtgaaaataagaaaataattatttatttattcctccaatcaaaattaaagaagatttttttggtaaattccaatttgtgacaacaattatgttgtcctttaatgccgagctcatgaaccatttgggtacataaatcaaatgaaactagttcatcatctttttttttatggagaatatgtagtttttctttcccactccaataggacaataaatgcgaggttagggtccaacaataaaaagtgcagtccatgattccttcacaccaaattcactcaaaactgatatgcgaaaaataggtgtctccacataatatgatattaaagcaatagagtcatttaacactgccaagtacctgcccgttctataatcaagagtgtcatttggtgaattaatgagtactataatatcatccatgtcagagggcatagatgttgtagagaacacctcattgcttaatagattcaaatgacaccaaaaatttcccggttgcactttcaccctgccaatgacacattccatccatatacacttgggaaccttccattttatggtaacaattaggcatgtcaacatcaaaagtgtcctccaaaagttacttcttaaactttatatttcccacagtgggtcaagagatatatcttctcatgacacatcttcccacgacacaccaagatcatcaagacaagatcgtttagtgcaaaaaatgttacatgtcgaatcaccttaactataatcataacaaaatccttaaagtttgaccacagggtttcagtaaggtggtatagattcaacaaggcctggcaggaatataatgacattgaattcctcagtgattaggttccacaatacaattgttgtccctcgcatgagaaaaacagttccattaatattgtcagaactcatcattcgaacataactgggattctctcaaaatgggggtggtcaatctaacttgactctcttcttaaatctctcaccagaaaacaaatacttgaagaatctaattcacccatcgtagaaaatggtgcaagttgttgtaggatgacaaatgtatcatcataatattaataattattagataaaaatttgttgtgatacatggccatgaaaggagagttttcaaacaaaaggccccataatttgcgtgcatatccaaatctcttcaaagattttagaggcagttttgacaaaacaatgacaatatcatcaggtatgttttttttacttatctttgcctccttatttgttacaaccattgccatagatttatccttcatagaaggacttttgacaataaaattgaaaaaatgagattgagaaaattggcgaagccaaatccactcaagtgtagctgcaagtgtaaaaaatagtctcacctattggatttatatatatttttattataaattatatcttgacttgacttgactgaaaagtaattgtcaaattttgtatataaataaattaagatcatgtatgaagatattttgtaatatttttaattttttatttaaagacttcttcaatcttgtcaacttgcatttagattctacatattctcgtgtatcattatagtattttgttaattattattttattttttattttacttttaataacttgtcactacaaactatgtctggtcaatataatatttaatgttatgggtggtcaatttttcttataatttattagttatgatatttcttaaatataatatattcattaaatgtaaaatatttttaaaagaattagttgataaaatatattttaaaaatttatgtatctattaatgcaatattaaaaaactgataaatatataatattttctcatttttatcattaataatttgactacatattgtatttaatatatatcatttaatattattgggtagtcaattttacttatactatattattttagatatttattaaatataatatattctatgaattttattagtgtaatatatgttttgtaaacctattactttttggacagtcaattttacttataatatattaatttatgtatttattaaatataatatatttcttgaatttaacaaatgtaatacttgttttgtacatctatgactttttggacagtcagttttacttctaattagtaccttaatttagatatttattaaatataacatacttcttgaatttaataaatgtaatacatgttttgtaaacctatgactttccatatgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgcaaagtgacatgtaatatctatctatatacatacatacacagacattaaattttaataatttttattattttataaataaatcttttaacatatttgaaaaaataatatttcacttgtctgttaatataagttaaatatattaataaacataaattatagtgtaaaaagtaattttgtgacatgttttttttttctttagttaaaactagacctcgaaccggtacacgggtgaattttgcgtgtgatgtaatattttatattgttttaaaagataattgttaataataaaataaataattagattctaaaattattcatgtgcagtatattatccagaatgtgagtttggatcatccctacaggactttagtttggtcaataaggctgttattggaaaggattgggttgtgtaagttcatgtttatcgttagacaaactctgttgtaaagtaatatacttttatcgagaatctctctctcaatttaatagctaaaaataattttacatcacaatttaaattatttaatattataaatctaaaatataatttataatactcaaatttatttatttattatggattttaattataactagtatgttttttgggtggtaatatctccattttaaactttattatcaaaaaagattattaataaaaataaaataaaaaattaatgatattaatcaacatattttttttaaaagaatcaaaataacttataaactaatcgattgcatgaattattataaattattttatattctttgattcctatgaataaaatatactaatttatatgctattaaaatattttatcaaccacactcaataaacaaaagtttatacaaaatttcacataacacgcccagaaagcatgcatccattcatacaagtgcaacaagctagtcaacctataaaggaaggtttcatatctaaataaaggaggtgacactccttgctttgaaaagatcatatgaaaaaaaaaacgtaagaaaattgtgttgtcgatctttgattctgggcagagtaaacaaactctaaatatctgttttcttagggttaacatatctctatattaatacattcatagaatacaatttcaaaatagagagtgtgacacaataaatttgatcaaatgaatgtaatttataatgctgaattttgcttgatttattgcttatttacaaacatcttgttaacactggataaccgtaggttattataatctagcaatctttcattttgtctttgtaatgattttgagcatccatctgtgttctctttagttagtaatatattgcttttgctgattaaaaaaaatgttgaatattgttctttataaggctaagttacaaaactacttaaaaaacacatggtaattttatcactaaacagttaatatgttcgtgatgggaatgcattcaaaacatgggagctattaccttacctatgactcgtgagttggatgttgaaacttgattggaatgatcatgacaatgtggtctcttttccgtacaacgtcgtaatatcataaagaattccgtgtgaaatggttacaaaagcagtgacgatatggatccgttctctcttgacttgtaaggcagaggaaacgatgagggtcccgaaacaacggaatcgaccgcgtttggttgaagatgctttctaagaaatagaataatcgtttattttttcttcttctaaactcttctgagattttgttttgtttcaacaaaatagtaatgaaggataccaaacatgtcgtgacattcgtcagagaaggaaatttttctatgtttcaatttttggattgatgtgcacatttttcattcaaacacttatgagattttgttttgtttcaacaaaatagtaatccagctgtctttgatgtgtttacaattttaactttaattatatttgagcctcaaagaaattaattaaaaattataataaatttcattataaaattatcaactcaaaataaaaaggtattaggaaataaaacaaacagaagggtctgaatatttgtacttttaaaatacaagtatatcttaataaaatacaaggaaacctgatatttttattgagtttaatttttagatattgtcaattatatagtgttaactattttacgatactataattaaataatgtttcagatgtgttttcaattaaatatattttactataaaatcttgtttgcattatttggtacgttctgtgtttgaagcatttaaatgtaaatccaaacatagcaatcatataatgtttcttataacgtaggcttagatttaacaaaatacctttttaaaaaatattttctcacctaataagtgagaacttgatccttcgagatatattcaagcacggtggagatattaaagcagaaatttatcctaacaattatatttttatatacataactttttttgttaaatgttaatcacatgctgaaaagatttgagtagcaattggaatattttgagagaccgcaacttactttgcctagtttaatttaatggtaaacgtgaccaaacatatccatgagttcaaacgtttagcaccattaatacttaagctcaaaggctactaaggaataacatttggtcttagttatctttgaatggacaaaggaatcaatcaatcaaggttcagtcaaggtatatactgcgaatggattaaaaaaaaaaagtatatactgcgacctcaaatattacctaaatgcaatggctagcacagtgacaaaatagatttaattttagaaaaattatggctttaaataattttttgtattaatggttttgtaataaattaatattttcaatatttatttttttgaaaaaagaagctacaagtctataactataactgtatttcattttgagtattttgtgatcaaatcgaataatttataaaactgtatgtatgtataatgtttttcttgtcattatgatgtgaagtgtctattactttaattgataattaatatttgcttgataatattgtgattatctttagtgagtttttctttcattcatttttttcatcaataaaatttgaatgagattttaagaaatttgaatataacttagcttgtgatgtgttggtatctatgatataagtagtttaatttttttttagttttgatgttatattagtgtaaatatttaatatattaaaaattattttaaatataacttaaaagaattttatataaaacttaacaataataatttttaatttataccatcatacacagtataaaaaaactattcgtattttcaatacattctaattaaacttataaaaaaataggaacatgcatgatattattaagttaaaaaacacagtataataaatgaagttatataaaagtaacaatacataagcaaacaatagaaattttaattacttacacaaagctttcattaacatttgcttttacttttgaggcatatttgaaaatgatcattttctttaaattctctcaatcaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttgatatggcagagagagaaagagtagtttgctagagagagtagcaaactacttataataaataattactccactttccaataaataattgtctccactttcctgtaatatatgtcattcctttattttttcatatctttttaaactaaattgaatggtaacctacatatttttattcaaatttttattcaaaataattttaaaagaaactgtattgttttacaaaactaatttagttaatagaattaattttcaattaaataaaaaaatatgataaaaaaatcaaaacttttcaaattgtttcacttattttttttttcaaataattgttaatttaaaatttgaatatcttgaatcagttttaaatttataataaaaattagaatcattttaaatagattttctaattattttttatttttaaatatattttttatttagttgaaaattatttttattaactaaattagttttgtaaaccaatataatttttttaaaaatcattttgaataaaactggtattttgaatcagttttaaattgattataaaaattaaatcntttatttagttgaaaattaattttattaactaaattagttttataaacaatacagtttttttaaattattttgaataaaaatttgtcccttaccatccaatttagttgaaaaatttgcaaaagtaaagagataaaatatgagaaaaaggaagcagttatttattataataaatatataattcaagtaaatttgttgctgtgtagttggttgaaagatctaaatgaaatatgatgcgtgacactgataatatacacaaaatagtaaattatgtactgtatagtttattgggagatttaacaaaatatgatgtgtgagagtgtgataatatgttttgatagtagatttcagtaatttgtgtttttggtggggtcattgtctcgagaaaagtcaagctggcgtcactaggtcaacaagcgcaacacgcaacactcttgtctcttcccattgtttatgtatttattgttctccccgaaccaacaaaatctctatgttgttctcttactcgcgcacacctctcatttccccacgaacccatttttcatttttccaaaaagatctcaactttgcttcaaactagaacactccctcttttatgttcccgtttcatgggcatctctcggaatcgtgaaccatagacatcgccatggacaaggacaaggacaagtctcacactcacagctttcttcacagtatcgtcagacacttcaaattcggttcaccaaaaggtaatttccctttctttcttcttcaatatgtgctttaattttgtggtagatgagttttctgattatactaggattctgtttctgctctgttgtgtttgatcagagcaaaacaatgaagctgacatacaacaaatggctgcacaggagcagaagatctttgcctacgaaaccttggcagctgctactaagaattttagtgctattcataagcttggtgagggaggttttggaccagtctacaaggtaaattcaaaattaatcaccaattttcttatttgttccgtcttaggttgctagcaagagtggcataacaaaaaactgataaagcttttcaattggttgaagtacagttttctctgaaaaggaatcaaataatggctggattcaataacttgattggtttgcaagcatttggttttccccctcttgtggtgaattcctctaaaatgaatgttttttctattattctattttactgggtaaaatgagaacccatgactcattctaattagtggaatttttggggtttccttgcaggggaagctgaatgatgggagagagattgctgtgaagaagttatcacacacttcaaaccaagggaagaaggagttcatgaatgaggccaagttgttggctcgtgtactgatgaaatgaatcctatttttttaaaaaagttccatataattagggttgtgtacaaaccatgctttttgtctgtgtagcactaagtttagatgaaagatttagtgtgctggtatttgaattggtgatcattatttcacgcaaatgaaatggattttaattaacagtctcaatcaagataattaactatagagtctatattatttaccatgaaagatgtgaattgagtttttccttcaacccaatttcatttggtctagctgactgcggaacatggactttccgggcgtaccttttcaatgtgattaatgatcaaacaattttttttttccaccatcagaatcagtttttatttgcattattataactatgtgccgttcaattttaacttcacctttaccaacaccatggaccgccacctatccttctctacctttcttcaaataagatatatatagtatactaaaacccatggtggacctgagactatgaaagagacttcacttgagaccttgacttttatgcacataaaattattcatttatctaattcatcggatatcttgcgtagacaatagaatgttcacgacggaactcctcccattcatcttatcaaagccatgacatgcgacttttgttgaataaaccatccctcccattttctcttttccttgccaaacaagcacatgggttaattaataaaaggtagcatttgggagttagaagacgaactttcaagtttcgatcacactcccactttctaagaaagatagtggaaacttcctaaacctaaactcttcttttctagatatattaatattagttgtcgtggaatagtcactaatccctctaaatcagatcaagttaatattaatttaggaatcatggttacgtgaggcacttttatttttattttttaaccaactaagctgatgaatttcctcaatatttctatttttatggttaaaaaaacaaatattatactaaaataattgccaattaaatttatgattaacatttgttcttgctgttgttagagattaattaatttttttgaataacagtaagttgaaatggatgatgcagaatcacaaaagagagagcagcttgattggaaacgtagggttggaataatcacaggcgtggcaaaggggttgctttatcttcatgaagactcgcacaattgcatcatccatcgcgatataaaggcgagtaacatcttgcttgatgacaaatggacgcccaagattgcagattttggcatggctcggctcttcccggaagatcaaacccatgtcaatacacgtgtggctggaaccaagtaagcctatgtttatattcttcttttttctcaaaaagttttcaatgaaattttgaatatacttacgcataaataattgcatgttgatccagaaaataaaacaaagcaaaataaaatagttctttattcgcgtacacactaagagtattattcttgttaatcattttcatgttttattttggataacaaaatcatttttccttaattttggtgacaagtgtatacttattaaggattacttagagtgtgagttcattagcaatatatattcgataatgtaaaattgaattttgttttggaataaatatatctctcttccatgtatcaagctttattcttgtaaatttacacattaatttacaatattttataagcaatattttatgtaaagttataaaatttcatgtaattttaaaaataatcaacattttattttatcgtaatataactatcatattatttgtctacaaatattttattgtatattaatatttaatatttaatatttaatatttaatatttaatatacattatcattaagaaagtttgatcggcataattgcataaaaattatattgccaaccctcttttatatatcaccatatggtttttgtttttactataataaatgtttcttaaataaaaggcttttttatttttatccttttaggcttttagcatcaacacatggcacatcatatatcaaatcaccaaattaaaaacttacgtgttagttacgactcatcttgcatctatatgattagtcaaatgttttgactagttaatactaatattcttttggttctcataaaaaagtaatactaatacttgggaattatacagtgggtatatggctccggaatacgtgatgcatggaaatctatcggtgaaggcagatgtatttagctatggagttttggtattggagttgatcaccggccaacgaaactcatcttttaatttggacgtggacgtggacgcgcagaatctgcttgatagggtaagagccattattgttatttttttgacttccttaactttattctgatacgagggtttaggtatagttgtttctttatcacccaaatatttatcgtattcttttacaaataaatgcgtctcattgacattccataagttttgaggactttttatttgatcaattgattaattagtagcaacttgtcattggacattgattgataacccttttcagtcttcacaaaaacaactctaataacctctacacccccaacctaacttcaccattacggcattacctcatacctacataatcaaactgcgtctagaattcccattaagaactcaaccttttgccttttggccccaaattataaaaaaataccgagcacaatttgatttttgccttaccgtattttgttttatcggcaaatgttagtttttttagacaaaaaggatcaaatccgtgacccttttcatttttcctttttctttaaccatatctcctgccttaccgtgttgatgttggttataggcatacaagatgtttaagaaagggaagagcttagaacttgtggattctgcattagcatctacgatggtagctgaagaagtagcaatgtgcgttcggctgggtttgttatgcactcaaggcgatcctcagctacgccctacgatgaggcgcgtggtggtgatgctgtcgaggaagccagggaacatggaagaacctacaagaccaggaataccaggttcaagatacagaagacctcggagacactccgcattgtcttccacattgggtacctctggtgcctttgattcacacgcttcagattctagtaataatgataatacaacggttactactagtgccacagggactagctcagctactgcagaaacagaccccaaagggaaacgtccaatgcgggagggttagctagcttagtctaagttcatcatatggtgttttttgcaatgaaagtatatatgtagcggtgtgaactaaatagaatgtaaatagattgaggctaggaatggcgatcgaggctcaagtgaattcttattctttaattaatattttacaagtgagaaattaatggtcacaaattatgtaatctctcattttccgatatgagtggatcaaacctgtaactttcgctttgacatggttggagatctaaccaattgaactacaatcccataaaaaatggtgcacagtttatatattgttacggtttctttcaaaccctttttttatatttattttggatttgaaccatttttgctgtaaatgaaagaggtctaaaatcaattatttcatacgggtagtggaagcagagtggcagtagcagtagtgtagatttgcttgaaatcgttgaagtattgggcttttgccagtgatatccaaaccttttcattggagggaaaatagatattataccaatatgatttaacataattgataaataattgggtttattaaacatgttcatgaagtttatggaaaaaactttattagaaagagataaaacgaaaatcaatgattagtctaatgacttttgattataaaatccatgacgatacttgctttcggggaaacaatattttttttttcctttctaaagaataaattaatactaaaataatgctaaagaaaatggtaaaaacatacattttagaaattttcttttaaaaaaaattttgcccgtaagttctttaagtgaaaaaaaaaagtagtaataaaaggtaaatagaataaactttcagctcaacaagaataaaataaaatagagaagtaaacagaaaaggggttaagcgaggaagactgtgtagaaactagaaaccctagagggagaaagagagagagagcaatgagaagaagtcttctgagaaatgctactctctacactcgcaaccttcttcataactccgcccctgtactcgccgcttcaactcgtccccaactcagactcttctgctccaatgaaacccccccaccggttccccaaatcgacgacgttaacaacaaaggtatatcaatctatctctttcttctcattctaacgacgtcgttttacaccttccattcaccattaccgttcaatttcccttggcagagctgaaagcgcagatcgagaggtacttcaagggcgacgagcaggtgctcccgtcgatcatggaggcgcttctgaagcggaagctgtcgggaaagcacgaggacaccgacgacgagctcatggaggagctccgcatgcgcccccttgacaacgttgacgaccgggacttcgaggacgacttcgaggactttcacgataccgacgaggagatcgacgatttgtacaacgccagggacgtggtgatgaagaggatggtgaaggacgagtacttcaacatggatgataaaaagtgggatgacattgttgaggacgggatcaagcacgggcttcttagggacaccaaggagtgcgaggagattctcgaggatatgctcagctgggacaaactcctccctggtacaccattctatatttttattacaaattaataccaaaactacactcattgattaggatatgcatctaagtttttgtctaaattgaagttggggaaaacttgatttttaattccattgcttgttgacatgtgataggattgggcctaggaaggcccaaataggtgacatttatagactagataatctagatatgatccttttagttttattttattttactagaaatattagatgatgccatttgtatggttgatatttcttgtaaaccccctgtttaacataggggatgtgctatgtaatagatcatcaatgaaagtatgagttattattttatcttctctcttagttttggtagaatgataggagtagtgatagaatagttatcttgtgcctatcaacatttcaaagttatttcactattactgataatcatgttgtgtagggaatggtaattaaaggttagaggagaatgtagggactagagtgtgtactattactatgtaagtatctttaattctgattactcgtgaagagtttttttttttttttttaaaataattnnnnnnnnnnnnnnttctaggctaatcagttctgttttaatgggttttatagacaacacgagatctttttgggttgtgcttgacatttattgcatactccagctgaaatttcatgatttgcattttagtgtagttgtcaattgcagctttagaagtggtttaagtgatgttgtgctaatttgctgatttggttatgtcttatgatagacgagataaaacagaaggtggaagtaaaatttaatgagctaggggacatgtgtgaaagaggtgaacttgaacctgaagaagcttatgaagagtttaagaagtttgaggatgagattgtggcagaatacttggacaaaatggaaaaggaggaggctccacagtttgatgatactactgtgccagataagaaaaaggacttggatgatccaccgggtgaaggtccaattctgcgctggcaaacccgggtagtctttgctcctggtggtgatgcttggcatccgaagaacaggaaagtgaaactgtctgttactgtgaaggagctagggctttcaaaataccaatttctccgtctcagagaattggttggaaaacgttatcatccagggagagacgagcttacaataactagtgagaggtaatgttctatcttcataaacattcattcatgtattattcaatcttatagcacctggatatgggcttttactggaagcagctacatttgtgtttgaaatgttcttttccatattttgaaggtttgaacatcgagaagaaaacagaaaggactgcttaaggacccttctctctctcattgaggaggcagggaaagctaataaactagtagatgatgctcgatcttcatacgtaaaagagaggcttcgtgccaatccagctttcatggaaaggctgcatgccaagtcaatgaggttgcaagaatctaatcaggttcctgcttgaggttttcggatctgatgtttgaatttttgaacattcacctgccataattttttattgctccctgcttttttgtatctgagtcttatcatgggtcccagttgcagaaacaacctccctgcttagagggtaaggccgcagacatctgatccttcctagaccccacaactgcaggggagactcatgcaccggggtacctcttagtcatatctttcgtatttagtgcttgaataatggataatttttttttacctcttgttagatattgtatgctagttgactcaaatgttacatttttgtggagtaacattgatcatagaaaaggctggatgacctccaactgaagcaagggatttcaatattttatattataaccacagtttaccaatcaattctatcgtgcttttccacaaaaaagagagaatagccacctcactctgtaacatgcagaattatgagtaatatgattaataaacaatctctatttctctgctactccagcccatacattgtctaagtaatcaataacatgtcatccgtcttaaatttagggtgcttatttcattttaaaaacatacttatactgttgggacataaagctagaggaaaagtagttagggatagttagagagggaagggtcagttagttaagaggagtgctatccttcggaaggaatagccgaaaattcctcaaacaaattttttagtcccacctgtcaattcaaaatagttataaaatactcccttgggtctcaattataagaacaaaaaacttatttacattaaaaaagttaatcatatgtaattgtattaatctcaattagaaactaaattttttctcaacttatctttcattagaacttgattttaggaataaaagagtcattggaactaaaatttcaattaagtgatagatattttaatgatagtagcataaatgaaatgaaataaaattagttgaaattttcttatatttgaaataaagaaaaatgtgtttttttcttatatatgatattagagggagtattagttaattttaattttccaaagtttttcctttttttccaaactctgcagtccgttatctcagttgaattaaatcccgattcccaaatgcattccctcattttcagagtgaatttactttccagcgactccataaaaaatcttctcctaaccatttttcctcaccattgttccaattagttcaactccactctttaccaacggaattctgtgcacctttaaaataattcagtttggtttgtacaaactgttttgcagttcaattcaagtgaaccacatttgcagttggaacaattcacgacaatttagttcagttcgaacaaccacaacttgattacttgaagctattagcaatcaccatcactatcttcactggtgtacttcatgatacaagaaaataagatctggtaggttgcaagctaaaggactatggcacatgtttctataaaaaattgggcagtaagttgacaaaaatacgaaaatagcaaaaataaggtcacatatgcaatgttacattgacaacatacagggagcagtagccacatagataagttttaaaaaattccgatatattgttgtccaaaataaatcattagtacatcaaaaatcaaaattcaaaaccgaatgattatatacaacgaccaataattttaaaaaaataaattgaagtgtgcttggtaagggtgaaaaatgaaggaatgaagaggaagtgaccatttgacttgacattagacaaagcacacatctagatatatcacatctgcactcctttagttccattctatttatccaattttcacttctaccaaggaatcctatgaaaatattgatcataagcactacatcaaacataatataaggactctcaaatactgtgttcaattgccctataccccacaaacattttattcactcttccagcagatagcccgatttttgttttcttcaacccaatcatatccaaatacaaatcaaaacaagagattctgcacaactgcggcataccaattgcagaaacactcttttgtgactctccaaccactaaacacttcagtcatcaattaatgattagtgctactgaatactttcgactgaagctgtcaaaatccaatgcgtggatggttgtattaactttaattatagggccattatggacttggggaggctacaactgattcagtactttcattataaagcaataactattcactttattggccaatgcgtggatggttgtattacctttctagataaagatgaatgaaggttgggttgaaggtagtagtactattagagtaaagaaattatataaagggagtattaattaaaagtaaaaggaaattacatactactattatcttgaggtttatttgtgactttaaacttatttaaaaattaccctccactccatttatatcaacttaataataattttttaacatatgctaataaaatcctctatttaaccaaggttaataaattaattagcattcaaaaaagtgttaaatgttttacaccacatattttttaaaacttattaaaattttctaaaacaaataagctgatgataattttcaatttcccccctcgtattaatattttaaaagcttaaattatgtaatatataaaacaattaagcaataacctcatttcttagttaaaaaaactaaattaaaccatataatccactataataccgggtacaaatttaactactcatgtctaaaagaaaaaaaaaataaaaggagcaaaactaagattcaaatgtcatatttatacaggaaacaaaaagctaagtataagaactcaaaactttattttacaaaattgattttgaatgaaattaattttaaaataaaataacttatattgtgatgttttattttttaagtatgctaatagtaaaactttacatgaaatttttaatccaatacagaaattacctaaatttatttcaatttgaaattaattttttactcaaaattaattcctcaatatatggaagactaacacgtaaatgtttacttaaaatattattttatcgtgattttagaagatgaaacgtgaatcgctacatctactgaacaaggaagataatgtcaaaattacgaagaagtgtgctatgctttagggacaatggctcactgtgtccttttggcattgcaaagagccacaactgtggaagtattaatattataattcatttctattaactgcttaatcaaaagtcattgtcatcaatgctggcgaacgagaatcgttgctgtgttggtgtggggttattaattaaacaattataatgatggcctatctagacaaaaataatatacttaaaagttggtgtatttaaatacaatacatgtaacttttaatttttaattattaattagtattcttatgcattgattattaaggaactatttttttttaaatcatagaatgtcataaaaaaaagtcaatgaataaaataattttacattttttaatattttttctctttttacttatattttttttatttttaattaattatttgagcttagttaaagtgatacgtgtaacgactacatatttaatatctagaattagtctagtcatctagcattaagtggacaaattctaggttggtaagactataataacgagtctctcaaaaaagactatagtaatgaagaaacccataantatatatatatatatatatataaacttaacataatcaggctgtatctaattcattttacatttttaaacataatactttttttggatagaaaacagaataattttaaaaattagacttgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtacttatatttagtaattaaaagtaacatttccctaaagtacataaactttttcacgtggccacttcccttaaatttgtttccgtttaatatgaaagaataaaatacactgtggtgtcagattttttgtcttctattcatagtagtacctactacattatctaaaatcttataatataaatgatagtgcaatacgttgaatgaggatcttaaatttaaaatttaatctttattatatctcttaataaagagttgaagagatttttaacataaaagatgagttattataaaaaaaaattttaagatatacatattatttaaaaaataataaattttctttttatttctttgtccataagatctcaaaataagatctaccattaaagaaaaaaattgaaagagatcttaacagatctttaatcctatgtgacggtctactaaaaagtaatctaagatttcaatttaacaccattaaagatattctaagtacctaaatgattcctaagagttgaatttctaaattaattctgtttacgtcattattttaatttgataaaactaaacatggtacaataattttttatactttaaagcacaaattattagaaaaacaatcttaaaaacaatgagcataaagaattggtgatgttaggaagaaacgacaacaacatagcaggtaagaatcaccttggttagaattaattattgaaattctcagcattagcatcaaagaattataaattgcagctaacattaacatagacttgttcagaacaacccaatcatatgctgccagtcttaggatccaacatgtctcaaacactaagctgcagaacactacacccattggactcaactttgatgaagtcaatgtcccacaatccaaaaaagtccaattccaccgcattcacaaggcactttgccaaaaaatctgttgttttggtcaagatcatggcttctgctacacctacagcaactcctatcacctttggattcaagaatttgttggatacattcactgttgatgtgcatagagcagagaacaggccactgaatgtgcccctaatagccccttttaccattgctacctctagattggacaaggtggagaacgtggccataagggttgagttgagcaatggtgctgtggggtggggtgaggcaccaattttgccgtttgttactgcagaggaccaaaccatagccatggccaaggcttctgaggcatgtgccttcttgaggagatgtcctgcactcactttgggttccatgttgggggagattgctggtattcttccagggcatcaatttgcttcagtgagtgagatttttattttttttagttcatgttttaccagtgcatgtgttgttgttaatcattctaatcctctaatgcttctcttcaacttttgaacctgacatgttcattttagttcatgttttactagtacttgtgttgttgttaatcattctaatcctctaatgcttctcctacttcttgtgcttttgaaactgacatggtctttttgaccctgttactatgcaaattccttgaattttgaatagcagctttagttttctgcttggtaactaacgacataaaaagagttacaaatttggaggaagtttcaatatttcaatctaggatagtatttaatttgtaatatttactgttttgagttttttcctttgtgtaacttttagtttggttctttaatttgcttaattttaagagaatattttgttatatcctcgttttcttaaaagttgctacctttttctgttctggaatcaatattttaagataattcaagagaaagaagggaaaaagagtcttttcttaatcctctctttgtaatgatcatactctccactcagattgatgccttttctttttctttttaccaaaaaagaaagataaagcataatcttactgtaaagagaggaaagggggaaaaagaataagggtacagattttaaatctttctatcactgcgaggattttttttatatcggtaaatattagttgtcggctgtcagtttttgttatcggcaaatgatttgggttcatctgctagaatgagtaataatgacagcctgaaataaatgaggtcttgaatgtgagtaagccattctagagtattatatgtggagttgaaagcgaggggcttgtgtaggtaaactgatacttcatctaatggtttaaacattgagggttagttgaatactggcattaaatgcatgcactgagttcttgtacatcggatctgccaatacagtcctttgaaaggactcctttctgagctaatagaattttcaagatatgagtagatcctttattctaatggctttgcaaatctagaagcacaaacatataagtagatcctttattattataatgcaaaaggtggggtaagggcacaagtggcagaatatttgaagcaaatggagactgatatggacactgatacacaattgcagaccttgttcatgttttttctttctaattatctccttcacactacccttcaatttttataaaactatattaattgacatcaataactatttgccattttccctacatagcattcaacctcttttccccatctttatcttattttaagaaattagttgttactttttgatggagaagcaacctgagattttacagtggataatggcttctgaagttgaaaaggtttcatcagaaattcatgttaatttatgtactattttattactcttgaagaaacaactggctaatgtatgaataaggttgtgaaacatagcacatacttttttatcttttgacttcgtaggatttcttaatagatgtggcagtaaaacttttccattctcatggggtctcctctgtgtaattgaaggttagggccgggatggagatggcaataattgatgctgttgcaaatagtattcgtgtgccactgtggaggctttttggtggggcttcaaataccataaccactgatattacagttaagttcttactaaatctcaaagaaaatgcttataatgaaaattattttacaaaaatacgagaaaaaaactatctgctagaaagaaatctaagccagcttatatgtgcagatcccaattgtttctccagctgaagcagctgaattggcttctaagtactataaagaaggatttaagactttaaagctgaaagtgggcaagaatctgaatgcagatatagaagtgcttcaagctatacgtgttgcacaccctgagtgtcagtttattcttgatgctaatgaggggtataactctgaggaagcagtggaagttcttgagaaactacatggttaaaagctctacatatatagttaaagtttttctccatccaattaattgtcattgtcttgcaatgcaagaaaatgtacacacacatgcacaaaattgctcatgaaactttattgcagtaatttacacaatctggccatgaacatagatttgttttctattacagatatggggttaactcctgttctatttgagcaaccagttcatagagatgattgggatggtcttcggtatgttggtaatatagcaagagagagatatggagtatctgttgcagctgatgagagttgcagaagtataattgatgtttacaaaattgtggaagggaatgttttagatgttattaacattaagcttgccaaagttggggttatgggtgcccttgaaattattgaaaaggcaaaagcagcaggattagatttgatgattggtggtatggttgagactagacttgctatgggttttgctggccaacttgctgctggccttggctgttttaagtaagaaacatcttatgtttgaaaattttgggccagttgccagtttttataacttcatattgttcaccttctaatttactaatgaatttaattattgcaaacttttttgtaggttcattgacttagacacaccacttctgctgtcagatgatccagttcttgaaggctatgaaggtacactgtgcctatatccatatcaatttcaggttttcatataaatattggtttggttgatgtctctgcaatctaatgacactagggtatttctcttgaacagtttcaggtgccacttataagttcacaaacgctaggggacatggtggatttcttcactgggacaaccttgcttaggaagttgtaattttcttgcacaatatgattccagataatccagcaaagttgctagtatatgctaggtgatttctggtgtaagattcattggataaccaatgattcacaccttaaaaggaaactgttcaagccttattcttggttggaaagcaagatacttgttgaagatataaaaccaatctttcaaccgtgcacctaataacaataacttcaaggataactgaatcttttctagccctatccttcaaattcaattgaatttcaaggcaatatagggtgagactgtgctatatatccacctttcaagcacaaaagggttcttgaatgacaaggcatgttagagacataaaaccaacttttgtctgcgcaagttctagaatttgtaaagccaaaatttcctactaatcacctttaatctcaatgctcttggcgagaatggagaaaaatatgttttacaattttatttttatttttatttttattttggacattggtgaaatacgtaaaaaaggttctatatataccgaggaatcaaatttaatatatgtttgtcaccctattacatgtaatgactttttgtatgtatgctatcttcattattgacatctttattaaattatttgcagatgttagagatgtttatgacaacacaagaatctggaaaagcataaatggacaagttggttaaaaaattgcctaattaaggtgtgaaactgtggttacaataacaaccatacgtgaagatttcttgtccggaatgagtagccattacctatccacaattgctatgtatttaactttttcgattcctcaccatatattctgtaaaagaaactgccttcgaggtcttgaaccaaatagtaaccagttgctacttgctaaaagctaggaaccgcatatgatatgagatatggatataatatgatatggacattgaaatatagcaaaaaaaaaattaaaataggcttaattattgaacttttggtttctacaatttaagctgtgtgcgattttgatcgtacgattttttgtttcagctaattaagttattctattttgaaaattaagcaaattcagtttcctcgtccattttgtttcacttaaaactctcagatattattacttatgtaactattaacaggcggatgatggaattgaggtatggaatgattctaaatgtttagaaataagaaacttagttgaagataaaatttgagaaggggtttataagatgtgaaattaaggaaagaaggaaaatattgtgaacctttattttagatgaaatttgatggtcaagatttttagttgacgagttctctgaattcgatatgcaaacattctgaatagaaaataagaatttgagggtcttagatataagaaaatcaacgggagaccaaatttgctaaattttaaaaataggttgacttaactgagttaaaaaaaaacttaaagagattaacttcgtgataaataaattatgaagttattgaaatttaatcattcaataattaataggaaaggaataaaatagagtggaatgcaatgcaatatataggtcactccattgtgtagatatattatgatgaaatgaaaacttattttgattccatcccataacctccaaattgggaggagatataaattaaaattttggatagaatggaacgaaatccattccattttattttaatttaacaaaatcaaataataaaatatattaaaattttattttatcccacttcattcaatcatcttttactaattcaaacatagccttcataacacgtttggtttcaagttttgaaagtcccaaactacaatttgagcaaaagtttgtttcttgtatggtccaaaaccttggtttgagaatttcaaactattggttgcaccgagttacatatcataaacctcactgcattaaattcggcttccctaaagctctacttttatgcttgaaatattgcacaattctactacatggaagcaaattcggtgtggcgagcggcatgctatgtaactctttgtgtggccaattgatcatttatgattccaaatactccagtgttgcaaggaatccgaaaaataattttcacactgtttctcaacacaagtggtttagatttatcaatgtgcgaaaagtcgaaaactacatgattgataccatacgttctctacaaagtattccaccatcatcgagctaattatgaacatctctaatagtataagaacatgtttaaacatcgtaagagtgtaaaacttattttaaaacagcaaaatattgaacacttacactacatcagatatagtaccaaaattgggccacgcaacaccgcaaagtctcagtaattcacccattttcttctaaatcacaacatctgtaaatattttatctctagaaattaacgtgatctcaaccattactgaactgaaaatgctcgtacagtctggcttaatccctacatatccttcctgtgaacttgtttgtcatactccactctggtttttatacttagtttctctctcatttcattaggaccctccagttacctgatagtttttcctcccatataaaactttttttttttcttttctttttcactgtagcaatctctatgaattcattgcttcatattggcttcatctttttgtgctgcttaggcatatcacaagaatccacaattaggcagtcatcacgtcatcacaatctctacagatggatggacttttaccaagtttgcaccaagcaatgaactcagaaattaaggctcagttttagccaaaagcaggaaagacatgtcggcttatgcagttcatctatggtatgtgccatgtgatttaaagaactgaaaatccgggtgattaacctgaactagccttaaccagttatcagcagcctgcaagagggaactcacttgttgagattcactaactccttttttcatccaaatagacccctttaacttataggaagccattgcaaaagtaggtatagaaatctttggtacaccatccatctcactgggataaaccagtgttggagcatgagtaggaccacttcctgcaaaatgtaaccaaaagaaatgttttgaaaataagtcagtattgcatcatagtgatcaaacaattacatttcacgtttttttgaagaaagcattattttcacatattagctgagataacatcaaccagcaagttgagtaatgcaccataagattaagaatcagtttctatttttccatatttgtcaattttaaattgagtgtaatagctgtaattgagaaaagattaagaaataagacaacaaacgatactaaaattctatttggttttattctaggcaggttgataatggaagcataatgattgccacaacgattgatggaaaatatagatgaaaaaaaaaaacttctatatgtacaagtgggtcacagtaagtcagaacacaaggtcaacttgttgtgacttactgactcttggatgtgcttactgtgcatgtccaagagttgaggcaacaatgcttttgttttaaagataatatagtcctaattggagagtcaatagataaatttggaaacacatggtaagtaagaagtatgtggaatgtaactatgtaagtttagcaacagatgcataaaccctagctcaaaggtgaaaatgggagaccatactgtatcacaaatcacacatgtatcttgagttcatcatgcaaaaatgacagaaaaaaaaaaaaaaaaaaagnatcacaaatcacacgtatcttgagctcatcatgcaaaaatgacagaaaaaaaaggtgatgtaaaccataggattctaggtagggtggatgaaataaagtgtctctagtgttatgcatgactaaaaggtaccattcaagctaaagtgaaaattttactgtgcaggtataagacctgtaatgtagtatggaatcgagtgttgggtaataataaactgacgagaataaactccacttaacatagatgagaatgttgcagtgggtgagtggacatactaggccaaaaaagaatgggaatgaatgcattagagaggaagttggggcagtaacaattgtgtagagaaacccagaagaatttaatttcaccttaagtgattttggcatgtatggagaagatttgtagaagcccactaagaataatagaacagatggagggtagccatattgctagaggtagaaagagattataaaaaatataggtgaaaccattaaaaaaaggatttagaggtcaatagtttatctagagaaatatttacaataaagcattatgacatcatttgatccatgtagctgactccttagtgggaaaaaggcttggtggtggtcattttcaaattgcaaaatgatttcccatggtgtcttctatcaaatcatccatcattaaaagatcaaaaaaagatgcagtcagttgcagatttgcagtcattctgttcttagctgcacagttgagaaaatgatgcagccagtttccacagaagtttggcatatggtaccacttgtgcaggtgtgagaaatgtaattgtaagtatgtgtatctagaagttgtgagacagagaaatgagagtaatgaagccctaatttaggtgataatattttgcattattgagagactaaattctattaaagaagagtagaataaatgaatgtcactttgcattgttgcaggataacacttgtaacttaggaggacaaaagtagggatttactcaaaaggaaataatctcaaaatgcacaggatgtttaatatagcaatacggagccaaaatcagtgctgtataagcaagtctaataagatgacattgacgatcaaacataggcttgaagttccataattacctgtcaagggtgtatggagtgtatggtatgttagaaagcatccatctaaatcttttaaagttgaacctgtgggtattcgatatataggatacctagaacatgacattaaaatatgttaacagaaaaaaaaagtattaaaacattagattaagtcaaagtctattcaaaacaggagagggggggcggggggtgtggagaagtgacacattagattaccatgccacagacacccaactgactggtaataaatcacagcttctcaacaacttgagggcaggatagtggcgtgcaagatcttgtatctgtcagaatattataagtataagatggacagatcagattatgggtaaataagtcacacattaactaaggatcagtaattgccttgtcagccaagggttcacgactatacggaggatcttgttcaaaatactcaaaaagtagatcttgaggattcccagtttcactatcatcactagaaaatccttcttgcacagtactgtgtttatcatgtatagatagtgtgttcatttgcagtgagacaccacctgttagatactgactacttctttgagtcataaattcattcctttttccatattcataatcactacttccttcactgcatgaatctctgtagtaatcaccatcactatcttcactggtgtacctaatgacataagaaaatcatctgattggtttcaagctaacaaaacaatagcccacatttgtaagttataattacatagaagtaggacagtaagttaataaattacaaaaatagcaaagtaaatttacatatttaaaattacatattacattgactacatacaaaaagcagtagccagagagcgagagagagtataaataaaaaaaatactaaaaatatatccaatatattgagatcaaaatgaaaagttaatccatcaaaagtcaaaaccaattgatattatacaagaaccaaattgaaaaaataaatttacatttttaaattttgaagtgtgcttgtgaaaaatggaaggaatgaagaggaggaagtgagatttgattagatatcagacaaagcacacatctagatatatcactcattcgcactcttctagttctatttatcctgttttcacttctaccaagctcaatacaaaagagatccctgaggcaatacaaggaatcacatcaaatattgatcagataaacaccatatcataaataagaggactccccacagtctcaaatattgtgtttccaattagcctacacccctcacaacattttattctctcttccagctgacagcctgtttttttcaaccaatcatgtctaaacaattaaaatacaaatcaaaacatgagatactgcacaatttctgcataccaattacaaaaacaatcttttgtgactctccaaccacttaacatgttaactcatcaattaatgattagtgctactgaatactgtcacctgaaaccaccaaatctaattcaaaaggcaacttgctaacattataacttatataacccaacaaaaatgctgcaaatatatatgactccaattacaaacaaaaccctgcctttcattaacagcttggacatcaaataattcactcaaaagaagtgaaacaaacactagaagcacataaaatgtaagcaaaagatggtccttatgagtcataacttgaaaatttgcacatataatgtgcaggatcgatgactattaaacaaattgctacatgcacaacgcccagtaccttggcaattttgtccaaattctaacaaaatagtctaaattctaaaagtaaaagcatgatgacatcactttgtgaaagtgtaacttcaacaaaatcagtgctttaaagcaccatttcatacacttcccctcaaaagtggttttaagtagaattatatgttttttctataagtaaattcctaaaactaaatgattttatgccttcaatataaagtttgataaccatgttccatacactaaaccctcaaggaaaatctagagtaatgaaaaaaaaaagttactcattactctttactggaagggaaaagagggaagatcaaattggtgcttaaatttgttccaaaattcattggaagtgaaatttaggaaacagaacaaattgaaatgactataatttataaaagggcgatgcaacattatcattgtatcaaggatcaccctcaataaaaccaaatggttataaactattagatttaaacattttctttacaaaatcccaaacaacaacttttattaaaaggaatagttgctattgacattcctcttgagggtaaagaaattttgattgaaaacagtcaaaaccagctaatcttctattaatacagataacaatatcatctttctggtttccaccattctgaactcctgcagtttctatatctatgagaagcattttacaaagactaaaaaccacacttgtatttctaattcatttacttctcaaccttttcctgttgcctttcaaccagaacccagaaagcatattcaataccacatataatccatttaaccaatataccctatacgcagatgggctgaagaggcttaaccgtggggagatataagcgttatccacaggaatgaacagcttcgtagatctgtggatttcacccctacacacaaaattccactctcctctgtctcactcaagtgattttttagcttcccttgttggataagttgattttgattcagaatcaaaagaaagttatgaaagcaactgaataaatgttgcatcaccattaatttgcttcctggatatgcacactcagcatttacactccatatggaagaggccatttgacatcttggaggcaagatcaatcttactcttgatttagttcagccacgtgaaccatacagtactcaggaagcaacaaattgttgagagaattattatagaaagcttctgcaaatttttagagccaaatcacgaacttaaaaagaaaatagtaaaactgaatatattttcaaattttcattttctgaaaatagaaaaacagaaagttaaaaccaaacaaattttctaaatcttaaaactttgaaagtgaaaataagaaatgaaaatagaaaacattttctcaaaccaaacgtccccttagccactgtataagagtaaaaagattaacacctggtatatcaattgattaaacacattttttttatcagcaaatgttagttgttagttgttagcgagactaaaagagctgcatccatcgacaattctaacatgtttccagtgattagtattgtcttaaagttaccaaaattcttattaagcacatgaaatggcaataccttggctttgcacttgacttctcagcagagtgaccatagagttgaatagctgacaaatacggaacataatactgaacaacagaatcactttgatcaagcaccaaaggtactccagctccgtacgcactccactccttaaaagactcccacagatcactcagtgcaaagtaagactgatactccacatcgcaaaacttccatcctctcatcgttgtctacaatcacaacaacaacaattccgataatataactaacaaagtataaaaaatttgcaacaataactgtttcaacatttcaaaagcaaaatcaaattgcaaagaaaaaaataaattaaaaatatgaattcagaattcaagatcaaccttggagaaatactgagccggaactgatggtgttgtggactccaagaacctatcgatgttactgacagactctacggacggagaaagagttggtttcagagattggctgagattgctatcgctattgctgttgttatcctcagagacatcgactttgctcttagaagctaaatccgcattttcaggttcgttgttcttggctctgtcactctgtttgcgctgattctggctctttcgaaccttcaccggaatataaaaccgatcctcgccgcgaacgccgccgaattgcagtgcagttcccagcattttccaatcgttttcagaactgcgttctcctcctcctcctccgttccgtcgccaagaaaacggaggaaatgagaaaaatcgtaatcgctgagaggatcaataaaaaaaaggaagaagagaatcagaatcggtgatagaagacgaagaaaagaaaacgaggttgaagacaaagggaagaagacaaggcagaggaagaagaaaagcttcaacactcttctttaccacgaaacagacagagtgtgcatagaaggtttggtggagattctgtcattttccgtttgcttggggtgtttaactgattctgtgaagttttggggttatttgttgaatttgttggactttccctcaagagagtgaaagaaagaccgaaagagtcttcgttattatcacttaaattaaatgtcgataaataaataaataaataaaaattacgcgaactttcgacacggatgagatcggcccactcgtgatatgccttacattgactcgtgtttttttggctttatcattgaaaggggtatttttattattattatcattagacaggtgaattttaaatttttaatctaacatatgttattacttatgtattttttaattttaaaaattgaagttatcaatttttttacaacattaatataattttttttaacatacaattttaaaattgtaaatttgtttttgattttgaagtcatgatattgttttttttatgttaatttttttctttcttaattttttttatgttttgtttttaactttttttatgtgacatttctttaaatgatatttgttaaaaaaattataaataattttttaatctaattatttaataaataacagtagaaaaatataaaatatatattaaaaattagatatatcaaaattaaaaaatataaaaataatataaaaatttagaaaatatattaaataaagtaatattaaaaatatagacagtataaaataaaaacatacaaaaaaaaatatacaaaatactaaatcaaactaaaaaataaagaaaattatataaacatttttcaattatgttttagtcatcgagataaaatatcatttaatattattaattattgtttttatctaattctcaaatgcttttagatcaatcttcatcatgatcttcattatttttttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcattatttttttaaaatcatataaaaattaaaaaatatatatattaaataaaataatattagaaaatatacaaaatgttaaataaaaatatacaaaatattttcttaattattttagtttcatttaatatttggatatacttttgatatgtttttatttaatatttaaatatttttaatattattttatttaatatattttctagattttatatatttttatttaatatttttattttttaatatattattttatttaatatattttctatattttttaccattatttattnnnnnnnnnnnnnnnnntgtcatattttttgcatatttagactaaatttatatttttaatcttttaaagattaacttatcatcacattatatttttaaggacgaacttaattatttatccactaactaatatcataattagtacaagaattaaagttaaaaatttattaaaagtgtttgtcgtattcacataataattatttactatttatctatcaaaataatttaaatattaaattaaaaatagattatatttttcttaattgatatatttaatacacttaaccatatgattaaacataaatcattaatatattaaaattaaggttaaataattcatatattacttaaatttattctttattaaaaataattcttaattagattttatttatttattagtcaaattttgaattaaacggatctttttctggaaaagttaagataaaaaaatctttaaaacacttatattcgagcaaaaatgaaaaagacacttactaatataagataagaatgaaatagatgacataatcgaggagcttactagttaagactcataagtcataattcaatagttaggtaaatttaaatgtgagatacaatcaatattttttttttatctttgtacgtcgagttaaattttatttgcatcttttaattttatttaattcgttttaaccctctaaattattttttcattttcgtatttttctgtcttccaacttaatggatacatcttataagaaatctacatggctatagtatgcttaatttaatcacagttggcaataacactccacgcaaagtgtttccgttttggttacctttagccgccactaataagatacccattgtttgaaaaaccaatcccaccaaaatattattttaaataaataaaaaatatttttattttaaaaaaataaatctttaaagtcattatttaagaatgtggcatatggtgagctggtagctccaaacacattgaattgaatattgagtaagacttggtctgtgttgcagctgcatcaggggaatgaccttgctgtgtggaccattgagtttaatatatatggatcattcaatctgaactctgaagcaaatggttcaaattttcttttatattcgtctgcaattaaaacaactcattcaatataaaacaatgaattgaagtgaaaaccctcttatgatactgttttaaatttaacatttctagcttattatagtccagtcatagctttctctacagcatcattatgccatagtcaaatgtcattttaaatcttttaaatattctagtatattactaaatgtatggattaattagtatggtattattttaattaacttatccaataattttaattagttttaaatatgtaattatattaaataatttaaaaaacatacatactcaacaaaaatagaatgaggttcttttataaaatgtaaacttttgcgatattggagttttttcatctcgtgatcttatgaacatgtttttattttggtcaaattttgaaagtttaattctctttttcgctaagcagttcattcatttaatggccttagaaaatatattaattaatttttgttaagataattttgtgtaaataatcaaattcgtatttaaaaatatgacgtagtaaagaaattagtctataaaagatgaaaatataaatttagtatatgaatttacaaaaaaaatatgataaattagtcatgtgactaaatttgtaaaattattttattattaagttgtaatgtttaaaaatcaatttaataataaattgtatttttttaataccaatttaacattaaattacaaagtttagagactaatttgtttataaaactaatttgtcatactttttttatattcaatatctaaaattgaattcttcatctttcaaaatcaatttgatagagcatcacactttcatatagatgaatttagctaattatcctctaattataataatattattactatttaatcatattttattgtattactaccgctttgaaaaaatgttgactatgacagtaaaatgaatcaaaattaatttttgctgcattatttctgctcccttttctttgggttagaaaaaggaaaccatcatctacgtacgggacgatttgcttcccgacagcaacacaaaggaaagtaacaacaacgacggcaaacagtgatacctataccaaccaccatttctttgactacaacaaccccccaaaatatgtcgagaaattaatggccacttaattaaggattaaatgtagttgagactccgatagaaatcatagaagtagtatttgtttttatatttatatttttttaaaaatctttttcaagtttttatccacatagatacaattttttttaaaaaaaagttgtttctaatttccaaattttactgttcaattttacattttataactacaagcaccttaatttattactcgcgttttaacttttaattgaattaactatgttttcttctttcactgtcctttcttttttgaaaaagagataaataaataatattttgatgataaactaacttggaaaattacttcctttgcactcagtatataagaaaaacaactaattttattttaattttaaaaaattaattaacatcatttaattttactaatattaagtaaaaaataaaattatttctaagatgtctttcatttaaacttaatatcatgaataaaaaaaatcattgataatagaattagagttaaatcaaggatgttttagaatgataacacaaaattagtaaaatttatttatatttaagtctaacatacaacattactttttatttatatatgagtctagagagaatattattgaatatgtgaatcaaatgacctaaggtattttatttaaacattaagtatgtaattggattaaataatgagaataagaattttgtcactcacaataatcctatattattcaagtagattacttcaaatagaaaaatattagtggtttataccataaacacaaactaggaaagctaatttttttaactaaaagtgtaaagtctaacacaatccaaaaatacccaaagtaatggtgacagtctatttagaagctgtttaaaagcttattttgtgaattcacaaaaataaagaagcttattttgtgataagaattataaatatattggaggaagagtatttcagactgatattttggttatttttcaatcaaattggtctgtctgatctaattttaataattataacttgtttatattaagttatttaaaaatatcttaacaaatttgatcaacttcaacttcattaaatttaataaaccagaatttcatttgacgttgaatctaacctaatttgtcctttgacaactcctaattgttttctcataaaagatatcttttttattatttactgccataaaagatatcttaaaactggatagcagaagttattttaggtttctaaattatcatcaacgactaattttgacatttagtacttatcagaaaacaattgtgtatttgtgttatttgactacaaccccaccaaacatattgtatgattaatgtttcaattttgatgaagaaaaatgcacccatgccatgtctccatcaggattgatgccatataatgggtggcaaagaagagcatgtataatggcccacactggcttgaattgaggtcgagcctttgcatccgtctatgtttcatcacaaaagctgaagaagataggacaatgatgtgatagggtacaagggggaaaaacagggataggagatagattacctattgacattaacatacacaaattatcattttcaatattcaataaaagggtcccttaggcttttggggttagtatggtgtgtccatgtcaaggtaaagctataatgacaacatttacaatttacctatgggctcctccatgtagcatattctgaattcattttgaagatattccacagcaaggaagcttctcaatgtttgaaactcaaaaaatatgggtgactttaggattataacaaaaaatgtttattatattaaaataaaagtataataaataaaaaaaatattttatattcatttgtctaaaatcacgctgatgttcataaaactcaaaaatatatattgcaaagtaaatgagggatattaattcaactattagaaatgaattgatgtaaaaaagttagatttaatttttctattattttttcattatccaaaatattattaaaagcttgaataagtgcagtttttttcttactaatttttaaggaaaaaattccaagaactacaagggaaccttgacttgggaatttttgagtcttgtagatgtgtgcgtgtagctggcgtggatcgtgcagaaattgacttaagagctaagaattaaagccatgaaggacatagataatgataagagaaacaactgattgattaaacccaaatggttaatatactaaaattaagattgaatggtttaagtattacttgagtttaatctttgatgaaaataactttggatcatactttacttatctcccaactagactctgaaatagttagggtctcttctccctatatgaagatgacttgctaataacataagaatttatttataaatttcaaaacttgtaaatttcatttcttatttattcaagttaacttatgtgtttggagattattgtttttttcactgtagtagtactttctaatttaagctattaataattgatccattggagaagtatccgctagcagcccaagaagttaaaaactccaggtcttgctatttacactacaattttcgaagtgcacccccatactttccttttctatttctcaattacccattatatccttttttccaaagaagtacactccttttacttttcagaaatgtatttccgaaattacatgtaactattccaaaaatgtatctccaaaactatgattcatagtttcaaagatatacttctgaaatagatatatatttttcaataaaatatcacttaagaattaagatagttgatgagaaataaaaaaatgataaacattgatcttatattcatgtttgttaatcttattttcactctatcattagtgttttttgaatctatttaaaatcttatttttattttatctttattattctttaaaccctaattttaaactatcttcaccatatattgttatataataccacatttttatcattattatacaatattttatatttttcttcatgtgacactacatttcagtatacgttcatcactaacttcatatatcatacaccttaattacaaagcaaagcttttgacggtggtttctttcctttaggtgcattcattcattttctaatccaagtctacgtcaacgattcagcatcacatgaagttagtgatgaatgtatcttgaaacacattatcacatgaaggaaaacacaaaatattgtataacaatatgaaaaatcagtattatataataaatatatggtgaagatagtttaaagttagggtaaataagattttagatatgatttaaagaaaattaataatatgatgaaaataagactaacaaatataagtataagataaacgtttatcatctttttttatttctcgtcaaccatcttaatttttaattgatattttattgaaaaatatatacctattctagaagtatatattccaaattatgaattataattctggagatacatttttagaatatatatatatatatatatataatttcatgaatatattttcagaaagtaaaaatggtgtacttctttaagaaaaaggatataatgcgtaatttagatgtcaaaagggggtatgggtgtgtacttaggaaaaatgaggtgtaaatattaatttccaaactctattaatacttcccagagtccgaagtatttacattggtcagtttcaactttcaagcctgttgttgattgggccgaatctctattgtaaaaaaaatctaactgccaaaatcattggttccacatttattatccaaaataattttcaatgagacaaaggagggcattcctattcacacctccaaatgatgaaaatactactaacacactcccatatcatacagaaaacaaatttccctgtgtatctaccaagagacagtgaaaacttgtttcattgaccacattgactaaaaattaaaattaaaattattgaaaatgttagaaatgattcctagtagaaaagatttacagtttggaaaatgaaaaaaaatgctatattgcagaaacaaaaatcatatttaaactaaattaaattcattgagtaaagtcatctttgcacgcaaagatatataaataaataaaactaaggggaaaaattcacgtgtagaaaattttctacttgtggtgaatgcttccaagttgtaacctttactctaaagtgtatccttgatttgtaatctggcaattggcatgttgaatttgattcgtccttaattagttaaccttttacctgtccatttgcttagtaggaatttaaaatggtttatacatttgactttgtcaaaccaatacatgcatccacgaatcatatatcatatatcatctatatattatattggtcagatcaacatcatcattagaaacaccagcgtaattcaatcctctaatcttcaaagaaatgtgtagtgaaggttcagatacagctttgaaatatttgcatatctgttgaaatatgtgaatttcggtgtgtacatacacaacaaaacaaaacagaaatatataatcaaacttctaattaattaagctttggaagtggccagggttgaaggttcataacgaagaccaggattggaacaagaaacggagcttgtcaaattcagctagccgctattgaaaaaaatgaaaaagtcaaacgataaagtgaatattaaaaaagaaccaggtcatgtacaacaatcactcatattgtatacctacccttgtttcatttgaatcatttctcatcttgtgcttcttctatggctaatttgcttatggataatgataataatgttcatatgaggttcttattccttatatcaatattcttcttcttaacagcatccattagtgctgaagataacaacaccaaacatggagtgtagcaagccatacaactgcggacaaatttccatattctactctttctggggagggaacagacccagttattgtgccaggctgccagcaacaagcaatataagctcaactgcgagggtaatcaaaacaccaccattcaacttggctcacaaagtttccaagtggttcactttgatgatccaatgaccatgacaatggttcgaacaggccttgtctatgatcattgtttctcctcggccttaaccaactcttcctggggctcaggtctatttcgttactcgacgaattttacaaagaaggtggcaacaagagtgctttctatggggacccctgaactgaaagagttcaagattgtgaaggacctaggattgaagtgtaagtaacaaaggaacatgaggttggtgaaggaattcaagggctgaacaaagctttgagtgaagggttcaaagtgcatcttattccagaggctcaagttcaacagtgcttagcatgtcttttatataatggaacatgtggggctaatgatgagtctcagtttacttgtttttgccaggatggaactgaaggtttagattgttctgatcatcatagtatgtcttctttctcttctcttctcttctctttatttatgtgtagatatggttttaaacttttaagaatagattttttatgcaaattgattacatgaattgaagcctttagctagcttgtatcaatggctgttctagaaaatctgtagaacaaggagccctctgaaaacataggtattagatgaaaatgttattggggggtgctgaaaataagggtgaccaacaattggttgcttctgagtttgatatttattttcctgattctggttgaggagaggcttctcagaaatcctcctcctacttcttcagaattttcagtcagtcatcaaaaggaatagcatgctttgaatttgtttagactttcggacatttattgtcacatttattttatcctttggtgctgctaatttgctcctcacaagtattgcctggtgatgttatatcttcctctgaatttgtcaatggtctaatcagaatttctactctgtgatttggttcttttctcccctctgcgtctaaatctagattttgtagtgtaattctgtgtgaacttgttgtgaattgttgactttgactattttgggttgcttataaatcatcatttttttctataaagtttactaataacaaatttctaactcatcaaaagtttttttcctccttcaaaataaccattaactgttttggaagtgtaacaaaatcaatcgtagttcttagacacaagcatcaactatttcattaaaaggttcattgatcgttgtcaggcaatacatgcttaattttgacaattgttaaccaattagtctctaacattaccaaaaaaacatatttagttctgaattgaaaactatcaattgatttggccattgatgtgcataaagtttaggaatcaaatcgactaatgcatattaaaatggaagatcaaattgactgccgatagttaaagccagaaactaaattttcttctaataatatccaagagaaaattaaccagtatatagtaataattttatggatcaaattgattttttcctggtctcaagaaccaaattgatattttattgaactagagttaatatttgtgtgcttgaacccattagggtcagcctactcataaaaaatttattaggtggttcgaggaattagactaatctttacataatatgtaatcaagtattattaatctcttctataacttgaatacatatacatagagattagttagaatcatcaacacataatttgaaacaatctaataattttccccaacagcaagaatttgagtagtttgtataaagtcctaggttcaaatcttgttgccttcattgcacactaaaaaaaagtatttgtgttttcgattatcatgaactgacaaggttcctgcattgtatgtgctatgaatttcttggttaggcaaacttcacgatggacgtgtagttgcagtgcagagaatgtacgagaacagttacagaagactgagaagagttgagcaattcgtgaatgaaatggagatcctaacaggcctaaatcaccaaaacctagtgtcactatacggatgcacatcacggcacagcagagaacttctgctggtatacgaatacattccaaacggagctgttgcggatcacctccacggtcaaagagcgaaacccagcacacttccttggcacacaagaatgaacattgctatagagactgctagtgcactggtgtatctccacgcctctgaaatcatccactgagacgtgaaaacgaataacattctcctcgacaatcaattgagtgtgaaagtagcggattttggcctctcgcgtctcttcccaacttacgctacacacgtttccactgcgccacaaggaactccaggttatgtggatcctgagtacaattagtattaccaactcactgataagagtgatgtgtatagctttggagttgtgctgattgagcttatatcatcaatgcctgcggtcgatatctcgaggcgtatgcatgagataaacttgtccaacatagccatcaagaagatacaaagtggggcattgcatgagattgtgaacactactctagggtttgagacggatttcaaggtgaggaaaatgataagtgctgtggctgagttggcctttcagtgcttgcagagttctaaagatgtgaggccccctgtggcagaagtgttggataggttagaggatattagaagtgatgggagttataagagcaagcatgaggtgctggatatattagatgatgctgctttgctcaagaatgtgcctcctccaccttcacctgattcacatttggtgactatttctaattctgcaccaccaaatggtagccaatgatttagtgtgtgtttgaaaaacagtaaatctaacatcaacggactttcagatgaaattatgaaaagtacaatataattgctttgacatttttgctctagaaagtgtatgattttcccgttcaacatggattcaacgcatctccaaacataccctcaaattactgggtgtacatagaatgatagagctgacttggttatgacaagccatgacgacatgttttgacatcataatggataaaaaaggaatgatatatatatatatatatatatatatatatatatatattcttctttgttttaggaagtttttggaaaaaatctcatcaagattatgtctagcttcatttatggctatcatgtattgatatatagagattctactaattaatgaaagacccctaatgagaattagactcaaaaccttgaattgatgtattttgatcctgccagttgatgcatctcttgtaatcctgtcatgtttagcgtgaaagcttacatcttttttatttgttacagatgaaagtttacatctaatgataagaatttaaaaactatattttccaaagttctatcatctctcctgtaaccttctttgtttgatgatgggaaacttgcattgctcaactcttaataaatttttccaaagttctatcatctctcctgtaaccttctttgtttgatgatgggaaacttgcattgctcaactcttaataaagttgatttacctctttttcttaatttgtttcattctatgtatccttgctctggcatcatattctgtccactaattaccaaatcttcaaagagattcttagatacttaaaatatgatacatttaaagtgagcaaaattttattgtaaaatatgataaaataacatgaaggaacagactcagtttgtggattagatactatatatattttgattgaattactgtgctacttttataataatgatcacaatacatactatttcataatggaggttttggaggttctgtattcgagtcaaaccaaagcctgctctgccagactttccgggatatattcatgatcaaatattcctaaatacatataaattaaaatattaagaaacaggaaagaggaatcaatttatgctaaagtgagttacatttattcttacgtcatttaataattttatattagataattttatagttttatttaaaatcaagccttaacttcctatataatatgactcacataaaattctagattaatccaaatttatttaattctacatttaagtatatacgaattaatgaaatatacatattgttttttattttctgtaaaaaagatctacatatatttatttatttttaccaagatttaatagaaataatttgacaattccgtcaagatctcttcattagttgggggaagagtccgcacgaatcggattttttgaggaacatatggagagagaattggattaaaaattaaattatcaatttagtctattaaattgttattcacattgtcattgtaatccttagatttaatgaattcagaaaagtcatcaaatctacaatccaagctgtctctaaatttaattatttattattatttagtccctaaacatatatcttaatactatcacttaagtcatactatgcatgtaattttgaactaaaacgagtaacaaattataattttgaaaaactttcttaaattataataattttaaagattaaattggttattaactctttgaataatataataattatttaatatttagataaaaatattttatataaaattataataattttaacaataatataaatttatatttcctataaaaaaaatatagcagccaaaccaattcttagtgttttattttcttcttattatccaaaccccccaccccccaatactgtgcaaactctgtgctgaccttagtgggttaaaccaattctgggcaaaatcctttatgaatatcacccattgccattgggttgatcgtggagtcattttcatgagtaaaaaagggcattcaaaattagccagtgtcaaatgattttgacatatttcgtttagtagtctctgccttttcatccacttgataatgcaacagtctccagcactaacaaaacttgtctttttcaacttattttcatcaacgttattccataataatttctatgctcttattctctgttccttccacttatataaagtgagtaaattggattataagagtgagtaaaatcaccccggccgttctaattttgaaaactgatttattttatttttttactattgttttatagtaattaaaactgaatattttttataaaatttaaaattaacaaaaaaataataatttaatctcaagaataaaaatgcatgagaattatgatttaatttattcgatataaattactttctccttgcctaacttttctttttttgcaagattatgcaagcgaatgtggaattctgttctatgcgataagagaatagaatataacatgacccccaatgattaagttcattttttgttgaataaatggacaatctacgctgagtggaaggagatttgtgaagaaagggacccactaaacttccatacttataaaatcaacctattgaaaccattttatacatgataataatattattactattgtaattgtcataatcaatcaaacccccaagtggattacataatggtggagaatgaaagctaaaagcaatctagagcattaatttccatccactaacatgctatcagaagcagccaagaagaccatcaatcatatttaaaaagctaaaatatcatctcagaatgaattaaaattgatgaaaaggcgagtagttatagaggacaaacaacgtgattttcaaagaaattattattacgttgtaacaaatactaattggcatggcatgttcatcttattacgtgccaaaatgtgtcgcttcgctctaaacccaaaagatatcttaaccctatagtgtttggaagatgttgcttaattattatttgggtgtggatcatatccacattcataaaataactgcacatgatgttgtccctttaaataatgtatataacatggccatatttttagctaaaaaggctgttaaacaatgatttcaatggttagattataaattgcatcaattcatcaatttataaaaaccgtgatcatggtgaaatctgtcgtctattacagggactatcaaacgcggtgacattgctacagagacatatgaaattacacacgtgacattcacgtggaggcggttgcatgtccttaattgaaatccatattctgatgtagaagtttatgcaaagaatatctatctctgcagtatactatacacttgatgagacgaatgagagtcacttatcacttaggcgtgtgatttgactccaagctaaagtagagcataagggagagaaattggagataaagattgatttgttataataatcgattaatcattgtattttataatcacctcaattatttaattgaaaaaataaagattgtatctaatctaaacctaaataaatatacatttagacgacgtttagtaaatgtgtttgaataaaaaacaattcataacatactagttctattccatgacatttaaaaaaattaaataaaatgacacttgtggttacaatataacattttagtttcagtaagcaactggattaaaaaagataaaataaaattacagaattgttctattttactctgtcctaataacaaaagttatcttctttttttttatcaacgcaaaagttatcttaatcattataaatatcattgtttgattttaattgtattatattttgagtttagttttctttaatttttattcgaatggtttgttaatagttcagatattatatcaaatctcttaagctgtgatgtgctatatatatatatatatatatatatatatataaacatattcttaagttaaatttattatatgaacttcatgatttttggtctaaaacatgaatttcatgattgatactacgattcattttctttttctctcttgttctccagtctcgttctctctctctccggtcaacaaatgtaacaaatcaaatcctgttcgtgtttctttgtacgttaccgaccgtatgaccaatctttgcaacagattcaaccctcaaaaagtgacagtgacactaaaaccttaattaacccagtcatcaagaggagttttagttatttatattaattcgaagtatttttccatctgagagtcaaggagtaattcccatatatgttacaccattttggtggggaattcaatatatgtaaagatttgatgacaaaaacaaccaagtcattcttgattcttcttctacgtgcttgattatgttccgtatggatgttcccgtgctttgcgctgcagaaacatgaacccgaaaagaaaaaaaattaatagacagtcaaataatattacataactagagagataaagagataaaaaaaaagagaaaaaatataaatatcataagtactatgatataatagaaatagagaaataaaaaaaatagatgtctaattgtataacaggtgttgggatttttttttataaaaactaatattaattgaaaatttattaatttttttagtaaaaaaaactgaatttacaatttttattctttttttctctagttaaccttatttgtataactacggactccaccctaaatggcatccaaaagcaaatgttccaaaatgcgcctttaaatatgaaagtctatagtctatacctcaatcaagtagtacactacagtgatgccttcgaacaaggtaagcaagacaagactttgtgcgtcctgtccaacattacagtgtcttcattactcgaagaatgaaaaattgaggcactcaaatcttttcagttttggcaacagacagccagtcggcaagacaaaaacatagctggctcacaaataatctatatactatagatcttgaaataattataatcattatctttaatattgcttcatcaaaattaattaagaaaagatatcagtatatccttcacatatcgctgcatatatagtgatttatttataatgagaagactagatgagaaaactctctcccccactcagcgaattaataaatatagtgagcttacaatttcattctcatgagtgataatttttcttgaaagtctttgaaaatttgtgtttcggagttggccttatgaaggtctatagctaatctggatgaaatccgtttaacaagtagattttagtatctattgaattaaggtcaatcacgtatttgattaaggcacatcatacttaccctaagattgttaattaaagtaataccaacatataattttatttcaaaaaacataccaacatctgaggaacataataaagtctcattatccatatactactacttacagcaaaagacttagggtactctttaaatatcaatcctgccatatcacaatcatttaagagtttgtttgatggtctgaatatgataaaatataagaataagataataacaagaatctattggtcacaatgacgataaataataatagtaatgatgatgaggataataatataatgttggtaacaattgtgatatgacagtgactagtgagaatagagttgaaggtgatgagatagagaactattattttattatattactttttaactcaacttttttttcatataagaaatacattgcattgatgaaataattaagatagacatacataagcaaatcatgttttattggtgcattaaacatatatatgattacaataagattctatcatattctgcctaccaaacaggtcttgaagactcccaaattttaacttagagaatatagtctatctatgggaaactgtttggctcgagtagacatctttctcatatccaatcctccttaagttcatatccataaatagcaatgatactctccctaagataaccactactacagcaagcattttttacgtcacccaatctaagtcggttgtaacatagccgatgttaaatcaagttcagtggcaaattcgtaataaattgtattttgtttgatagacaacgtcgggttttaagtgaccgtagttgtctttaaagatacgaagtcggtttgcaaaataaccgtcttagaaaggattaaacattttaaaaaaaaataaatttttttgttttaaaaatttcgtggtcggttttatttagcaccgtcgttgtattgggcctttgcaaagtcggtctatagttttaaccgactatgaatgttttgatacaaatttttttttataagaaaaagaaggaaaataaaacctattataaactttggcccttttcccccggatgccctaaaagctcaaacgtgcccgtgccccttcgacctaagctcaagagtgttcaccactggaagcctcaaagcccccttcgacacagcgattgatcaagaattacgactattgcatcctcaaaggtaggttttaacttgtattcttcagatattgcggattccttcatcgtcattgttgttgtttgattttatttgcagaagttggttcgaagagcgtaggttggccaccccgacgacgaatatcaacatcagtgccgacgacgagtggttccgccatgtagtccgccgcaagtacaagaggtcagggatccctggagctagggttcacagtagcttgaattcgaactccagttggactcagacgggttcatttgcaggtaacattctacacttagctactcatctggcactnnnnnnnnnnagcaaaggtatcaattggggcgtttgtttgacgaatttgattatattccttagaataatattcttgaaaatgttatttccatcaatcatgtttggtacatatttttaattcatgtgaatgtctttgaatttattttaatataaaaaaatattaaataaacaaatgaggttgaataaaataatgagaaattattttaaacatctttatgaaaatgtaaggttccaactcctttacatgataatgataatagaaaaatggagaaacatgtacaatattattttttgaaaataagtatgtttcggaatatttattttttgttaccttctaactaacaaacgaatatgagaatatatatttacatttttatattttttgaaatctaataaaattatgtgaaaaaccttaaattgtcaatcctatgagaagtttttttaaaaaaaagctagtcatttgatgatgctcgaattttgcccctagctagcttctctgccattagattaatgaataacaaaagaccggattaggttgaagacgtacgtgcactggtgttatagtcttatgccttgaaagcatacttcactccacgcactagagattaagcatataacattaatcaatcaagcacaaagctcctgaagagaagaatattatagtggtccagaaagatcgatagaggtgatgtagggtcagggtcagggatgacattttgctcacgtggatgctccatgttcatggctagcctagctagtctaaaaggattatgcatgtttcggttgtcccagtcatgaccctccgaatccacttaattctttgtaatctgatcttgttttgtactctagtgtctagaaatcatattaaattttgattcatttaagtcaaatcaagaaacttatttaagaaaataaaacttaatatttctgtcaaaaaataaataaaacttaagatttaagattttatttcaaaatataaaatatcttattactttttttacgagaaaagattcatgtgttacttaaacgtactaacatacacattgataattacactaattattcaagcatatcctggtttaatttgtttttagtgaatataatatttacatatataataatttgatttaattataaggattattcaactcttaaattgaatatgttaagtagataattctttctttttattttttctaattagcatctataaaagatgtatagctcagttacttaccctttcatatattttttttttaatttttgcagataaaaaaatagtttgtatttttttctattttcttcttttctacttgttcnnnnnnnnnnagtatggaagtgctttctaagtcggttgttgtctagaccgacttaatatgttatttttcaaagtcagttgttctttggggaccgaccttgacttggtgaaaaatacgaccctttctaagtcggttgtttatcagaccgacttaaatttggctattttctaagtcggttggtgatgggaccgacttaatagttaatgctttctaagtcggtttatactagtaaccgacttaaaatgatttctttcaaagtcagttcattagaatgaccgactttgaagttgtactttctaagtcggttaattttataaccgtctttgaaacttcgttatgcaaaaaaaaaaaaatacactttcaaagacgggttctttaaaaccgaccttgtttgtggtgggctttcaactacatctgagacaaagtcggttgtacaaccgactttgttggggttaaaagaccgactttaaatgtggatgctgtagtagtgaaccattcctaattttaacttaacttttctctcatataagaaatacattacattgataaaataattaagatagacatatataagcaaatcatattttattggtgcatcaaacatatatatgattaaaataagattctatcatattttacccaccaaacaagttttaaagacttcccaaaatttaacttagaatgtattctatctttggaaaattatttgactcgagtaggcatctttcccaaatccaatcctccttaaattcatatccataaatagcaaagatactctctctaagataactattcttaattttaattaacagcccaaattaccatttcaagcatttattaacttaagaatttgagtttaggtagaatataattgtcaaagtgagggttgaatataagtgtcaaaagtaagtcaaatttccaaaatgactcatcacaagttgaggaaaaagagagtcaattcaacctaatttatttttttgatgaacaaaaaaaatgacttgatctcaacctactgtaggttggtcggttaacacaaattttaaaaaaaattaaatcttgaaaatgcaaataaaattttggaaattttttaaaaacgaaaagaaaggaagaaaaaacaaactattattagtaaagccaaaaattacaataatttatcatcaccaatcttaataacatcatcttttaagaaatggttttaattaagtgatttaaaaaaaatgaaatacaagttgagtttgagggattaaaatgattttttaaaaaatctattttagttcctaaacagttgaagaacaaaaatcgtattttaaaaaaaatgagtgactaaaataatcttttaaaaaataggtaccaaaattaaatnnnnnnnnnntcattatgtataaaaaaagactttattaaaaaagataaaatttgtttcgataatctctacgcctcaataattagtttcataattttggattatgagaaccttatttccagaaagaaagaaaaatctagagttttattgcttaattattatatctatatatgcaagttttattagtatgagtcaatataaatgaatagaaattttttttgggaggcctaaatgaatagaattaataatgtctatttcttaataattccagaaaatattattggaaaattttaaatatgatagagaataaaagaaacatatatatacaagtgtatgcttaatacatcaaattcttttaagaatatttataacttcaaaaaaaaatgtataaaaaattgtttttcaaatcaacactaagtagtagttctattttttcagatttgttggaaattagtaggggcaactctccatctgaattaatgagataatgattggcttattcaaaaattgagagacatgaataacctatgaaaaggaaaacaaaaaatagaaaacttccgaagaagtacgaaatacagccgacaacacttgtggtccagtcaaagtgcatatagatagaaggaaagaagacgattgaatttgacgaacaagttgccactcacactccactacttcaatcgtacatccatgatacctctgtttggaattggaaggagatacttctactttttctattcctaagtcaacagctatgactacatatcatcttctgtgagactcaaaaagaaaaaattaaaaataaaactaactcatcaaaaatatactatatcttgtcttctatgagcattggtaattttgagaagaaaaaacagtggttcttggactgaacggggtatttataagtgtatttatagaattaatttattgaggttttgttttattatataattatttaaattaagaatgaaaatattttattcaaattataaaagtaatgtatgaccatttttttaaaaaaatatttttataataaagtgtacttaaataagcttatgaaccagcgcatttcaatcacaagtatgcttgtatcatgaggcatgtaagcagcttgttttcaaggaactaattaatacagtatactttttaagcagtcaatgcaattggattctctatccagaagaataattggccattgctcacttctctctcttttttaactaatggtgtactccctctctcaattcatattcatatatatggaaaaaaaatcatcttgtatcttagatttaaaaataaatataattaattttacctttatcaaatgatgtaatttataaaatatcttttatattgtaacggtatctagctaggtcaaatagccaaaaatgttatggtaaaatttttagatcactgaaacacatcctctagaaatgtcaagtattcaaccatgtcgaatacctgagagtcatggttaccttgtccttccaaggaggatcatgatggtatcatgtgctcgaccatgcagaatacctagacattgttgtcccatcttttaatacttctcttatactagtacaagatattcaatcatgttaaatacttgagtactattatcttatcgtttacagtttatctctcttatactagtactaggtattcggtcatgatgactacccaagtactgttaccctctaacatttactctcttatgctagtactaggtattcaacctgagtacttctatcttatcccttaaaaacttgcttaatattcgtataactaccaggtactcgatcaagttatatatccaagtaccatatttattacatatgtaacacacaccacagtgttcaggtattcagcatggttgaatgtcagatacctttatcccacgtaggactacttatttaaaagtaagattatctaaattaactaatagataaccattatggtaaaatttaaaatccctaattagaaatacattaaaaggtaaaatagagaaagggcacataggtctagggtgttaattctcatttattactctcatatgttgctcttgacaagggcgttggagtgtcttttgtatgtatctcactctccaaattgtcgaacactatattgcaaaggaagaagtcagtcaagaagacataagaaagaatgaaagttacctacctaccccggtgcaggtacattttggtgcccaccatagggcctaggtaaaattgcctatgccccaagaaaagcatggttgtgactacccaatctatggcagaagcataagttcgacaattgatgaccagacaacctcagcaagttcgaacacccttccctcatgttagtgaagaccatggggatacgagccctactagaagagatcataaacatgcagcagaggcatgttgaggacataacaacattacaaaaggagaacactgagttaagggggcagcatcactcataacacccttctcgacatgacaacccacaaccatcccaagtaggggtgtccagcatattacaaggcagtcatttgggaggaacaacttatccattcaatcttgtcagcacctcaatagctcttgaactcaggaatccctttgtcttagggatcacatatactctgttaccttttacctgaaaacgagtgactttggacaagtatgatagtgctatcgaccttggcgaggacatcgacatttatgttgtccaggtaggcctatacacgatggatgacatagtcttgtgcaaagcattccccacctctctcaaaggacaagcgttgagttggtttactcaccttccaccaaacttgatagattgttttgaaactctagctatgagatttaaaatccaatttgccaccaactggcctcatcatttcacgtatgttgctccagttagtctatgacaagaaaataaagagacactaaggtccttcatggaaaggtttggaaaagatatggagctcatgtcaatcaaattaaaatatgtaccttatttgttgattctaacaagtttatatgttctaccgaagtgtctttgtacgaatatgatcaaataatgactattacaaacacatttaaacatttgtgtattaataataaaacattttgatttaatagataatattttatatgataaataatttttttttattttacaatttaactatatacaatgttaaaattgatataatatgttaaagagtcagtttgactccaccttatcttatatattttaggtcttgattgaattgaagttagattcaaataaatcacccaatcaaaaatttgagtcaaaataaaaataaacttatctcttagtcactcctaatacatccgtaacatcccatagctatcaaaagatcactttcacatatctatatctaaagactcttttagttaccttgcactaggtaggttctgaaaagattgtaagaacattttgtaacatcaaaatgttaaaataaaaaataaaaaaaccatttatgatttttcttaaatatttaccgtataaataaataatgaaaaaattaaaatgtcatttcaatatttcaggaaaaatgcaatcgaaccaccaattcgaacaagtacttactttggtgagtggaagaacggcgacgaggaattttatgatcaaagcaaaaaggaaaaccattagcttggcctagctagtcctgccaaaagcatttgatgctttagaaagataagtcatgtatccctagatttatatatcaacgacataaataatgaagtttttatgtatattaactaagtgtcaaatgatttttaattcattttaaattttgtaaaaataacttgcattataaacatttttcctctaacggtagattttagaataaatttatttagtcaaaagttattaaagctaaccaagagtgatttgatttgtatattaacgtaagatgatcacttctcaatagttattaaggtaaagtatacaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaacagcagtttctaattgaagagacaaaactgtcactctatatatacacgaaactcacgctaatcagagagaagaatcatattaaaaacacaaaaaataagaaaaaaaaatatttataaattgaacgacaaaactgtcactttgtacatgaacgaatcccacctcaactcagtagcatgatacaaaaatctacttgctttggagtggtcgtttaaactaatgagtagacgacgaattaaaatccaattggcattttaatatataaatatttaattaatcattatcaacaaaatatttaattgtttatgatatactttttaaaaaatattattatattaaataattgtgctaaataaaaattgtttaattattattgagtcaatgttatctattttacgtttttaatattttaaaaagttacttttttttttctttctaaacaaacatgctactttagaagtgtttttaaggttctttgtagtaattttgggaaaaaaaattctaaataatcatattcaaatgagttaaaaacagacttttatttaaaaagttttttttatgattgtaactaaacacgtacgtattagtactggtataatataaaaacttctgaaagataaatctttttttataaataattttttaagcacaaactaatcactcaaatatgtaactgttactgactcaaataagcaaccattaatactattctgtaacacatatcaccacttcaaaaattacctctcgaatagtgtgtattttgtccgatatgaggtaagaggggacaataatcctttattaaagctaactatcctcagtttttcagctgttttattttattaatttggtgtgtaaggaagtctatacttcatgtggattttaattgtttttcatctaaaaacaaactcaatgtaaatacaaataaacagaagtccttatcattacaaggaaaaactataggctcatgtccaatatgttatatgtgacttatttcaatgcacaattatagttttataaacaattaaaacggtgctaattaataatattttaacagtgcagctctattaatggcaaggcaaaaagaaaaggaaagacaacatgcaatgcgcaggttggaaaagatggggaagttatgggagtccatatgaatatgacaaaggtggctggctgggtcaataaatggtgaattaaaatatcttctatagttcaagctcagaatagtagaaaaacaatatcacctaaagcataaagctaaggttaaatattgaatacaatgggaccacctcctttttgtagtggacgcaaaatgaccattaaggtattcctattttatttttattattattattattaataaacaaaaataaaatacatttttatgaaagaaaatttagaccacttgaattcattatgatcataacaaatctaaagactcaactaatacttataaaagtatttacacattatctatactagtaacatataatatctgagagattagttaggacaaactatttaaaaataaataaatctaacttataaaaaagagaaagtggttcaaataggcaaaaataagagatataaattattaatttttaagacaaataatcatgattttattaaaatacaaagatatattttgtttactcttatattaggttaagaggttaaatacataaaattagaaaagtaaaatataaaattttaagaaaaatacatgtaaaattgttaaaatgaaaaggtatatttatccaaatttaaagaaattaaaacctctgttattagtaacaaaaatcaaacgcactcattattacttggaaataaatacttataccacatatttatgctcaagtggagactttacagtggagtgggaccatgctgagaatttatgaagataaaagatggataaaattatcagccacgatttgattttattagttgtttcacgttttgtgtagcagcatgccttatggttgagtagcttagctggtgggtcttggaaggtaaagtagtgattgcttttcttgtctatgatgtttggtttggtcattttaacaacatcttctcacagtcacagagacagagagacagacacaacagacacgttcacactaataacataactgataattagccccttatcagttaaagctaaacagaacctcaaattcgacaaaagacgtggttcatgccttcatgttatctgactttcttcgacccctctctttctttctctctcttctattcttctttcccataacataactctctctctctctgtgatcttatctccttttaattattcactcacccctttacactggttgatgcaaaaaaacatggtaccctctattgttggttgttgctgatactcttcatagtcacaaagtaggtgactagcagtagcatgtgagcgaaggagcctgcagttttttttatcgtactatactatgtttgttatgtaagtgcctcttgttcacccatctcatcacctaaagatttgtttttggctatgcactttcttttgattcttccatgcattttgagccattccttctgctgctttttttttttccttcactcttctttttttgtttcacttttgtttaattattgtgctacttttccttttattgggttttggagtttcatggagctccactttggcttgcaagaaattaaaagttcatgttgaggattttgtgtcttttgttttgtggtaatttgaaaccgtttttgagatggttaattatagtattgtcagcttagtgacgaaagagaaggattaagcctgctagttgtgtatcaaaatttagatctatgatttaaggagcaacggaaagcctctgatttgatgtttaaagcatctgttttctgtaatttgtattgtttagtgatttttgtaactcttaattccctactgtttttcaccttcttttctcctataaccattctagaccataattaattaccttctttagtttttgagtgtctgtaatcttttaattacctgtttgatttccatatgatttggagctgcttttgggtggttagttagtctactataagaaagctatctttttagtgagtatatcatgtcaattgatgagacatgttgtaattatgtggttaatctctggatataatttacttctatgaaagcacggaagagataaaattttcagatttatggagataaccccatctgattaatccgtaacttctgttaaacctatcttatataaacaatacatttttcaatcttaattttatcattgagcaactgctggaaacttcttgaaatgacccttttcatctcaatataatttgaaaaatataatctgcttttgtcagcaaataaagggtttatgtctgtaaaatctggcatggtactctaccttaagactcgtgatttgagaaggacaattctgcaatttactaatgatgaaggacaaaatagttgtagttcacaacaaccgacaataccaaaggctacttttatgcttttgcttaatttagtgcatcatagatgcaacttaaattagcaacaaaggggaaaaacatgaagtgggaatctacagtgtctggaagcaatggagtgtactgtgctatgatcaactaaatagcccttgaagttgtcttattcacgcacttaaataaataaaaatggtgctcaacatcaacagactagacagattctactaattagaaaaagatatgaaatgcattacataataatactcatttaagtatatgataaggaacataacgtacaccttgcattcaaggctcgtgtgtgataaggtccataaggtacattttgcatttaagtcttgttttatacaacatatgcttcttttctgttgtacgcaatgaagaaaacaaaaagataagaaaaaattatgaaaacatttttgctacattgttgtcatgaaaaggttaaaaattatgaaataaaaaagtcattataattcttcataggtggaatctgattgtgtattcccccaacccctcaatttgcttacattttttaaattgccttgtcgtagatgcatgaattaacatctggattcatttaaggaccctgttttttaggggaagaaccaaattttgtttgttgtaacttaagtttcaaattccctagcaagaaaggttactgctaatatgatagtttgaaggtcatttcctctttttggtaaatataatataatttttacccaagcataattattgcctttccttaagcagtttaggtgagtatttgtgttcatgctggttttagatcaaagttattttttcagaaataagttttcagtagaaagtgttatctaaattggttttccatagagaattaaactacatccgatttattttttatcgacaaatgctactttgttagttgttagtttttgttaatgtttagttggcctgcaacagtggcctacaacattagtggacaggagagaacaattaactagcatgagtaactgataagtggtgagtttcttgagttagtgtgttcaaccaactaatggtgattgttagttagtagcacagtacgtgggtaaggtggcaatgcatagtattcttgatgtttttctgtaaaatagggtctgcaacaagaagcaattatatttgtctgcaaagtgcttctttttatttattggataaattcctttgaccagaactccagaagtttccttagacagttacttctggtgaaataaatgtgttcttacactcagctttcatttttattagtgtttggcctagacaagtttctgtatgtaaggtgaggtattacaacagtagaagggataagtcataagttaaagaggtttaaaatagaaggcagattcaatttggaagaaaatcttgaaatggaacaattcatcacctggtgtgtcagaggctatcaggttaaaacaaatgaaattaaaaagcaaatgagttaatctagtattgcaatacatcggatagttagtttctttataatagtatcacatgtaatacgatttccatcttttgactttctttaatagaggtaacggccctctttaatttatgaagaactggttggtaagcagaaacgatcatctatcaaagatggttcatgtcagctataagaagtataagcttgtgtatgcttgtaatccttaagaagaattctttaggtttagtctttcctatttgaccttcattcgccaatgtttgtttctattacttctatatatattacatgtcttctccttattctcatatcctagtatttttctatatttacttcccaagtcccgtttctcgtattgttatatcctcttgtgcaaacaagcgttgttcttttctgctataagtttgctgtttcatatattgttatatcctctggtagtctggttcataacgaagaaacatacttaggtttgtcctctgggaattcttttagaataaaagtaataaagtattcagcattaaccaaatgttttggattcaaagggactgtgtgaacaactgtataactgacatttagaaaaatacatgtggtaggattgttttatggtttgaatttctattctcttatgctttattcactttctatcatccatgatttttaagtctatgaaaacggataattgttagataacaaaaaatttggcaactttttttttttggtgagatgttgttcagagaagcactacggtaagtgaaactgttacatgtgactgtgataatggtttctcttttcattctaaatcatttctttgagatgttcatgcttcatacaccgagcatgcatcttgatgaaattcaaatatgccaattattactttgttctgttttgctcaaggtttgagctatgataactctgtattctctctgtttaaagcacttgagtaacatgactcgcattatgttgaccatgtaaacatctcaaaatgtatctgatttccttagtcttgtggaaggaatgttccatagaattatcatcagtaatatagaaatcctaacatctttttatgttcctgcaatgttatttttttattttattgatataagactagtgtatatgttttgctccacatgatggatttccatgcagttacttctcatgtatatgattcaattggaaatggtctgatctactttaattgcatattactgccaacttcatgttgatgcttgaatttgttccattttgcatggttaatcaaaattcccaactttacgtagcaaatagtgtatttaatcaaaatgtaggtaatgatatcatgttaagctgactaaagtcacagatttgttctatcactgccttcagggaaagaagttaactcatagcaggttcacacaaacatgatgactccaaacttgaacttggaacctgaaaatcattcagaaggcagcagccaagtggcttcaaatgtatcctttcatgaagcatctcatgatcttacaaagggaagcaccaccacttcctcctgtctcacaaaggatgaaaccgatccaggttctattacccttgacttgacactcaactttagttccggtgatggcgagttgaaaggctcaagtgatgctagcagtgaagtcggagctgaaactcctgcttcagcatcagcaactccaagggttttttcttgtaactactgcaggaggaaattctatagctctcaggcattaggtggtcatcaaaatgctcacaaaagggagaggacaatcgctaagcgtgcaatgcgaatggggatgttcactgagaggtatacaagcttggcatctctacctcttcatggttcacctttcaggtctcttggccttgaagctcattctgcaattcaccaaagacacgtgccgtcctccatgacagcactgagggctcctgaaatgagagctgctgcaaaatttgagagaaaccaatttggatcactgattttcgtggaagatgatgatgttggattcttttggcctggcagtttcagacaggtagaccaacaaggagctggtgttaatgtaggacatgctcaaagttcaaatgctagtttaattccaatggtgcctcctccaccacaagcttctacatctcctgatctcacattgaagctttaagtttaaggcttaagaatgatgatacatacacaagcaaaggcctcacaaagtaataaataagtggctaagaattgactcatccattgctttgcattcaggcaaaattttctcaaccactcattttcattgtgaggggtttaattatcagagtttttatgtgtgtatgtatcacttctcttgagattttttagtctttgatttcattctcttcagacatgaacttattaattaatagggcgtgcattgtacagtgagatgtgtatttccaatggcgattttaatggtttcctctcatgtattttacttcattatacatgaatcatgatactgcgttcaggataatggactaatgttttatatctaaaaaatgtgtttgtgatgcactgtttgacggaaacatgaggtatggatgtgattcaattagcaataattggtggatttttcttacaggagttcgaatctaaatggaaattcctatgattaaggtcatgttgtcacatgttcaagtgcggaattgatttctcaactcacctcgttaaaaactaaaaagattgtagtttatagagattgtatgtaaataacattttctagtttgtcacataatcctctggggacatcatatttaagcgaaatatagaagaataaaatctccaaggtgataactaatagtaacagctttttaattaagcaccccaaaaaggaatcaggtaagtcgtataaattctacctttaaaaagtagatttaaggaatataaagctttgaaagcaagcacatatattcatgcagtggtaaacaatcgtgaacgttatattacaactacgaatatatttttttcgtctatgttgacttttaagtgttatgttttgtttcttcggcttgaagttgttgtgaagtcattccaattgaaagtgagcatcttaagcatcattttgatataaagtttcgtaagaaaccaagttaaattaatgtatttctgattacgttctttagttagaccttactttattgtggacccttaaagcccagtggatcagctacaatatattgtgtagtatatatatttaagagttgggaaaaactttatacacccatattaatacaccattccaacttttttaaatggccaaagtaccctcgtgaatccgcaagtaagtttttttttttaatttaaaaaatatttctccaaataatgacttcatgttattaacacgacacttcaaccaactgagctaataggtcaattgtgctaaaagtcaattaatgttgatacatataacattaaaatttttaatatatatttaatacacgtataagtttacataataaattttgtaacaattaattttgatataataattaaagtattttttacatataaaaatcatagatttaaataaaaatcataagttcaataaaaatttgcaggtttaataaagtataaatatagatataatttttaatttaacctataaatacaaatataatttttattagacatgcaaatttttattaaaattatgattttttttaaaactatgatttttatatgtaaaaaaaatactttaattattatatcaaaattaattattacaaaatttactatgtaaacttatacgtgtattaaatatacattaaaaaatttagtgttacatgtataacattaattggtttttagcataattggtctattagctcagttggttggagcgtcacgttaataacgtgaagttctcaaatttgagacctgcatgtgctattattttaaattatttggaaaaatatattttaactttaaaaaaaaaacttacttacggattgggtaatctgtatggcccatacggattgtccaatccatatatctcaaaaaaaaatacggatcataataaaagtgaggatatttttggaaatgcattgttcagaatcgtgtattagtgggtgtataaagtttttcccttaagagttacatgtgattttttcttttggtcaacttgcacatgagtttactggtgtaaaagtagggaagaagatgggcttaaagactagtggatcagctacagtaaaacccagatggagcttaaacaattgggccttgacccttatttggttcctttttttctcatttttctaaaattacggaatcaactatggaacacaaaatataacataaaagtcaattgaattaacacgattgattgaaagataataggagcacagagaagagaagagaggaagggtttaaaaaataaacttagagcatctccaaacaggaatcttcactttaattcttaaattactttcttggaacccacattaccgcatcagctttcagaattttgttaacattttgcttcaaccatgaaccttcacttcatatcagtggtttttccggtatcctcacatagctgttactcgatatctttataaatgcactttaagtggttagattagtaatgttattatggccttaagataagaccagggctttgacccttgctactttagagaactcgattgagaaatgggcaaaggcttgatcaatgacctagcactaagtaggcatacgaccaagaggatacataactctcaacctcaagcacgaaggctagaggaaagtcatacctgagcaggtacaatcaagtgactacacaatccttgagactcaaacttaaagacacaaaggataaaagaaagtttttttacctaattagtgtacaatgagaaaaatacacaacttctaacctcaaatacagaggcacaaaaagactaaaggaaaaccacattgatcaatgtacaatcaagagagtacaattttgtattatacaaatacgacattaagtacaaatatatctttaaaatacatactcacttttcttgctgttatacttcttttcacttttatcaatctaaaacaccttcaaaatctattcattctcttttgtctcttacttctttctattctgttttttcctatcaaaatctttaattgttcagacgaaacattaactcatcctaaacagatacctcaatagaagaaaaaaaatctaaaataaaaagaatagaacgccataggttgggtgtgtcctttattcataggccggaaataggggccgttgctgttgacatatacttgatcctgaattggactggacctctgggactgggtcatggatgaggtgtattgaacctagtatatgcttcattatttgaaatgccttggtcaaatatgccaatgcattaatgtaagaattttatgtttattaattaatcaaaatgaaatgttcgaaggtagaaagaattgtataattataatcgaaaaataaattgtataattagatcaaattaaaattcatttgattttgaaggaaatgaaaacattcacgaaatctatttattcaccttttaccctctttcatttacatttttctttcctaattaagaaaagtgtagttatatactctgtcaaacttattatactattcagtaaaaaaaaacttattattctattaattaaataaataaagatttaaatatatataattttcaaagtagctatggaaaatgttgacttactactcacaatatttacttctgttttgacttgatttgattactcttttttcttgtgtacatataattggttaccactgtatatatatttggatcttcacttggagtattttaggagttatattctttcttagtaagtcatatttcatatacaatgagtatttgcttttacttgttatttattttattttatttctttcaaacactattgcttaaatttattttcagtttttaattttgaatcttaatatactatataaattaaatcttgagattatgataacattaaggaatcttaatttcagtttggtttttaaattttgatagataatatatcttgattcgatgatctattttaataatttccttttcaattttagaagtctcatttatttaatttattattatataataaaataaaatatttattattaaagtaaaacatcgattattttttattttttatttatatattttattttaattaaaaatgcttatacagtattcggtaaacttgctagctataaaatagataaataaagttgctattcaatgtacaaattgacctctataatatcatgtctgattaattgtgacaaaataattattattatttgaagagaaaagtcttaagtatcctctttcaactttcaaaaaacaaaaaatcgtcttttgacctgtatacatttacccattacaaaatttggaaggaaaatgaggagagaaaaaaaaaagggggacattgactttttgtttgaggtatattaaggctttgtttgggagttaggaggggaggggaaggaaagagattcaaggggaagggaggggaaggaaagggaggaaaataagggaagttcctttatccttgtttgggagttaaaaatatatcaagagagggaaatagagagttaataagaaatttttacaattttttcattatttaaaaaattaatacattatatattttacactggttatggtagggtagtaattttattaacactgatgatataagataataattttagttatttttccttctaaaaaccccccaaataggggggacaacaatttataagctttggaggatttcagaggagttttgaaaatcctcaaatcctttccctcaaaaattaaaactcgcaaacaagggaatgactctccctaaacctttcctttccctcccttcccctcctaactccctctcccaaacataccctaaatgaatcgccgtgtcgtatatttatggggaatttattgtcttattattttcccatttggatccatccatccacctgagtttgcataccaaaagtaacacagcgttggccaacatttgacttttttgaaacgaaaggaagcaacgtcccattttccgttcatttgtgaaataactcatacaccttcaatttggatttgtatcgcagcagtgtcaatatctaatataatagtcatgcattaatcataaaattattttatgaggttaattaattacaatctattgtgttaaattcttatacagtaaagaaccttctaactgcttggacggtcaatcgaacagttccactaccgaatgttcatagtggagtccatctcaggtcactaactgctatacttataaatggagagtagataaatgcagtcacaccctcaaatacatcttttatcacattttttttcattgattgacctcattttattttttaatgagttatttgtacaatgattgaggttataacattttataattttttattttattatttttattaagaagaagataaaattaaattattattcaatattagactaattaacacttaaaattcttagtgacttagacattagaatctcttttagagagatatctaaatatataacatctcacttagatttggagtggacattagatatagaatcaagggatagacttaacaaacacnnnnnnnnnnatattccaatgactacactgcagcttctttgtcttactcttattcccaccctttctctcacaatccaagctgttcactcacccgcaattcaactgataattttgattactcagtgagcaaagatgaccaaatttggaactgtggagagggcactaatggctctgtgcatagtaggttcaagcccattggagatgggttggttggtttatccaaccatggtggtgctgctggtggtattagttcctttatgcaaggtaataatagtcagtataaaactaatagttcagataaccattcttttttcccttcagagttgcctgcaaggccaaggtttgaggctcagtcaggggactcaagggggaggaattctgagaatctgagaatcttggaaggcttggatgatgggaaggtaaggaaaatttctaagccagagagaattgttagggaaattgtttcagagtctatacctgtcatggcattgacaattcaggagcttaccgatgatgtcatagcatcaactaaggaatacttgaggaatctcattgagaagcctgagaagaaagaggaactggtaagcctccagaaccggctcgagagaagatctgaccttactaaggagagtctttcaaagtgccataaagtgcaattagaggttttagtggctgtaaagacggggcttgctagcttcctatctaataaaattcaattgtctgagatggtagaggttttcttgtttaagaggtgtaggaatgtaacctgcaagcatttgnnnnnnnnnngtgttgtccacttgtataaatattttaatttctttttattattagaattgagatttagttatatttgacattaatatagatagattattttttcttatgttagaataagatgaagtaatcagaaaatgggttgatttggtggggaggagaattacacctcctatttatataaaaaaaaaatagatttaaatatgtttttggtttatgtaagttaacattttttatattttattatctgtaagtttattttttgaaaattttagtccatataattttactttttttcatttttgactaatgaaagatatttttcttatttttagtttttataagtttatacttttcaaaatttaaatttctataaataaaaacttaaaactattgatgaaaaaattagaatattaaaaagaattattttttaaaaaaaatacaagaagtaaaaaaaattaccgaaatcaatattgaaaaatagtctcacaaaaactaaaagtaaaaaattaaacttacagaaataaaaaataaataacggtaacttagagacacaaaaacacctttatgccaaaagaatattttgtcctaataataatgagtgaagtaaacgaataatggtaatatgatgcaaccggcaaagaagttaaaaaggcaatggatgaggtttgtattgaagtggtcgttcattcactcactcactcgtgcttggtggtggtgaggtggctgagctgcgcggagctgtttgatagggaaaagtaaagttgcagtcaaataaaagaggtccacttgagcgtaattctctccgctttcaagggttaagactgtaatctcacacatccagaaaaaagcatgccctttatcgccgttttttattacaccccttcagtgtgaacacttgaataatgacattccggccgttgcttgcagactatcccaaactaaaaccaacgttcccaacgtaacaaacaaaagaaaaaacctctggttctccctttattctcttgccatgattagaagtaaagattgtgttgctgactctgaaggtgagaactccaggagcaagctctcaaggcacaattttgaggccaacaaggagtacccagatgaaaaaggtgttgaatttctgagagattcagaagtgggtggtggtggtgttgatggggttcttcactcaaaacccaccaaggttgttgttggtggtggtggcagcagctcagggttgcaagagttgaccctcagctacctttgtgacttcccaaaattcaatcttgctgagaaagagattcctggtaaaagcctgctgaattccttggaaaaaatgaaccacaaaggaaaagaggttctggtctgtgagaattcaaatcaagatgggaaatgggtggaaagagattttctcagcctgagtgagccaagggaagattcttcaaagagatcccttgaggaagttgttgagacggagactaatagggagaagaagccaaaactggagacacttaacctttctcttgctttgcctgatgtgtcactttcccttactgcctcaaacgccttgcaaaacggtgatcaacaacaacaaccaattaggaccaaaccttgcaggccatccactactactcacacttcatattccaatgactacactgcagcttctttgtcttactcttattcccaccctttctctcacaatccaagctgttcactcacccgcaattcaactgataattttgattactcagtgagcaaagatgaccaaatttggaactgtggagagggcactaatggctctgtgcatagtaggttcaagcccattggagatgggttggttggtttatccaaccatggtggtgctgctggtggtattagttcctttatgcaaggtaataatagtcagtataaaactaatagttcagataaccattcttttttcccttcagagttgcctgcaaggccaaggtttgaggctcagtcaggggactcaagggggaggaattctgagaatctgagaatcttggaaggcttggatgatgggaaggtaaggaaaatttctaagccagagagaattgttagggaaattgtttcagagtctatacctgtcatggcattgacaattcaggagcttaccgatgatgtcatagcatcaactaaggaatacttgaggaatctcattgagaagcctgagaagaaagaggaactggtaagcctccagaaccggctcgagagaagatctgaccttactaaggagagtctttcaaagtgccataaagtgcaattagaggttttagtggctgtaaagacggggcttgctagcttcctatctaataaaattcaattgtctgagatggtagaggttttcttgtttaagaggtgtaggaatgtaacctgcaagcatttgcttcctgttgatgattgtgactgcaagatttgctcaggaaacaagggcttttgcagttcttgcatgtgtcctgtctgtttgaactttgattgtgcaagcaacacttgtagttggattggatgtgatgtttgttcacattggtgccatgctacttgtggtattcagaagaatcttatcaagcctgggcctagcttgaaggggccttcagggacctcagagatgctttttcattgtattggctgtggacatgcctcggaaatgtttggttttgttaaggacgtgtttgtgtgttgtgcaaaggattggggtcttgaaaccttgatgaaagagcttgactgtgtaaggaagatcttcaggggaagtgaagatcgcaaagggaaggaattgcatgctaagactgatgacatgctattaaagcttcaaactaaaatgatatctcctttggatgcctgcaattacatcatgcagttcttcagctgtaagtgtctggactgtggtcttttcaattcatatttaaatttgtgttaattttttttaaaaagtatatatttacttcataaatacggcatttaagtgctaaggatacaatcatagatacagcatttaagtgctatggatgcactatgaatacatcatgatatgcttggtctaaacaagaagaaaggatcagtccattatcttcaatgggattgagttaagaaaaacacttgatatgttagtctttcagctcttaatactgtatattctagtgttacagttagatgaaagcattttcatatgatataaagggtctctttgtagtacgattatttattggaagtgagcaaaatcagtggcttttttatgtgatttggtaggatgtgaataagggaggaacaaatatatgctctggtggagagaaggattactgttgataaattatattgtgcttctgacagacaagagatacagtatggcacatatcaataaaatgagaagctcaattatgctctttttataaattatggaactttgaaccccatttcgacttgaccaacaaataattatgctccttagtgtctggctgtccaaggccaaaaagtagaataacattgagaatagccaacctcagttttccttttctggcaacatttttttatttgaagcaggaaattcagggcaagttgagaaatgatttgtactttaagaatgcaaattgaaaaccattgaagttaatgttttaaaatggattataagcaggtttgcttttcattttttaagcccaaaaaggaaaattaggccaaaatctcctctctcttgaacattttgattataagttttttaaaaaacaaaagctaatcctagcattcattatatgggggatttgaatatcattttataaagtgattcgagactgctggatgttttatcaacatcaagttgttctttgtcaatcaatcaggcttgcttatttaccacaaccaattcactttcactattcagcttggatatttacccccaccccaggcctgttatttcctgtgtagttttttagtgagcacatgctactggcatttgatgcccctaacagatccaggaatcatcttgtagtttttaaggcagtcgagctcagtattacatttgataaagtttaatatgtttttatgatagattgaaaacataaaggaagaggaatgttgcttttcacactgaactgcctatgcatcaattagttatggtcttctgatgctcaatttgcatggataatgaattatgtgtttgatgaaactatttgcatctttttcccttcctggttaagatattttcatcttagcattggcattttgcactgaagtacttcatgagataggaagcaatggaatgccattagttcttgagaattgcagtggtgggtgaaactggaaaaatgtgtataaaactgttgcttgtatggtacggttgccattatctctttggctttgttgaatatgtttgatgtaataattcaaactacctgtgaccctgtgatttttttatcaaatgtccttttgtatagaaggcccttttccttctttagcttagttattgctaatgtttttttgatgaaggcatgttttctctaattaaattactgacaatgatatctaactgttgagagattttttctgataaacagacgcggacagcatgtcagactttcatacttctggtatttcttcaaaggatttgccagcctctcaatctaaccttacaaaggatacaccatctctttcaaaacctatttctctattaccaaaatatggttatgacatgggctattctaggtcacatcctgatgccatgtcaagtgatctacttcagaaagacctcaaatcttccatcttaagtgaactgaaaaatgaggctgatttacatttgggggctttattaaggaaaggtggacttgaaagtttggagagcattgtgaggataaaggaggcagaagccagaatgttccaaaccaaggcagatgaagcaagaagagaggcagaagggttccagaggatgatcaggacgaaaactgcgcagatggaagaagagtacgccgaaaagctttccaaactctgcttgcacgagactgaggaaacgcagaggaagaaattggatgaactgaaagtcttggaaaattcctattttgattactataaaatgaaaaaaagaatgcaagatgagattgatggtttgttgcggagaatggaggcaaccaagcagcaatgggtttaaattttatttttgttgcttttccttatgttttcttattgaggatactgctaaatgtgtaatttattgatatgtgatgtcttggtattctggtggttccctgaatggatggttttcaattgataaaatcaagctttttggtgtctcatctttgtttctttttccttcataaatggagatggcacaaatgtcaagctggacatgttaggtgtgaaagctttgcacttcctgtcgctgtttatattacgactttgaggctataaaacctgtaaattttttcgttatcacatcattgttgcacatagatttgcatcttcctttattataacattttccctttaagaaattgaatccttttctccattttatatacttagcatctatctgtatgtttagatcatattatttttaaaaaacaatttctgtcccaaaaaacaatttattttttattaaattttaagagaattgagataaaacaattttaagtaggtcttaagcataccactgagtgccttgattaactggtggggttattttagtttagtaagtgatttcgagttctaaactttatatccaattgtgttaaatatttttttaaaaaatttacagcctatactaattacccctaattccagtaagcttatcctttgctaaggatacatgtgatttcgaagagagaaaaagaagtttttctcaagcatgttactattatacaaagatcctccaataagtaggagagagaaagcttgacattattaattttgttactcttggtggatgcagcataaaggaggacagtgctcaagagcactttgcttgaatattatttgggttattcgtttatttgctcaccgttgattgctgcttcttaaaccataatttgcaactgtttgtgcttatgctgtgttttgccacttccagcattggaactagttccaccaaggtgataatgaaagggaatctgcacacattcatattagtgtgtgacatccaaccaatcagctctaattggattccattcgatttattattatatactaccatcattttatttcctgatcactaagctggttgtgtaatggtgactttcagcaaacattatcaatttgctattatattaaggtagaatcgaattttcatcatgcttgaggaataatgaaatcattatactctctaataccgtttttataaactactagtataatttaatataacgcttaataacaacttacatcaaagttcagaaaaaagaacttacatctcaaattgaaattggacaactaacaagttagatagttgagttaattaactatttgattaatattcgacttctagtaatttaagattcgatttctgattgaatgtataaaaaaatattatatccattttgataatcaatctctgtctttaaaagactaatttatcctgggactggaagtacatataaaaaaatatcaaagttgaatcaattgataaaaagacattataataattatatgttgacaatcttaaaagtcacttagagagaaaaactatctctacaatgtttggatatttaataccttccaatattctttcagccaatgggaagcaaatcctggagcatgcctacaacagtaaagaggtatgtataatcagtgatctatttctgcggaataggttattgaaagcgtatggatgcagaattcaagactggtactacgagggacttgcatatccatatgttgacgatgcgtcctgatatttgtatattctagatatcttcacgatggatcttgtgagaatgacagtaagtggtgtagtattgtaagggtcttgttaatcagtaacattgattaaaaaaataaaaatgaaaaatatttattgtttaaattagagtataaaaaaaattatgaataattcaatttcttatctcttaataaaaacatttctattataaatttcttgaatgttatctttagtacactggttagcatttgcttaattgtaaaggtttgtatctttttatatgctattccgtggtatataataagattctgaaagcttgtgagctatctgttaaagatgtggaattctagggttgtctgtattctgttggtagtctactcagtgaatatcttaagcactgggagacaatagtatataacatggcacttctggtgcttttttatcaatatataaatatacctttgcttattaaaaaaataaacataatgaaattaaatgaaaagacagaagaaaaaagaattgnnnnnnnnnnnnnnnnnnnnnnnnnnngacttaacaaacacttggtgagaataatatatatatatatatatatatatatataatggattaagttatttcaaaaaacactttaatagaattattttcaattcccaatattttttaaatctaatgattttaacgaataattattctttattgttagatttcaaaaaataaaatgtaaggatgaaaagtatcttttttaagattattcatgcaataacttaatctctatcttaagtaaccatgagtatatttaagtctatttttttatcatataattgatataaaatgtttactagttttatttgtgaccatttttatcaagaaacctggttagtcacttttagtaaaatcttttttttttaatcatttttttcattaacaaaacttaaactaaaatcttttcttannnnnnnnnngttgtctgtattctgttggtagtctactcagtgaatatcttaagcactgggagacaatagtatgtaacatggcacttctggtgcttttttatcaatatataaatatacctttgcttattaaaagtataaacataatgaaattaaatgaaaagacagaagaaaaaagaattgaaagtataatttatattaattatcttagtacgatgttagatgataaaatgatgataatgacaatgatagtggaagactaggaggagaagataaagaatttataatgattaattaaattataaataaaaatagatattttgtcttttgagtatttgataattaagacaaatgaaatattgtatgatttattctgtgacaaaaaatggaactgttatcctgcccatctttatctaatttgcaatatttcatttttttaaaattaaatattatattgtttagtacgacaagttttagcaaaacaaagttaattgtgtcattcttaaaatttcgtggagccatgacgaaaaaataatttggatcattttatatttaagtatttcaaaatataaatatatattaaaaaatagatacatgattttattagaatttatatattttcttatattaaacaaataacataactttaataaatctctaaataatatattatatttttattcaatttactctagctattatcatctaatatcattcaatatatttataaaataattatataacataaatatctatatataaggtagacatcacaatgacataagataggataggtttaataaggatcaaatttgtctagtttgagtcttcaaatcaattcaaaccaatttaatcataatcaaactatcatatctattattaaaataatgaaaaaatgaagaaaaaaaatagaaaagtgattatgatatcatgcaattttatacatttaactcaatctattttttatttactagtctaatatgaaacatatgttaaatttcaagctaaaagttaagtcatgtcttacattataggacctgcatgggttgggcttatagcaaaagttcttagagtgtttcttcctgcaccattcattttttctactacaccattgatgaacagtgcatttccaaaattgtccttcgtgtttttgcaacttttatacacggatccgtatgattcatgcttacggattcgtcaatccgtaagattcttacggatccgtgaatccgtaagaatcttacgaatttgtcaatccgtaagtttttttttttgcatgtacggattgggcaatccgtaagcccaatccgtttgtttttttttttgaaaagttaaaatatattttagaaaataatggtgcaagcaagtatcaaacttgtaacctttaagttattaatatgatgctctaaccaactgagttaatagaccaattatgtcaaaaattaattgatattgatatatatatatatatcactaaatttatttaatttaaaataatttattatgttaaaaaaatattgtattaaatatacattgaaaattttagtgttatattagcaacattaattattttttaatgtaattgagctattaatttatagtttaatttattatgttaaattttataataacattatatgttaaaattacatgttgaattaatgcatgcagacatatctgtaaattatatgtaaaatttatattataatttacatatctgtgaaattatttaatgatatgaaataaattgttagcttcaaataaggataaaaaacattaaaaaatgtttaagaattaaaagtgaaatttacaaaaagtgtagaaataaaaaaatatattaaaaaannnnnnnnnnnnnnnnnaatgtatatttaatacaatatatttctaacataataaattattttaaattaaataaatttagtgatatatatatatatcaatatcaattaattttttacataattggtctattagctcagttggttagagcatgatattaataacttaaaggtcactagttcgatacctgcttgctttttttagtatgaaaacaaaccagctcaattagtcaacttatatcccacaagagtccaaaagatagtaagaaaaaaaattacacaaggcatttccagcaaataaaaacacaattaaaaaataaaaataaaaaaaaatgtagaaatgctggaccaatcgaatttgaataaagtacatggaagtggagaaaattaaatcaagagtaatttcgggcataacgggccaaacccactgacatatctacaaagactccaaacaagagaatagcaagacccgtgaagttgattaaatgagattctctctggtgtggggagggttttaacatagtatacttctccatcaaccctgttagtgcagcacaaattgccatgaaaaatagtgctctaccacctgctacgtgccatggggccattgcattccttgattgtgcagatccttgaagcataaaccccagtcccataagccactgcacccaacaatcacgacccaattattaaagttttgacatatatgacctatattactgagtaaattatctctaaggttttgtcaaatttgttctgatgtcttttgtttttgtaccctcacacagtcacactagtttttcttaattatttaaaaacattacacatgacacttcgtattaattattcaaaaaatagtattacatagtgtacctctataaaaagaatgttgtaaatattaaagaagcatgaaactatatacaatctccataagtttcagagagtgtcaatataatttactcaatacttttagattgtcactacagttaaaatcatatataggcgttcattattgttaggatcatgtacataaaatgttttttctaaaataaattaaacttttgtttttcatataaaacaaacttgtgcacttaattttaatagaagttttcttatctaattttgttaaaagttgagacgcagatgttgatttatgaaaaattcaatttattttatttttacttttattttttctcccgtgagtactcacaaaaaaagtttaagattgtatagactaatacctgcaagccaaccaagcaaaaggtgccaatgccaatccatgaatggaggctggttacgtcctcccagtttaccatatcattgaacttgaaaacggcacatataccaacaatcccaagaattatagcaatgaaatgaagtgtcaagtgaatgatcttctttgtttctcgtggccctggcaccgtttggtatgacagtattgctgctcaaattttacacaccaacctaattaattaatcactgtagaaaatgatacgctatacacttttgtgtatatatgtatgtatcacacattaagttgttcacatcttgttcagatcagtccaaccataaataagatctaaaataaatcttaaaagattttttttaaataaaagagttatagattaaatgtttttattaatatatgtgacttttttttaacatatgtgattttttcttaatttataaaaattaatagtaattttttttattagtagacttaaaacttaaattttaattactttatttggatcgatccaaacaattaatattggtgaattaagtcgtgaaggaaaacaaatatgctaaactgggataacaatgatgaattgaatgcagtatagaagggacatgatgtgagagtaagataccttgaccaataaggaaaatgaatccaacgaacatcataaaagggtgaacctgcaaggtggaaaaagactcagatatgaagtagaatatgatttttgtatataaacacaagcaagaaacacaagaaaatagtgttaattacattgaaaacacgaagtggattttcagaatcatattcaatgccctcacgataatgcagcaaccaaacaagcaagaggatgagagcaagaagcccaaacaagtgtgccaaaattgtggtaccgtataaagtcatcttaatggattaggtgggagataagatgagagaaaatttggaagctaggagtaatagagtgagtgaaattttgttatagtacaatgctggttctgacatggtgttattctgctgtggttcagtcttatagagtttaccttttgataaagttcacaaaagaaggaattgcttgatatcttggttttggaattttgaatgaagaaacttttggcataagccaactctagcagtttctaaagtatatattcgtatgttagaatggtttccaatttttgtctactatttgtataatctttttgcatagggattgatgcccacggtgtcagagactcagagtattatacactacaaaccacgtgtaaatgaaattattttctgtgtaaatgcaacttttgaactcacatgatataaacatttgaataccaaactattttcgtcttattaaataattttctaagagttgtgattaaaaaattaatagtaataaagttttgattaaaaatcttgttagaggtgcattaaaattataataaaggtattttaataatatttttagtcatttttttaatttgttaaccaatattctttattctctaattaacacttatcatgtatttttagtgtacatatatcagagatgtttcaaatgacaacatctcttataatgataaatgagaacaatcaatgacaacctttagattacaattgaaaattttaatgaaagagattaaaataattaaacacgtgactttctcttcttcctcttctttctccacttcacagttcacaagttctaaattctaccacattcaacgcctctttagatattgcagatatagtgctctcaattctagcacgttaattgaatgtttgtggatcaacatgttaagttcttttgttttttttcttcaaatattgtcattacacaacgcacattcagattcagaggttgggctgttacaattgccttttaccagttccaagataaatcataaaaagttttgtaaaaaaaaaaaaagataaatcataaaaagtagtagagacgaacaaggaaatcaacttaagaggtaacaataaggaatgacttgaacgaggaatctacccatacatatgaggtaactaagtgcttctttatcttcaagagaaataaaattggttttaaatcattcgaatatgattgagatgtctgtttaaattaatctcaataataattttatattgaaacatgttcattatatggaaaaaatatttttgatataaaattaacactcccgtaatttgattcagatttaaatatatgctagaattaaattgatcttgaatacgattttttaaaaaaaaaacttaccccgtcatatatcttacaataattaatcaagttgtgcatgaccggctcaacttatatctaaacttcaaagtgaattttaggcataaatctcatttttttctattatatttgacaattattttattttcttatattaagttttaaaagtttatctttcttattttaaaaaatgttaattttgattaaaaacgttagagttttgtttatttttacattttaaaatgatttaatatctttttttattcattatgtttcgcatatatttcactttgatacattatgttttaaaattatcattatgatactttactttttcaaaatgtatggtctttttttcaatttttgttagaaatttagtgtctatcaatattttaaaattttagaataattaacttaacatagtggcaggtaatatgtcactatcttttttatttaaaattaaaaatcactaaataaattgaagaaaaaagaaggatttgcaaccacgaacaactacaataacaaccttcactcttatattattattagtattattctcttcattcaatttaataatttaataacgacaataatttcattcaacaattattctcaatcacaatgggttatgaccctttcttcttttgttatttcacctctcaccgttgacccaaaacgatcattgtctcgccctcacttttgtctcatcatcgtttctaacaacaacgcgttgataaaggcaaataagaagatcgacaacgcccgattgtggatggggtttgactagtcgggcctttcataaacatcttccaatgaaactcattgttcgacccttctttgtgttgcatatcttgcctgactcggttgtagatgtcggatggaaaacttctctacttgcccgggcttgctcatagacctcacaaagagtcacattgtgacttccaagttcaaatctgggttaattggctagttaaggtcatgtttttgtctttcgtcgaagataactcttgctcttatctctcctacttctgttttcaatagcataactctgtgaaaggttttggttttcgatgaaaagtataagaattttttgtggttccagcgagattacatgttgacgttgttcaatctatatggtgatgcattttttaccttttcaaatctagaagaaattggaggagatgatacttatttttggttgtttattttttaaaaaataaagatagtgattgtttttagccgccgctatgtaaaattaattatattaaaatgcttatatcatttttttttcattatatcttgtagttatttcgctttggtacattaaattttaaaaatttcattttgatcttttatgtttcgaaacgtatcattttgaacatttttaaaaatttaaaaattaatagaacactagtgtttttaacgggatattaaaaatgatcaaaatgatacatttcaaaagcataaaagacaaaatgaatcttttaaaatttaatgtactaaaacaaaataattgcaaaatataataagccaaaaatgacattaagcctaaattctaagatataaagatataattttttaactaatttaaataatttattaaaattattgttattttgcttgaattttcttataaaaattaagatacaaatttacttagtaattattgtattcaattttattttatgtttattttttaattaataataaatcgatttacttaatcttattaaagctttattattttaagtaatatttattaaaaaaaataaaactgtatttatattgaaacggagataaattttgacaatgtttcataagtaatatatacataataagtatttaatttttatatgacaggagtgtctggcaagacatgcaattggggggcttataagtttagtcgactacttaagagagagaaaaataaaagaaaataaaaatatttatttaacatagtagtataatgaagttttttttaaagaaaatatttgtttttaacataatatatatgttaattaagattattttttttatttctgtctgagcggaccatgaagttgtgaattgtgatattttgttatcaaaagacattgcgaggctaactttaaggccgagaaataatgattagataaagttataaagtccacttaaaaccacaaaacatgaaaataaataattttgaaagtttcgaaggattttactattattattgaaattaatttaaatagacatcatatatatatatttcaaatttgtaaaaaaaaaattaatttcattatcaatttattagtgttaatagggtaatcgatttacatacaactttacatcaaacaatgtaaatatgtatgtgaactgtgaactgccccacaatcagacaaagggcaagcttttacaggcacaaggaatcaaagaaaaagagaaagctagtgagcaaggtaaagaaaagaatggggatccaagatgcaacctcccatttttaatgcagccagccctagttttttcttctttcgatgattccaatgcaacagaagttcaagtgtctccatctgtacacaagaaatagaaatttacattttttttcttcttaaaactttaagtagcaattactttttgagtgattagcaagtttgtgtttgtgtgtatggaagagtattcatatgattgggctgttgagttgggttgtgaaacctcttcgtcaagggatgcgctacatatatcatataaatttttaatacatcatttatgaatagtgcatttctaaaaaatatgatgttctaatcaattgagctaatagaccaattatgttaaaaattaattaatattgatatatatatatcactaaatttatttaatttaaaataatttaatatgttaaaaatatatgtgtattaaatatatattaaaaaatttagtattatatatatcaacattaattattttttaacataattgagctattaatttatagtttaaattatatgttaaaaaatactttaaactataatttaatagctcaattatgttaaaaaataattaatattgatacatataacactaaattttttaatgtatatttaatacatatatattttaacataataaattattttaaattaaataaatttagtgatatatatatcaatattaatcaatttttaacataattggtctattagttcatttggttagaacatcgtgttaataacttaaaggtcacaaattcgatacatataaaaaaaaactcttacaaattggagaatccgtaaaattcttacggatttgtcaatccgtaagtgtgaataatacggatccgtgtataaaaaaatgcaaaaaagcgaaggataattttggaaatgcactgttcataaatgatatattagaaatttatatggtgtatgtagcgcatccccttcatcaattgggctatttgggtccggcccaagttgccttaatcagtagtgcactttgtttgctcagatcagggacaccaaagtattaggcctttttcataaggcttcattcagacattcactactttcggctttacaaagtaacataattatgatcaacagataatacaacaataagaaaactatatatccaacaatcatgtacaatcacacttatttaatacagatattttctggcagtggaaaatcctacaatgaatgtaatattttacttttaaaaaaaattcttaacaatgaatttttttccgctaatattgtataaaatttaaaagaaatcaatttcagaaaaatacaaaaagggcatgcaaacattgcagggatggctggacccagaatgcatgtagttttaaagctctttttctttgttggctcttattttgcataaatattgttgcctttgtcttcgatcctagatttccttcttctttttcttttatatcatgggaatgccaaataaaattatgagaagcgtatacaatatgctagctgcttgtcagatgaacataaatactctggtcgagacattttgcttaatctactgacatttgctctaatatactagctttcgatctagtaataattatcttctatagttctgtgccatactctatagacattagacatgagatgtttttttttttaaatataaatgatatagaattctgtttctaggttagtttagtagtacttgatcttggaatggtttgttacaatacataaacttgtagtccacgttaatatattcgtatttaatatggatgcaatatatattttatttagatttttcagctttgcaatataaaattgtgtgtacgtggacaacctcttaactgccacagattttgaagtaagtgaccaaatctcaacacggttaccgcattgtttacacaaacattaattagtggcagcttatgacgtttctcattgaatggatatctatcaatcatttcagttggcaaaagaaaaaggaaccaagagggttactaaattatactagcatatactatgaattattatttgggaatttttaagaataaatgtgtagaattgcataagttttttactaggttacctaattatggactgtttgtaaaagtacttttcaagattttctattggaaatataaaaaaaattttaataaaaaattctcaaaaacacttgtaatcttgtatctaaacaaattctataaattataatatataattttttataataataacttaaaaattaaattaaacatgaatttaatagattgacaatgtaaaaacttacactaaccatacatatttactaaactctgtttttagatactaaaaaaatagtactggacaaatataatataccataattcacaaattaccaaattctttaaatatgttttcagtggtttagtccttagatctatctatatacaagaataaatatgggaagaagttaacttcttaaataaaccttagtatttcaagagattacttattatctttttaacagaaaattttttgggaaaaaaaactgtctactagagaatactctgggttccaaaaaaatacaagtaaacatcttttcaataagagtggaaataattaataatatatgaaattattgaaataccttaaaaatatttaactatctaattaatatgctgggtgaaaaaatcggaggttacttatttttcatactttaatatgaataaaaacagatacatgagtgagaattgtgttctggtgtcagtcataatttcatatacgtcaacatacaccatatcaacctcaatgtcacttttgatttgtgctttttcgtcgaaagagctagggttcaatgctagcttcagtctcatgccaaacttgagagggttaaatgatactgatctcattatcaaactcttgtgacagttgtgagaaaacaatgtactacacattcccaccactcaattaatatggatgacttcaaattcatgaatatatataaaggtgagtgatactttaataatgtaaaatgtaaacatattttcacaaatattgagttatccaaaaatgacatacaaccacaacacatccctactatccttcaaacccgcatctataacagaacatttctcgttcgcatttagaaaaaaggtttttagttaaaccccctttggtcaatcggccagtgtagattattatcattatatgaattataaatgaacctgactgctgataccatatggaaggctttgtactaaaagaattaaataattaacttaaataaaacaaggtgaataattaaaattataaggtgacatagtaaaaagggcacaaggaactataattttactgttagttttgtatgaatcgtatacaattaacaaattaatacaagtatatatcttgaaactaattttcccgagcctcctatgcttgacatatatataacgtgtggagattacaatagagtacaaatttgtctacgtacgcatgcaatggataagacgaactttgcttttagatggacccagcccaatcaaggtatacataatatgcaaatatagacaacaacatattagtgatcgtacatacattccccaccaaagcacaacaacatcattcttcttaattctagccctaccaagggaaccttctcaattctaagagattattttttcccaaaccgccccatctgtctgcatccttgactagaaaaccacccattaattatcttgtactactaccattttacatattgagctccatccacatgtagaaccaatcatttaacttgggatttaagcaaggaatagagtaccacaaactacaatgcatatgatggcttgcaaaagagagaatagggagagctgacctggcgtatgagttggagttatcttatatgttagggtgtgtcaggaataaatgatgtgtaatgagggagggcctacagtagcattcctgaaaaactaccccaccatgaatgcacccacgttgtagagagattgttacctccttttcggcctcattgttatttgttaagtatgattgaatctcatcacaaatgtgcatgatcagatactactctatcttttcttctataacaatgatatcaagagggataattaaagatcatatacacaagtcaagaaaagagaaaaagcctcgcatagtaatattgattaataaaagataagaaaataatgtatatagtgggttgttatactaactattgagcactaacaacacgtaattaaacaaaccaaattgtttatatatatgagaaatttagagagttctaaagttgatttcgaactcaaaaaaccctaacgattctcttatgtgtgatctaattaaagaggtcacaccctatttattgaatgtgattagacctacatgtctaaggcttacttgttataagaagtccttaataggttgatgcacatacattctgcttaagtgttgagcccgaaagacataagtgtttgttatgtttgaccaatttatccaaataattgacagtatctctcaagtcttgagtttaaaagatgtaagtatttgctatgatcagttaatctgaatagtccacatgcttcatcttctactaagattttttttttattgtcttttgttgctcccccaaaagttgcgttactttggtttgcaaggtattttataataaactcacaactaaagatcgttgtttttgtcttgtagtaaattttttgatcgactcttcactaaaaacaatctacttaacataaagatttcatttcaaaattcatatgttttttgtgccttcttaacactagtgttaaaacaacaaatcatttaattttacatgctcatttccatatatatggtattaggaaaaaaaaatatgctttgttatgaaaggtttttatgactctatcaagatgagtaaattctcactttcggtcacattttggtgttaagaaatataaggactacaaaaatattttggacactcttatagtaatatatgatgtattctttatgattgtcttaacaattggttatgaatttatgctaaatttaaaaatgttataacgggttattatagtaaaagaattttttttacctcaaatttttaggcatcgttagcatcatctcatatgaagtattgtctgatttgatatttggtgatacattatggttttgttattagtaaaaaggtgccttagtggattaaggggggagaatatttataaattatagttgatttcgattactaaatgatgtgagactttagacatatcaaaataagtctttaattgatactaagggacaagagtgatttaggtgtttcttttagtgtcaatggtttaatcttaaatcctcaagtattgttatgatcatctcgtctgacataatattcacttccatacttgatgttacgtcggtttcatattttctaaaaggaagttcaatatgttaagggaggagataatttataaattatctttgaccctcacctcttaaataatgtggaacttttaaatgaacaattttgtttacctattcattacatatattataaaaattaactttttcttccgtgttaatgtgcatgcaacttattaaattttttttatcaaatattattgttattatgggtaggactatctcttgtattccatagtcaatacattttgttttataaaaaaaaaatgtagattgattaccaactgcatgaattattaataaccgagactagaattatatattttgttttcaaaattgaacccctgaccggcagtttcacctgtatgcctaagaaccaacatggtgatcaatgattaactctaaaagatcgtacaaatttagaattggtgaaaatcggtaaaaaaaaaaaaaaannnnnnnnnntattgtattttattaatatttttataatatatttaatttataattttatgtgtgctttgaatattaagaatctacaatttaatttttttataaatattaagaatctaaaaatgatattttattttaatttttaatgttaaaaaattataacattatatttatttaatattattttatgcattaattaattattaatattttcattaatactattttaatcacaaatcaaaattgttaaatcttaaactaatgtctttatgttggttgaattttaaagttactgacatttttaatatgctttttattgcacaaacagcactggcggcggcataagcttataagttataacctttgactttaaccagtgcaccgaaaggtacatgctctcttttttacttttttatatataaaatgatttccattccagtataaaataaaaaaaaaaaataaaacactacttgaattatactactttataaccttgtcactaatttcagaatttgttagctttatgctgcgtactcgcacattctctttctcaataccaaaaactgtcaggggcactacagttatatttcagttgatataatttttcatttaatgaaaaaaaaaattattaatacaatttatgtggatatacactgaacattgaaaatatatattagtttttatttcaacaaaattatttattaatattaatttataatagtgaaaatatatattaattttatatcatcatactaatattaatattttattttaattccataaaaactatatcaaattaccaagattaattcaatatttagtatgacaattattttataatgcttcttcagtaacaaagcttgggggatcatgttcagtgcagtgcataaagctaactttattttggttacataaacaacatcactatatcgatcaaaagactcaaaacaaacagattgacgtagtaagcattatatgatagaaataatgagatctaatcatgtgaatgacgcggtgtataagatctgattgttgggaagtggaacgcaattatatttttttataatttgcaattatttaagatgcacatggaccatttagcttattcatgcatgtttgcttctaatggacgattctaaataaacatgtagttcttgattatgcttttaatttacgaaaaccaatttattatccaaatgattggaaagatagaatcattttctctatctatttatttatttaattgcttctttaaaaaatctatttatttaaattgaatttttgttattgtatatctatttatttttaggttaaattataattttgaccctttataatttttaattcatgattttatttttcttttcgtaattttaatttaatcctatttttttatatttttttgttttgattcaaatgaatcatagatctaaaatattaatttaagataccatataaaattatttaattaattaaaatataaaatatataataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtaatggtgaactaacttaatgatcaaaattatttattttgacaaataaaaggactaaatgttttgatttaaaaataagaagactaaaatgacttatttaaaattatagaaaaccaaaattataatttagtttatattttaaaataatctctaattataaattattaatatattcgctttaaaaaatgagtgtagattagcaaatttcaaaaatatttagtaacttacatctatttatttatttttaattacaatacgttatcatatcataaatgtatttaagattatttgtaattataacttacttacacattatgaataattaaaaaaacatgagggtatgctaactaatatataacaaatgttcaaagagttgttaaaagcggaccattaccgagatattaagtaaacctcatgactatcttgtattggtcttgtaaagaaaagtaaggaaaaatgaagaatatgttttgactaaaccgaccttaacatgctggtccttagaatgtcccctttgctttgacttacaaaggaaaattccattgatgtagttcaaaggattttttttgacaaaatctcgtgtaactgttcatttacaatggaattcaaacgttgattttagataatttttccaccatttcatacaatggaagggaaaaaaataagttccttgaatcaatagttatttttagacatgctagcttattttgttccttccactgaagcaaggaattgcatacgaatgcttgccaaatgtacgaagactacaacttaaactaaaagaaacactcatcgtaagataagatattcgaggaagaagaaagaaagtatcaaattgatgaactgtatgagaaatagtttcagaaacgcacataagatattaaatattatattttggctcaatataattaaaatatttaattttaaatttttgttaaggaggcagagtagtagatcaattctgatgtgcgggggggctggccagtggccacaaatgacatatgaaatggataaacctgatatttattatttatttatttatagatttttcttgagtggatgggaataaatgaaattaatatatccaaaacaaaaccacaaatataatacctgaaaaaagaataaagatgccgcgatccgcgagagtgacctgatgacgtggcggatatgtgtggtgaagcagtgacgcgtgttgacgaaagtcactgttggaccccatcccctgatttatgggtcatccctaaggcaaacataccctttattgttcttttgtttggctttatcttcaccagctgagacttctgcatgcacaatcttgtaaaaggacaaaactaccccttccccattattgctattactgttgtgtcctactccctcttcatcacggtccggcaacttgcttgcttgcttgcaactaatctgtccgtgaccctcgcttttaatagatagtacttttttcaattgtttttaattgtaatagtacaaataatgcatgttcatgctgttcatttgttgtactacccactcgataactgtgttcctaacacaccctaagtttaagacaaaaatcttaatttgattttgcacaaaatatatttttaaagagaaatcagaacttaatcttaaatgtaattaaatctcaaattaattattaaattttatagtctatttaaaaaaatcaaaatttatgagattctttagaatttcattaaagaataaaaaaaatgcttaattttatgattataaaaaaatgtgttcttgtagttggatttaataaaagagactaattctttcaaatacattgaactgagatttaaattttaattaaaagagaggtgtaatatttagtctctgatataattttctttgaagaagtatagctgtataaaaaaatgtgcataaggtaatattgatgtttcaatttaattgataaattttagtttaaatttgaataagtaattattctaaatattcaaaagaaaatacttcatcataataatattctaacttgattagaattagcatctcttaatgtgttctgtgttctgcataaaaataatgtcaataataatgttgttttattttgtttttatttttctaacggtccaaatttcatcaattggagactaaagagaatatttccgagatacacgccattgttaataagtcaatcatatcaatgggcaaaagaatctaaatgattttttttctaaattatttataaatttgaaattattttcaaattatttatgaatatgaggcttttgacaaactatttacaaatatgggacagtgggtcgtgtccaaaattgggcgtgaccgaggcgcgacccaccagatatcgatacgtgttatgatagatggagtgatgcgcatataaattttggacggtcataacttttgattgggatgtccgattgagacgaaattggtggtcacacgctcgaaattaagaggagaagccctaagcaagttcctaaaggggacttggccaaaaattttccccaaaagaggcctctaaatgcctcaaaattgcgatttaatctttgaagccctaaaaaatttcttgttttctaattttttatctattcaattagtgaattgtaagctattctttatttatctaattacttctcttaatttcgagcattttaacataaaatacgtctccatcggacattgctacgagaaattatgactgttcaaagttatatgcatcatcaattttacagtataattttgttcaagagtcatggccacaagggttactctgagagctttgaacagtcataatttctcgtagcaatgtccgatggagatgtattttatgtcaaaatgctcaaaattaagagaagtaattagataaataaagaatagcttgtaattcactaattgaatagataaaaaaaattagaaaacaagaaattttttggggcttcaaagattaaatcgcaattttgaggcacttagaggcctcttttggggaaaatttttggccaagtctcctttaggaacttgtctagggcttctcctctcaatttcgagcatgtggccaccagtttcgtctcaatcgaacatcccaatcaaaagttatgactgttcgaagtttatatgcgcatcgctctatctgtcatgacaagtgtcgccatctagtgggtcgcgtccaaaattgggcgtgatcggtatgcccaaattcaggcgggaccagtcacgcccaattttgggcgcgacccactgtcccatattcgtaaatagtttataaacaaccccaaattcataattttttatttaatttgtatttttttgatttttttcccaatttctgcaacaattcacctcacatgcatagataattcaattagcattggtggacgtttgatgtgatataaaattaaaaatatttttttaagatattaaatatatttattttagtataatattttccatatgaaaataaaagctattccaacattctaaagaccaaaagtattgattaaattcctagaaaaagtatggattgaaatataaaattgattctattataaacatttactattattcatagagttttacgatagtttttaagaaaatatatttattactaggacacataaaataataaaattattaaaaatacttgtttttacaaaaaaacacttgttaataggacacaaaaataataaaaacacggggaaaaattaagtcaaaataatgataaattattaagataataattaatattattatcttacaatattagagatataaaataaaaaaatatatattgctaagaaaagttatgtgtacatctattaaagaataataaatacaattatagtaggagtatattgaggaaaaaataaagagaaaaaactcattttcgattcattacttaggaagctatttgatatttacgcaataattttttttactataaaaaacggagaaaaagaataatatatatatatatatatacgtatatactttttatttgacaattaaaattataacttttaattgaaataattaatctctctggttaaaattattttttgagttcacaattggattttatatttcttattaattccttttatatttattatataattatttctattttttgttatagtaaaatataattaaatagaaaataagtaatgtcatttgaaaatatcaagtgaatagaggtaatcttttttccttccaatcaaaccgaaataaccagagaagattggaatcagaagatgaacggccaagattgatgacccttgagatttccaccaaaattcacgtgcatgccatccacccaatacagcatcatgcagcttgggaaccagtgagtgaagatccccatgtcactggaagcggcgttcgctccccgtgcagtttagataatttgcgtctgcatggtctaaaatacgcccggcggaatcgcggagacgacaccgttcggaagtgggctccttacccacgaagcgcgagtttcccaatggacagaaaaggacaactttttagtcttaccataccaaatagtactaataaaaaagaaaaaggagcaataaaatgttgaatcttatcaagggtctttagaatattaattaaatttttaaaaaatttcaaaatttataagagcataaaaaattaaaaataatataataattttatgtattttaataaaaaaattaatttttaattaatatttttagaatacttatgcgtaattatctaaaatatttatttatgttcgttcctacgcgtgaattaggatgggtcccactccggtttgcagggtaacggcgttgtgaagggacgttatgaagagaatggaaaagagagagttagattagactccgtgaataacggggacgcagcttggattgcgggaatggaagtggatggtggggtccaacatgggtaacggctatttgggtgatgacctggactagaggagacagcatgtatcgtaagctgtcaagcaccaagttgcaacttgcccttcaagttccacggagattgatggacgtgtatattctgaaaactaggcaaaccaaacacaatactaaaaaaagtaaaatggaaagaaatataaataatgaaatacatttagttgtaagagactgattttaatgatcatgaaaataaaaagttgatccagcttataaaaattaaacttatatcctataaaataagtttaaattttattgttgatgaaaggattatgttgatacataatttataaatatttttataggctcaataaattttaagacatattcttctcgttaagttttaaaacttaattggtaaatattatgtcttcttatttaatttttttattttattttattgtgatgtttatcttattaatatgttttaattattaattaacataatttagtatattttaagaagtcattaatttcataatttataattattcttattgaaaaggtaaaacataattataatttcatttaagaattttagtgatactaataaatgaaaaatattattatggcaaattatctgtacattcttaaatttttaaagtgacaaatatttttaaattgtttttaaaaaatattttgaaacaaattaaaacatggaaagagatacataatataagatggatagatgataaagtaaacagagttcaattttaatagtgtcaacataaaaaaaactttactctattacttaattagaaattattataaacatgatttttacaataattatgatacaaatatgtatattgtttcaaaagaaatattttgttaaatataattagacattaatataaacatatatcttatttaaaaatgaattattggttcattttcttgcatgcaataacttaataattgaactaatcaagtagtaatgattaaaaatttataaatttgtgaagacgctacttacttaatattccttaatttggtaataaaatataataagaggacgtaaaattattttgatcatcaacttcatagtccataaaatctaatgcttagatgagctaaggttatgcttaactgacatgtatatgaatcatacgttttgattgggtggcgcgtcaaattcgccgccaaggaaaattgatagtcacgtggcgagctcactgaggcgccgaattttgaacgttggcccacgcaattctcattccttcggagccttcaactttttcttccatttaatgccctccctatcattcctattcacgcatttgccacgggtcattaatgtctttctactttgaattcaactgtgacacgcttggtgacaagacctcagggtcggttctgattgcctcatccagagtgcacccacatgccctaattccaaatttacccttataaaggtactaccacgtctctttttttggttgaatgaaagaaaagtagaaaaaatgaaaaatttaaaatttgaattataaagaaaatgataataaagaaaaattaattttttatatctataaaaataattttttcttctatttttttaaacaagcaaaaataaatattttattaatagtattttctgtcttttctatttttttctttcactttctttcttattaaactaaccattaaaaaaaatatataaaattatattgatataattttgataattattatattatttttataatttgatatagaatattattttaattgatcaaattattaaattatatattattaagattatttatgttaaattttattataattaaataactataaaaataattaaatgatctattttaaaatatttattttgtgtcgatttaaatttataaaaatgatataataaataattttaaatcaaataaaattttatatatatgatctgtatgaaaataatttttaatccaacaataaatttttaaaaatattatttaattaaaaattataaaataatataataattattaaaattatattattataattttaatcattctatttctttaaatatactaagaattaaaaaaatgtaatgtataaagttgttatcctttttgagagccaaaagcttgtagaatattattattttctctataatcattcgtatagctctgctgtcctctacttcatttgttcctttttagtacttttgtattattattgtcatgggttttgccactttatcccacccccaagccttcaaattttgaattccaagcttttagtagttttttttattttaaagcatcataaatcacattcaccgatgttctaattaatattttttctaaaagaattctttggaggggcttaaatacaagggtattcatccgttcaatgaattatgaaaatagtagttggttcaaattttgaaaaaaaataaaattgaaaagtaaaatgattattatacttaatattttacttcaactagcatgttattttaaccacttgcataaaaaagctagttttattaaacaaagaattgagtatgttactagacagaagacaaatataaacttgannnnnnnnnnnnnnnnnnnnnnnnnnnnnnnnnnnnnnnnnnnnnnnnnnnnnnnnnnnnnnnnnnnnnnnnnnnnnnnnttttaagttatatagaaatatatatttaacgaagattaaaaataggtataaattgtttaccaattattatttttttttcttataaaatatataatctagtcatttatattcaatagcatatctacatggaggataatgggagcaattgttcccacaaagtaattttttttacttaaatatattgaataaatatttttttactcctataaataaatagatattgttcccataaaataatttttataataagatgaatgtaaatagttataaaagataaaaaaaaagaataaattgatactaattttattcactttatccttttaaattttactatttttaattttttattatcattatttttaatgaagcttatataatttttgtttgagaaaatattagactatttttgcctccactaatttttttttggattcgtcattgtttatataatttataatatttattatnnnnnnnnnnnnnnnnnnnnnnnnnnnnnnnnnnnnnnnnnnnnnnngtacatttcatatattttctctacaaacaacaaaacaatttttttcttattcatctcaaattactttctcttatatctatctttaaacacactttatcttcttaaatacgtgtctctctcaatttatcctcttttatatcaactttatattgaattttaataatgtttaaagttaaattatgaataactaaaaatacttatatcacaatttaaatttattcactataagtctataactttaagatgtaattttaaaatacttatttattttaagttttaattatttaaaaatgttccggtgacaaaatgacaggataaaaaatgtttattcagtataattttgattatataaaaaaatattttacataatataaaaagtaaaacattacttacaaacaaatgtacacatggctaactaagaattagttattatcttttctaacatgcatgagccatattactgataaaaaaaaacatgcatgagttaaattaacgtttagtaattaatttgagaaaaatgaaacataaaaaaactgcagaagaagaattttccctgtccagattcattttctgtttcagttcataaatttattttttgcagaatgataaacagggtcaaaagaaatgagcgtggcttaaggcagaaggggacagagaggatatgttaactttagaaacagagccacgtgttgaagcctttgtcaacaagtctttgtactcatcgaaaacaaaccagaaaaataaatcatacagctgagagcttgttgtaaaatttgtaacgtatttctcattttccacatcaatttaatattcatcaatgaaaatgagagtttcaattaagtactacatttctcttaaaggaacgtcaattaaaataaataaacactgtagtatttgtctacatttggacacagctcaacacagtctcacgaatacaaataagcttcgtttggccgtgtctttctctctaaccaagcccttttcgcctcgctctatcgcttctagctgtagagattactattattccaaacctctctctttctctcaccatcacccttttccttcttcttctcttccttgcaccactccttatattatctcataaaaataactcttgggagaaacacaataatcaatcatggaagggtctcacatggggttgttgctcttcttttcttccatgctttttgctgccttcccttctgcctcctccagaaacttgcctattataccctttgatgaaggctacgcgcccttgtttggggacagcaacttggtcatccatagggatggcaaatcggtccatctttcactcgatgagagaacaggttttttattttccttttttttttttttgccatcctttgtttttggtttggcaatctatgtgcagttgtttgttttttgttgagatggcgatttctgtggctaaagtcctcacctttttgttttttttcctttccatttctggggtgtgtttgcaggttcaggatttgtgtcgcatgatctttaccttcacgggtatttcagcgcttctattaagttgccttctgattacactgcaggagttgttgttgccttctatgtgagtatttttgcctcaattcggtgattatatgaaagtgatacccttttttcttatttatgtcccatttttttataaaaaaaactcaatcacccatcgtcatcaccagcatacgtgtttttctgttcaacaaagatttctccttcacctcaatcaccaagctttttttgtctttttataccattttttcctttgtgtgttttaaatcactgctagtatacttcaattaattagtaattttttttgtgatttgattataaatcacatagttatcagttctcactttcatttttaccaatggagaatgaaatttaggatttttcagacatttatcaaaacaaaatttaaggacttcttacttgggcaaaagtgtgcagttttgtttgtttgaaccaaaagggtcattctggttttggtttgaagtcttaagttgcatatccggcaaatgggaaaagagtaattaatttatttcatcacattatctacttgcagatgtcaaatggtgacatgttccagaataaccatgatgaaatcgactttgagtttttggggaacattagaggcaaagactggaggattcagaccaatgtatatggcaatggtagcaccaacattggcagagaggaaagatatggtctctggtttgaccctgcagatggtttccatcagtacactattgtctggacagactctcagatcatgtgagtctctatctacatatactatatttggttctattttgcatgttatacacttgactattgtatctatatcttctctgttatagtaatttttttccatcattcttatttgttatgttactttactattacctcttattctcattttgcatgtcatgtcagtaatttgatagattatattgttttgaatggtgatgttatattcaaaaaatttcctgtagttttcttgttccctttattaaatcccctgtttgatcaaacaacctgtttccccccctcctgtaatggtattttgtattatatgtgatgctttggctacttggttatggataatgaataaaaccagatactaaggtcactaatattttaattttaaatggtatatattcttttagcactcagaataatttgttttctctacctaaattcataaggttgtaaataatatgttccttgcatggatttttgtttttcttattcaattatgctaatttctacttttggatgtcacttgttgcttacttattttcataattgcgttcttgcttatccatgtgcagattttatgtggacaatgttcctattagagaagtgacgagaacagaatctatgggaggagatttcccttctaagccaatgactttgtatgcaacaatatgggatgcatctgattgggctaccaatggaggcaaatacagggttaactacaagtatgcaccctatgttgctgaattctctgaccttgtcctgcacggttgtgcagtggatccaattgagcagcacgtggccacgtgtgacaatgctcaaagctctgaggcaacaattcctccttctggtgttactccagcacaaagaatcaaaatggagaattttaggaagaagcacatgacatactcctactgctatgacaaagtcagatacaaagtccctccttcagagtgtgtcatcagttcccaagaagctgagaggctgaggaggtttgatcccgtcacgttcggtggtggccgccgtcaccatggaaaacgacaccgtcgcagcagaggaagccagacagaaactgctgcttcatcattttaagagggttccataacttccatttagtttcactacctggggtttatattttcttcttttaactttggtgtatagagaggaggggcatagaattcttgaatatgatgatagttttgatatggtggttattgctggtggtggggtatgtgtatagttcatacctttaggttctcccaggtaatttgtttgtcattcatgtcttatggtttacaaattgaatccgttgatttttgtatttagaccacacctctgtttcaataaactatttagcataagttatctatggaatgttaggtatgaattatttcttttaactgctaatcatcatgtatataaaatgttggtgcaaccttttttttattttaaatttctctcgtccacaattgtccaatatacacacacctgtctgatagtttatgtggtcatatttgtcagttagacttggacatgacagttatttaataaatcttaatgagaatccaaggtcaagctgaagaatggaagtgttgctgcaggtcctccacttaattttgaccacagtttatgtcttcactttttttcttcaatgtgttttggtacttttgtaacgttctggtgtattatgatggattgaattgggtagttgagatctctatggaaacattatggctagtttttgttgacttgtgtgtctgttgtgtttaaaaaaaaaaaacatttatttttcactttttaacaattgttcttgggatctctgatctcactgcatcttggtaattactaattgagagatttcacaacaataatttttatcaagtagaaagttaattataatagactgaactatgaaacggaggaaacgagttatgaatttcaagaacatatggtaaattcaatacaagttttttgcgtgcttaggttatcaatgcaggttacttaatgttaagcattttttggccgccaagatatttgatgaaaggtaattaatcgtaaattttttaagaaatttccatgtaactttgtaaatatgattcatcattatcaaatatcaatgttagatatcctagtaaatgataaatttttttcgtacaagtaactgaaaggtgatccactcttcttttgaaagcaattaagataagcgattacacctgtctgtagaatatccaaaaaattcatagcaaggcgattttatctaaggttttccttgaaaagcaacattgctcaattgctttaattagattgattaatactaaagcaaatatcatcccggcatcttgtgtttcaccttgtagacattcttttacgcttttcttaggaagatgagggagaaatttaatgatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatgcctctcatacatacgggcgtattttcttatctaatcactcaagtaattttttagacttttaaatttgtttttttaatatcttcttatctaatcactcaactatttttttagatatttaaatttgtttattttatactagttttttgacctcttaagtttttttttccttcattattttaatatctaatattatcaagtgacttatgtctattatctaagtttcttttaacatctttggtaaagaccttggacataagaatctttgaatcaatctctaccaaaacatcttcatttaacttgatttcaatgaagatattttcaacttgactctagtcaaaacattcttagcttgacctcaacagggaaatcttgagtccaacctcaacaaacacatccttgatcccgacatcttgacttgacctcaaccatgacatctttggcctagtctcataatgtatgtacatgatttatctacaaaacacttatataccattacataaaaatgaagataaaataattaaagcttaatttgggttgccattggcccatgggaccttgtaggcttttttaagtgattttttttaatcattcacatgaaactgacagctctacctccataataaacataaggctcttgcaagctagtactctaaacgcattggttaaaaaattaaaagagaaaaatatatttgtgtaaattataggagagtataaaaaagatcatgaacaatataattttttattttctaataaaaatattttttctttaaatttcttaatcaatatccttaaaacattcattaatatttacttaagcttaaacaactgaacacccttctaaaaggtattaactcatattagcctcggtaatcgacaaaactcatgttcacttacatgcaagcttggtattatacttttgtaaaaacctcaaatattttttatttgaaataattttgattatgttaggtaaaattattataaacattattttttaaatatttaatgcaattatatatttaaattcaaactaaaaaattaatagaaacagtccaataccaatttatcaatccacttgatttggtagtatttaagtcgtatggatttattatagggagaatccaatagttaccaaaagacgacaaaccgaaccgagattctgaaccgaccattttaattgggacttttttttttttggataaagatttcaattgtgacttgagtgcatgttttgttatctgataaatctaacgttaaattacatagtatattgaatatgaaacataactctgacacaacctaaacatgtctttattaacaccatttaaaagtttcgtaagcagaattttaatgtaacaaaagaaatattttcgtcaaagcattaaaaaatttgaaagacatcattcatatcatacaatgaatagaaaacatgttacttagttctgcatagtcaattccgcgggtaggtatggagtacaagcggatacgatgcaagacaaaagtgacaatcagaattttctctttctttctttctggtatcatgcattactaattactattaattattgcatctcaaattatttttaattaataatgcattctggaaatacactcaattaaatattttcatcaaatcctcatcaaatatcacataagggtttgttattaatttgagcatggaatttattgaaataagccaagaaaaaattattttgataaactactccctctaatcttaaatatataaaaaaaaatccttttcttgatttcaaatattataaaattttaattaactttatcttatttaatactattatataaaatatcattcattaaattaaggtgctagtttcaatgatttttttttattttttatatcaagttttaataaaagataagttgaaaaaataatttttaagtaaaatttatacaattaaatgtgattagttaactttctttaactaacgagacatttttttttatatatttgagacaggagagagtacaccacaaaatttattgaaataattttaaaaatttataagagttattattaaaataagtttccctgtaagtttttttttttgaaagcttaatatatatatatgtgtgtgtgattaattaaatatttaaattacgcatactttaaataaatgaaataaaaagtactactgatttaggagctaataaataattttaatcagaaattatagctcgattatattgataacactttttatgcaagttttttacttttaaaattattcatgatttatcattaattattaaaatgattacaaatgaatgcaatttgtgaaaagtttatagacaagtggagttttaatagttgcaatgaatccatttgtaaaccacaatcctattgtttgccaaccaggtttgaactggaggaggcaaaggcaatagtcaacttccgtcatattcatcccttgagccacatatgactcataattattccagaatcactcatcatatattattgtcactgaaatccttgtgttgccaaatactactactgcatatttccatactgggacgaaatcaaaatctcttcaactactactgccaacctgaaattttatcacggaatcaattccatggcctccacaaagatttggacctttaaacttgtgactataatactcaattctgttctagtgatattgcattgcattcataagtgaagccttcgttcaaagcatattgttataacatgagttaaaacttaaaagaatatctgatttatattttgtttccacccgcctttttaaatagttgcaatcaatccatttctaaatcttttttttttctttcacaatatttccattatttatttatttccccatttttttcgtaattggcttcctaaaagttttgtcctcctaaatatcattcctttgtataagacatcacagtatgacgaatttcctcgtttcaaactgtacagtaaccttttattctctcttgtttttgtagaatttatagacatttcagcttgagttttatttcccagcaggcattagttaatacagtgctatggttgagttagactaaactattcccttgtggcttcgtatacactttcaaagctaaaactatatatcgttcatgtatgtaatgttaattacccaaggccacaatattcttattattctacaatgaaccacaagcttcctctcattctataagcttatggacaatgccttgccttcgttttttatttgttatataatgctattgggatgaaattgtactccatgtaattttgaaagaccagtgaaactaaagtgataattgattacagtaatgtgtaaaattaagaattttagataaaggcaggctaaaaaaaatgaatgagcttcaaatcatgtggagtaactctttacagctagctaggactgtttcagactttcaggtgagtatttcatttaatgtgatcttaattaaaccaccaaagtaaagaaacttcctattctttttatttttttaacccaaagcacatgatattaagagttcaacctatatacactaacaagtagcaggggaattaaggaggacaagataaaaagggttggaaagatctgaaataaaaaaagcctattaattgcacaaagcgtgacttacctgaaaaggtttaacagatggtggatatgcaaccttaccccctagtgcaaagaaagtttctgtgatttgaatttttcacctctaggtccaaatacttgccctctggggaaaaaagggtctattaactataagaataatttatttccaggaagagatttaatttgacaaaacaggtaaccgaataggttgatctagggggaattacactagtaagagttatttaggcttacgaatgtaagctctttgaaaacttatttcaataaatttcacagttaaacttaaaatcgatcaagctctaatgtgataatattgaataccacttaataaagttgtttgccaaaatgtgttccgtctagaaaatttactggcaagtaccagaagttatacagagaataagctactttattaggctagctgacaaaaatacttcgggttaatttttatatatagatagagaatggacaggaaaatcttgacttatacagtcaaatacaccatttatcaagaatgaacctgaatgaacctgattacactatttccctcaatttactggtaaggacaatgaatttttttctagctacattccaaataaatagcatgatgataatttatcctctcctatattattgacaccacaccatttttggtaagttaagccattatatgtatggttcaaactgataaattaatcatcaagtaacaatactcagctaatttattctttgtaggaggatattcttttatgttcgatttatgtattgaaatctaaaacatcccatcattcagttcaagatatgttgtacactatgctgatacaaatagtagaatattatagttgatgtataagatgttggttgatcttagtgcacaataagacaattagtggagcagcctccaggaactacaagaaggtacctgtagatgcctatatttctggtgttataatataagaacatcctctacccaagctgttacgtctagctaggctcttgttcttcgtcaggaaatgtctccttttcaatgacaaggctgtaaggcaagaaaggactgaaaatgacatcgagacaatgaggccaaacaatgtcagaactaaggaatagcatagactgaagagaatgtagtagctgaataaataaccaacaaccaattctatgacaacatatctaaaaattacaagcaacaaatattatcataatacaaacctcaaataagaccatacttttgataatattaatccagcaaataatccatcttctccattctcatcataatacaccaaacaatttttttccatgcatgacatcaaaaggagaatgtaagggtcgacccaacagaaaatgaggccgaaaaattgataaaggttaaaatgcaggatatgcttgctgctgaaaaatgaaacccaagtttccacctgtgagaaaccacaataaaccataatagaaacagggtagaagagagaaaaatagggaaagaaattaggcaattgaaaactgattattgattcaactaaaccacagagtcagtagtgatgctagctagtcacacagccaactcagtattatgatttatgacaattgtctaccgttgtatatatcaccagtctgaactagtaaaaatatgttgaattggccttcagttcagttgaatctgaatgaccacagtccgcagagacatggattcgggttggaagtatactgtaaagcagaaaactagtaatagtgtgtttgttttaggtgaatccttgtgtctccttgaattcacgttcatcgtggttcaacagattcgtataagctatgtaactgattaactttctaactcctaggttgataaactaaccatgataaactaacgatgacaagagagaatgacatactttttttttatctacaaatgttagttgtcacaatgttaattttgttagcagagagaatcgaataagtgacctttttttcccttccttctttcttaaccattcaattcaccttatattttcagaataacatactctaacacaccagtaaaatgtaatgatgaacaacacacaaatatatcaagaaaatattacactcaacttatatgcaccaaatatatcaatggctaaaaggcttagctaaatcctagagggatcacctccaaaagttgccaatgcacttcaatcccatgcacacaccaaacatattaacaaaggtatatttggcccaagttccacaaccgtttgcaatggcctgtgtacgggtcattgcaaagactattctaatatttataagtaaaacacaaaattttggatttatattgtttaaggaaagatagtgattaaaatgaaaaggatataatgattactttttcgaaaattttcttttagaaaacaaagaacacaaagacaatgaaatttatagttaacctttattatgagagagtgagaatagaggccaatcataatcatgaaaagttcagattaaaaaatagtcacgcaaatttcttaagtggtcatgtaatcattaaataacttttaatcttatctataaattcatatttactctttttagcctctcatacaaatgctcttgtcatttgatgtgtcacacacacagtcatataattgtagtgaagctattaagatttgggagaaggaattctatgattgaattgagtaattgactgagttcataatacatgcatggctcatgtacgtatatatacagatacaactctcgtagtgtaaggcaattgaatcaagctggtgtaactaattctgaccatagagaaactaatggttaacaacaacaccattattcatttcccaataccccgcacaagcttaagggtatattttttaacacgctcaacttagcaaggaaatgtgcaaagaaagagtgaagggtccaatctaatggcttagtgatgaagttggccagttgattgctagagaagaataaaaacaaacttggactaaagtttctccacaatgtgacagtctttgtcaatatgtttagtctattcttgaaaattagaattagaagcaataaacgccttactgattgactaccacagtaaaaaaaaaaaatagcaaaaatgaaggagacatgaagattgtgcagtcaaccagtaactgatcatgcattatttattttgaatttttcgggttgcgttcgggtcacgattatatgatatgatcagtcctggcgtcctgcacagaatatgttgaatgagaaatcttacatcgtttaagaagactttaactaagattttaattaggttgttatatttaagtgatgtggtcatgtgggtatgttagttgtaaacggtattgattttaacacatgacttgttaggtgtacctaattctaattggtcacgtttcataaaattgaatcatgacaattttataatagaatatgaataatagaggtattggtttagatcagttttgagccaaaaagtctttggatcaaaagattaaaaaaaattgtgatttgattcagtttggattgctttcttaaaataaaataataacaaaaaaaaactgatctaatcctataaaatgttgcttagattaattggatgatgatttggtttttcctggtacatctttaccggcaatttaatttcctattattagatgtctttagctttactaattgttaaattttatagcatgatcacagttacattttatatttaaagtttctaactcaagtatgtgatcctaaaatgtctgccttgtttcatttaaatcatctatacttgttcataaacttaaatcaacgtgtaatactatgagcagtaatagaaagatgaatgttcgcaattctctttttgatattctttttttaacatttttttattaactgaaatttattaaaaattatcaattgttgatgaatctaacttttcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatataaataatattactctatagaaattctaaagagaagcagtaaatattaaaaataggataattataacgttaaagtgatcaattttttttaaaattagtaatctatatatttcttaaaaaatattttttattggtttttttgcttaaacttgctatatacaagattacaaggcacatgcgaatgcattgcattttttatgatatacaggacaatgccagtattttcaatgtagtaatccattgattgaagttgcataattttaatattaatgatttttaaatgagtccaactatggtatattggtttttctannnnnnnnnnatatgtgtaatacaatttgttatactaactaacgcgcgctaacggtgtagtaaccctttttgatactatcagctaaaaaagaaaaagaaaaatccctttttggtacaattatttactaaagtagtttaaacatatgcgcgcatgttagagatgcttttaagttttaacactttttcattaggttaatgtcaaggttattcatgtttgatttcttttttaaaggaaaaaaaaaactggaaaaaagtagggagaaagagagataaaaacatttaagattaacatatatattaatgattataaaatcaataattatcctaataaaggaaaatcaataattaatattattattattatttccataaattattatacatatattttagtgaaatgaagctctgttcgagtttctccattcgaattaactggtacgcaaacgcaatttcattgtaacacaattgaattataaactttcactgttaagagattttgtgggcctaggataaatgcataggtttgtacaagtggaaatgaatacagtaatgtgatattttttattcttatttaaatatacttttaataaatataaaataaggttttaataatttgatttcgatcattattttttttataaataactttggttcttgtaaatattttctttaaaaaaaagtatactttgcctttttagtgatgagatagtatgcagtatgcatttacttgtatcagtacacttgtaatgatttaagtaatataattagatgtatgtcatgtgattattaagtagtaattggattcgggctatgcagcaaacaactcatggttatggtggtctcaacctgattggaatcacattaatcattcgtcttagcttagttttttttttccaaaaaagtattaagtagtaatgaaaattattttaatatttaatttagtacttatttattaaatattaagaaaattttataagagagtataatgtaccgtaagtcttatttaaaagagtgtcctcgaaaatcgcaattgattatttaaacaggtaagaattaagtaaatgtttgaattgaaattaaaaatattgtgtgtacattttaatgtaaatttaatgaatacaaaaataagagtttgacaaaattatttttgtttcaaaagtaacttctttttttttttatattgaaaatcaagcatgcactgagaaggttgtttccaaagaagttcatgcagaagagctcaataaggtatggctaattagtttactattattctcaacacggtatgaatgaatatgcgccataagcacatcagttattccctttataattagctcaatcacgtagggtaccctcaattaatattcaaattcaaattacatactagtacaaattaggagtgtttgtgattttagtttacatttataattatttaaatttaaatttaactggattaatatttgataatatatgagataagatagcttcaattttatttattgacataatatattgatactaatattatgtttgataaatcacaaatttaaaaatataaaactaaaattaacatatatttaaaaataaataaattttatataaatattttcgcgtgttatgtcaaatgttattttattaagtgaatagattttattattagtatgtaattattaatacacatttaatacaaatatagatcaataggtctagtggaatgactcaaaatatagctaaaacttattcttaaaatatattggtttatttatttttaattcaaatatgtaaagattaaatttaagccgagttagattagtgaaataaaatagattgtgagtactcttaatataattatcactctctctttttgaagaatttcatccataaactataaattattttagtttaatgcaagatgttagtgtggaaagttttatatatcaactaataaaaaagtcacaattagggagatagccataatgaggtcaattgattcaaagatgaattgctcaagtatggtgtagttttggtcatgcacttaagaaggttgagttttggattgtaagcatataaaggaggattgtaaaagaaactattttacaaatgtgaggttattaaactcattagggatgagggtgaggtgtgtatttatatacaaacccaactccactcttgaaaagcatgaaaaaaaaaatcgaagctgaatctggtcaaagtggattttcttatcaaagtcaattcattaaatgagcactcacaattttaggtgtaattgtcatgcgtaaagacactcattatatccgtctaaaaaaatacacgttctaatgtaaattgctattgataaacctttttttttttttttatctttgactgttggaaaatgatgcgtgggcttgtaaacatctaggaaagaaatagatagaataaaagaaaaaataaagtgtatataatttaccaacgacttgttgcggctgagtttggattcttaaggcggttgatagaaaatatcttactgaagattgttagctagaattgcattaaaaatatagtgattaataaaatcgattatagttcacacctacatggtataaaagaaaagaagtatataattcatacatatatttattttaaacacaatgcgctccttcttcaaccatacgcttctgtctgtgtcaaagcataccaattttctcatttctcaagtacttcatttttctccttgatttgtggcgcataacgaatttgcggaatccaaaaccagaagaaccgcaccttgataatggccctaccctaacttctccattctatacgttgcattgaacatcaaaacttgtctcaacaaaaacttaagtccagttagggtggtttttcgttttttttttaataaaaaaatcagttttaatttttagttttgagtttcgatttattttttatttttagtttttagttttgattacaaattaaagataaataaaataagtcaacaattttattttatttcaccctactatgaaataatgaaattgacaaaggtagcaatttgtgataataatggttatgacaatggtggtggaatgaaacattggtgaaacgatgatggtaatagtgatagaatgaaaatggtgacgatagtggtggtggaatgttgatgctagtattttaaaattcagactaactcggtcggttgaatcgattcaactgtaacctaaaggtctggttggattgagttgcctattgaatcaactatgcattgatcctagtgcaacttggtacgactcagccaagtttgatatgttgactcaatgacctgggccaggtcatgtccaagggaggaaacacactaattaatacatgtcaattaaggtttgatataaaattttatcattttctaataaagattaggtaatgcaggtcaattaatgattgttggtttgaccattgactcagtgaccaaatgtcttgattgagttaatcatcgattttgtttttaaaattatgggtgacgacagggtggtataatggcaatggaagcgatagtgtgatggtggtggtggtggcgacgctagtggtgacagtgacaataatgatgatggtgacaacaataatgatatgatggaataatagtagcaatgatggaaataacgatgaaagtgataatgataatggtggtgaaatggtggagactatagtggtagtggtgaaaacggtaatggtgtagtgtggtgatgacaatgatgatggtgatgattgtggtagagacaatgatggaatgataataacgatgatgcaaacgatagtgatggtggttaaaatgattttttttttaactaaaaaccaattcataaaatattttttttcttgattttgataataaatataaaattattttgaaattgagttaaaaaccaattcaactttatttttatcaaacatattttattttgaaaattgaaaacaaaaaattgtaatcactccaaagaagaccttaggaaccgttaagtgtgggtcaagtggtactattccctttctacctcttgcattagtatttgttttagattttttggtacaatttgtttttgattcaatgaatatccctaaatatttaggggatttgtaaatatttattattaacttattaaaataattgctaataataataagatataaagtttaaacaagaaagactatgcactcgatcaaaaaggaaaatatgcacacacacacacacttttccattatcatcatccaattaaaaattattatttaagataagtttattatattttattaaattattttaaaatgttagatcaacgtttatttataattttttcatcatttatgataaatttattaacttttataaaattatttaaaaatatgatattaataatgatttataattaaataagtgtacaattattttatattataagtgttctaccactaaattttaaagttaatattaaatctctatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaaatttaaaatttatttcctatcaactgtcctctaaaatcaaaattctcatttttaaatctctgttaagttttttttatataaaaaaatagtttatgcaatacaaaagatcaatatttatatttacataattaaattttacaataaaattaaaatttatgataaataaatatttttaacatataaattatattttagattcatgataaataatttatattataatataaggttattttcaactatttgatacttgtatttttttaaaatattgagattggatttaaaaataaaagatgaaaaggataattgaaaaagataaatggttaagaaaattaaatatatagatgaagataattgaaaaagggtttgagcattgaggtagtctataaaaattgtttgagtcagtgttaaataaaataaaattaaaaatttaaatcgagaaatatatttaggaaaaagatgtataatatatgatattaggaagatagcatgtatttcaataagagtatttttttttactgcatctcaataagagtaataaccactctaaatgtgatttaataatttttttttattaaggacttccattgaagaataactcataaatgcattattattgaagatgactttaaagagtagagaattaagaaatatacatggtagtattaattttataattgtaaagtcaattactattctcaaagaaagaaggtttaaaaagaactatagtagttgttttaaaggcttaatctcaaaccaacatggctaaatatagaaaggggaatgaccaaaagcccccattttcttccagaatattctttgtaaaatccaaaatcagcacccaccagtcctcagatgcacagcaacaaatatatatagagagagagtgcgttgtttcgtgacttgtgaatatgagccaccatttaagactacaacacatgcgtgatcaataagccataccctttgttacacattcttcattaatctcaaccctagatcttcctcttcaagcccctccctttgcgtcatcccaactcaaccaccacttcaccctcgttccatcactcacccttttcaaaccccagatctctccaattctcgctcttattgatttcaacgccataccaaaatttcatattattcgttttttcactcttttttggccttaatcacttctggggtggtcttgtttcttgacaaaattgctgcttttttgctttatttgttctcaattctgcgtttcttttagtggggtcctcttgaattgcactgtttttgttataaactcgttgtttccttgcttagatctagttgtgtttgggtatgctttatatgcggttgtagtgtattgttgtaagtgagttctcatggcaatgccatcgggaaatgtggtaatacaggacaaaatgcagtttccaagtggcggtgccggtgccggtggtgctggcggagagatccaccagccccactaccgccagcaatggtatgttgatgagagggatgggcttattggctggctgcgaagcgaattcgcagctgccaatgccatcatagactccctttgtcaccatttacgcgttgttggtgaccctggggagtatgatatggtcattggggccattcagcaaaggaggtgtaattggaaccaggtgctgatgatgcagcaatacttttctgtggctgatgtggcgtatgcactgcagcaagtggcgtggatgaggcagcagaggcctctggatccagtgaaagtgggtgcaaaggaagttaggaaatccggttcgggataccggcatgggcagagatttgagcctgtaaaggaaggttataattctagtgtagagtcttataatcaatatgatgctaatgttacggttactggaggcacggagaaagggactccagttgttgagaagagtgaagaacgtaaatctggtggaaaggttgagaaagtgggggataagggtttagcatctgctgaagagaagaaaggtaaataatgggtcaatcagtctgtatgtatttatacatttatttgattatgctacaacatggtgaatcatggactgattgactgtcgatattaacagtgttttgtgttcattataatccaagtagtagtgaaatgagagcaacaatttatagaaagtccgtggagataatcagatcattttatgcatgtgtttgcatataaaaatacaattttgatgaggaaagtaaaagatctcttatttaagaatcattgtggaaaggctaggtactagcaggaattagtgtcaaactagaatacttgcaaaagacaattcatggagttgttgctgactaaaaattcaaatggtcaaatgttaaaattaaggctgttttttttttttttggttgtttcttatgatctggtgccttctgctatccaattaatggaaagatagaggataagttcactgatcattaatacacaagaaatgcctgcagtctattaacttctttgctctcttgcttgtgtgagcagatggtataacatcacatcaaactgatggcagcctgaagagcacaaggagtactgaaggatattggtccaacttagaatctgaagctgttgtaaatgatgaatgtatgtctaatcctaaaggtcttcttcctcctgacaatgatgatggtgaagatatattatagatcttgtttaacttaaaagagtttagggcagcagacgaatgctagttgcattgcattcatgaagtttaggaaccgagaaaatgatatttggactgtacccatcaccccctccttttgtcacatgaatgcaatatagttaaagtttgggtgtgaaataacacaaatgtaggtgctgactcttgtttgatttagagatacactgagagtcaattctcatgcagtttataatcatagttttctgtgctgattttttgtttaatactagtatttgtttatatcaatccttatatttataaatcagtcttcaatcttggatgtgaagacatttttattttattatattctcttgctctgtgtaacacactgacacatgaccttaccattatttagcacttatttttatatttttgaacattttaaaattattaattttaaaatgttcttttatattgatatttattttttgtctaaactatcctgttacattaaattcaacttctcaaatctcagctataattacttttaaatttttaatattaattttattttactttaaaattgattctttttatttttatattttaaatttgctcgctttctctgaatatttgtgttttagatccatactttttagttaaatgacactaaactcttgtgaaatgtgtttacagggaacaattcacattctgtgcaaaatcaacatcagagccaaagtctttctaccaaagcaaaaacttttattggcaatgaaatgtttgatgggaagacggtagggtcctttaaaatgtttcttcacttttcttgatgtcattatttcaggatgggtatatgccttctcataagttttcttttatttttcgtctatcttttatattctatattttaagatgcaactttatattttttcacttttaggtgaatgtggttgatggactgaagttgtatgaagatttatttgatagcactgaagttgcaaatcttgtttcattggtcaatgatctaagggtatctggaaaaaaaggacagttacaaggtaaatgtactatctgtgttctatcttcggactgaaagattgttactgcttccctttttaatagtacttgattcatagcaaataggtgtggccatatgcatggcaggccctttgcccatgttcttaaagctcgaggtttctgtgtaaaaaggtggttgacttgtatctatttttctttggttcatctcagtatttgaatagtcatggacagataatcagcttgcactattctcagttaatgacaatgagtagtatatgagtcatgagttctaatatataatttgctcatggtaagtaatatgaatcatagtatgtgtttttcccaagcccaaaaggggagtgatctgataacttgctgtcaggggagtcagctggttcaccaatggcatttatacgtgtggatcagattcaagaggtgagggatagagagatagcagcaaaccttgaggcggctatgtttaggccctttttataacttctttccttatccttagtcttagtcactaatgtgttcattggtaccctaattattgcgtcaagcactcaagccctagtccagaacagtgcatttcctgatattcatctttttccttactattgctaccattaattctatgtctgttaatgattaaatttttttgaagacccaagagaatgcataagcatacacaggaattggacagtaaggtttgctagggacagacaaggagaaaaggagcaaaaagaatgcgtattaccctattactgtattttatccgacatccgcatgttggttgatgctcaatttgataattgggcacttgtaatacatatatgctgatgttcagattgattattgtattttatgttctgcggggaaatgatttttgcttttgttgtcaccatagatcattcaagcttttgttttaaattttaaaaaatgtattgttagttgctgaatatcttttataagcaggaagtcaggcatatatagtttcaagaaggcccatgaaagggcatggaagggagatgattcagttgggtgttccaatggctgatgccccagcagaaggggaaaatatgacaggagcctccaaaggcatgttgtattattattatgtgattttctttagataccaatctactatagtttacaaaagtttattatttggagtcttttttaccacccttgtaataatggttttttttttttcaacttttactgattgaatctggcagatatgaatgtagaacctattccttccttgtttcaagatattattgagcgtatggtttcctcgcaagtaatgactgtgaagcctgattgttgcattgtggatttctataatgaggttgatttttctattctactttttatgagaaaagctagcaacactagttaacacattttttcataactctattattgggtgaaattcatgtgagtcctactttcaaaaccctatttagtaggtcacatggatttgatctaataattaatggtgtgtggaaaagagaatggtaaacagtgtattgctagcattctaaatttttatttattggttatcagatgttttaacctgacctggcatcacaattgtctattgcctatagggtgatcactcacaaccccacagttggccatcatggtatggaaggcctgtttatatcctttttctgactgaatgtgaaatgacctttggaagagtaattgcctcagagcatcctggggattataggggtggtatcaagctttctctagttcctgggtaatgcttgttaaccttgtcttttactatgataatgcacctgatatttgttctataatattgttcttgagaaattacaattgagtgtaatttggctctggtgaccatgattatatatgtgtgtaatgcacaagagaattctccattttatacgggtgacaatatttgtcttttgtcattagttgtaactttacaattaaaaggtttccactattacttaatcttatcacaaggtgccctctttgtttgctaagcgggagtctgtgggacttgaatgttttgggtcattccattcttggaggtgattataaagttggaaaacctttgtagagcatgcttactttgcttgttgctgttattaattttgggagtagactctacagcatcatgtgcattctgggtgtgcagaattcattgtgaggggagagcttcttgttttaatgtgttacactagtactgcaatctgcaagccgtctacctgttatgctgattctatacttgatatctgatatgatttttggctttggctgttataggtcccttctggttatgcaaggtaaatccagtgattttgctaagcatgctcttccttccgtctgcaaacaacgcatacttgttaccttcacaaagtctcaaccaagaaagtcactatcaagtgatgctcaacggcttgcctcgacagcaacatcttctcattggggtccattgccaagccgatcccccaatcatgtccgtcatcacgtaggctccaagcattatgctacacttccaacaactggagtactgccagctccacccattcgaccacaaatggcagctccggttggcatgcaaccattgtttgttactgcaccagttgtacctcccatgccatttcctgcccctgttgcaatcccactcggttctactggatggacagcagcacctcctccaaggcatccccctcctcgagtccctgctcctgggacaggagtcttcctacctccaccaggctcaggtaattcatctcaacagttaccagcaggtactttggctgaagtgaacccaagcatggaaactccaaccataccggagaaggaaaatgggaaaactaatcagaatagtacaaatgcatcaccaaaaggaaaagtgcaaaagcaagaatgcaatgggcatgctgctgatggaactcaagttgaaccagctctagagacacggcaagatagcaatgacaaagctgcagcatgtcattgagctgtaccatgcttacagagagatagagagaggaaaagctaatcacacgaacactataggcagtgaacttgagtttgaagcaaatgtaaagcgcggcaacacgagagatatcactatactgcaggggagaacaagggaaggagggagaacttttggttctctctgtaatcctttctttgctccattccttttttgttgtcttaaaaaatattaactattacaggaagggaaacccattcttaattctaattttagcatttcctatcttaattattttattttaatgcatcttgctgttaatattgatcttgtggtagtgtttgcgtgtttcaactggatttgttaaaacttaactagtttaagacatacaaaatggcatgttgagacggaatcaaatagaagttggcaacttattctattgaaaatgggtaaatcagcttattatatcatgttcagttccatttgaaacttgtcaattaaataattaacaataccgatacaacaccagtttagaaactattgtaatattgccctactatgttccaaaaaccattagacatttgtcatgtcctaaacaagaaggaaattggacatccaaacctaaattctttgtcaaggtttgacaaacaaacaagtcaacattattgagctccttaatattaagattctacaaaaagcactacaagatagaagctaactcttgaaatctttggaggacgttcaatctcttctgaataaaattagatttcgtgcctgttcaatatatgaatttataaaatgatatattaatttcttattgtgcagtttattaataatgatattaaacattttgttattattttgaagatatttatatagagatgcgaagtcaaacggagacttaagaagtgtctaatagtaaacaaacacttattttttccctttatcatatttttttcttctcaactttcttgtatctattaaatagattttcaattaaagtttggtgaaaaaatgtattgtatagataatcaatctgcgtaaacattctctttgcgataaatatattgcaaaagtacatttctgtcttaagtaaaaatctttgactttgaagtaagatatttgagtagggatacgaaagatatttcacgtatctatttatatcattgaattttatattttcttttattttaatggtgcattcaaaattgttttgtcgtgatttttttatttatttataataattgtactgaggtttgaatgaatatgttagaatttgattactgtctagatcatataatttctttgtatttgatgataggttgatagttaagttgtattttatttaaacatttaaaattacttaaaacattttaatataatgaaatacactagtaatataaaaaattatattattattatctaattatcaattatcatatgttttaaaattataaattgtaattataattacttaaaataatattttaatttttttaattaattagaatgtaatagtttttacggtcacagtatattaaaattaaacgtttttaatatagcttgttaattttgattctttttagtttttatatataaacataaattttgcagttgaagagcttagccctaacccgggtaagaaaggtgggtaaagtacgtgataaagcgggtatgcggaagcagtcagcaattacgcagagagtaaagtttcaactttcaaagacatgacatgcgaatccgatccgtaggtaataataacatttgaagaagaaacacaaacacacgacacggagttcagtagcaatgtccgaggttgagtttgtacctcaaccaccacgcctcttcatccccaacttcctctccctcgacgaatgcagagttagtttctttctttgcttgctttaattaaacatttgctctttctttttattctgattttgattttggtgaaggaattggaattcatccacaagagtagcagcacggtgggttacagacccaatgtcttctccaccactctctcccatctcattgctaccaattcttcccacttcatcattccttttatacccatcagaggtacttttacatcaaaacttcatttttagttacccccacaatttaacaatctctttcaagtttatttgtttttatttgtttccgaatttggtggcagaacggttgaaagacaagttagaggagtttttcaagtgtgagtatgagctcttcgttgaattcactggtttaatcaggttggttaccttaccttacctcgattcaatgtctggttttttattctctatttgataagcatttttaccatcttgtttaatggtactatgaatcagttggagcagaggagcaagcattggatggcatagtgatgataacaggccctacctcaaacaacgtcacttctcagtgagtattattcaaccgatcaacccctttttgaggtattgaattcttgttatgttattcactattgatcactacctttttctcccttttggtaataccatgaaaggcagtctgctatttgaacacttatggccaggatttcagtggtggactctttcacttccaggatggtgagcccaagtcaattgtgccaaaagccggagtgagtttttccttcttttttttttttttttttaaaaaaaaaatgtaattcaatctgctgttaacattcttacggtggcatagtatgtcttgcgaaattcgttattgaactataatatgttcatttatcattccaagtaggaaatgagcagtctttcactgtgtttatctttatttgaatttgaggatgattggtttttatttcaggatgttgtgatgtacacagctgatgaccgtaacattcattctgttgatgaggtatattcaaatgctctcttttcttttgagtgtctatttatttacttggttgtacatgttcaactttaatattaaatcataatggaatctttattgcctcctccctaactcccgagtccaagaaaaagaattctttgtaaactaacatgatttggcttcttatattgattattgtttctctcatcaatcagcctcaatcaagagttgatcttgattattgtcatgccaacaatacatttccctaattcaaacgtgattcatttcccttaatcataaacagtgtataaatatgttgtacatcattcataacatacataagaaattattctatccatttcaaatgagtgcaaagagtaagtaggctgctgttatctattaaaattttaattgcatttataacctcatggcttctattaaattttcaacaaatatgataatagaataaagacctttctgtttcatttggacaaaatatgcagacagaaaactttcatctgttatggactatcaatagatattgaatagattttgagattgatgtaggtaacagttgtaaataattttttgaaggactaaatggctataaaatcattctttcatggagcgaatgatagttcaatcatcaataaatatatgtctcttaaatttttctgatatgaagttatctttttacagataactgaaggagaaaggctcacacttgctttatggttcagtcgtgatggctcccatgatgaggatatgaagctcatttctcttctttcacgacacctgttgcatgactacatggctgattcatacctacctttgccagcatccagtaatatgtactggttttctaaggaccaagctttcgattatcagttcggttttaatatatgctgggctagactgcatgttcttggatatgacatatatatttctcaagacagtagctgtgagtccgatgtctctgaattactggtaaagccggtgcgcttagtgaggggggatgagttgctagaccaggaatttgtcaatattatgcatgcacttcaggtattttaaagaatcctatctatgtttttcacccctgttaatattaaagatcaagtgtatagcaaatgcacgtaactatacattgaaagcctataagaagtgaccatgatttttggtcttctttctcatccttcacaaaaagcagatttataaaaaccactggtactcaatcctttgttgtgcttggcaaagctgtcaaagcaaaacaaaactaactagaaatttagttttccactttacccaatggagagaatcctttttccgatgttagatattattattatttttaaaagaagagattcatgaggacaaagagataattataagtttagtagatttgattgatgaaaactatcaatgtgttatgtgtagcacaatcggaccatccatcaatttttattttcttttgataatgaaaactttatgtgattgggtcccaggggctcaccaggatcagggcaagcctcaagcctcaatgagcgcttatagaggtacttacagattacccatcaacaaggtcctcacatcagcagcgggaattgaacccacgtccttgtgggatatgagtccgttccttaccaattggacaacctttgttggctgatcatgcatcaatatatatgtgggaaattcttgctatttattatatggagaatgctttctagaaagtataggttaactgtcaacctgagtgcattgcatcaactaggactttctatatcttgatgttaagaatagaaaatatagcacatgtttttggaattttgttgtaaaagttgtctggatgtgtttcttttctttttagtaactctatttcagcacgactatagaagggatcttgaaaaggtaaactgggtcccccaagtttctttaagagacttaaaaatatatgtacctttgctcttatatttgcattttatgatgtaatatggtcccttcatttttctttaactgcatttactactgttgtttatgcatcaatgatttcttgcaatatataatcttgatttgttttggaaaagtttctgcaactactctgattcatgttctttgctagaacaggttgtccatttctattgttggaaaggatcagttttactgaacaagatgtcaaatatagactccatggtagtaaaagtgacagatgtgcagagagagaaaatcagtggtctgaattctgtacttttgaatgatgatcattttgcatccaaagttttctgcaatatgccttccgaagaaaatggatgcatttgctttcactggtcaggaattgtggctgccgttgctgcttgggaagattatgcgatgaacttgagcaaacaaattcatttacaattaccttactggagaacacatgaatctatatatagtgcgcaattagatgagtagtattcatgatcaacgtttccaagaaaaagtaaccacctacaattgtgcttgggttaaaaatttggaaagaagcactggtgaaacaacttgaaagtagtttgtgaaggtttgctttaatagcattttggaaagttttaaggcgaagcttcttggggagacatgagaaatgaaactgacggatatctcaagatttatcataaatgtaaatgttatgcatacttgatgtagattgggttgccctgctaagtagagcactcatggatttttctgcatcaatactagattgcaaatactacaaattgtgtatgcctttgtttctgaaacgttcttttttcttctttgctttgttacaaatagtacatttttaagtttccctaattgtcagccagaggggcctccattttcataacatagagctggtaatgtgtgtactttagcttattatatccaggctgctacgttacggtctttggatatgctccatgtatgcaaaactttgccaaaagcatcataaaatatgatatctgctttgcttttggtgatctgcatagacatgaatccttgcccatcataatacaacttcagttcttccagtttccacggcttgacatcacccgaccatgcctttgatccacctccacttgttataaagtgaattccactggattgtttatgcaaaccacagaaacttgaatgtcagaacagtgatgatgttgaagctaatcatttaagagtaagatatatgcttacctattattgtcaattatgtgctgcaagcagtggtcatgtccatttatgtatgcatcaacatcgttcgcctggaccaataatgaagaaactaactattctgaaattataaagttttcatgcaacgatttcaaccattataagggaattaaagttttaacatggtctcagctaatttacttatgaaacctggttaactgacctagtagttacactatgtaatatgtatcatctttaacaaatactgaagggggcatttggtaattataagatatcttggtgtcttagatatgcaaatgtttggaaaatggaatgccgacatggcagcaatgtacttgtcatactaaaaacacgaggaatgttaaatacgagtaattaacgtattaatatgagaatgtgatttgattacctctaagatgggaacaagtagctgtttaagctcttcggtgttaccatgatgcccagcactgttgatggtatgatgacccaccaccatcttccattttgcttttgattgagccaaagctgaatcaatatcctacagaaagatttcagggacagtccataatttccctccttttaatgttgcaattaaacgatagatgtattaatgcaaatttaaagtctttgatatcttagtggtaataagttttttgacttgtttaaaacgatgttacattttcctaaaccatgtcataattttcaattgtgaattatttcaagaaaataaatacaaaaatggccgtttattttattttttttaatagtttttagaactcactaagacattatttcttgacaaaagtcaacaaatttgaatttgtaagttgtaacttgtaaccaaccttcaagagttctgaaaggtaagttaggcgaggaagaacgccttcccagtcataggtatgctctcccgggtctgtgaagtactcgtctacaaatggagtcgtgtccacaaagaaaaattccacaatttctacataaataacgggcaaaaacacaattgttacaaggtttaattcaataaatgaatacttttattatgtaatcatcacaaaacattacagcatcaattacattatttacaacaacaaccaagtcgtatctcactagatgagatcgattacataaatcatataacgtaattcaatacaattaaaaactatagtttcaccatcgttttagaaagaaatatgttgtgaataattcatgttaagtataacggtttcgaacatcaattacataatttcatttaaattattatttcttaaaatacaaatgtgtaaattatacctccatcgagaataaaagatctcatgcaaagccatctgctatctttttgttttagaattggacttagttgtgcctcaacatcacctctgtagtcatggttacccagaactatcacagtaaaaaaagaaaaagaaaaaggaagatcaattgcttaattagcaaataattttataaaattggcacaccaaaaaccatgcttaagtatttgtattttgtagtattaacttaccagtgtaccatgtcttttgcaagctcggggcagtgtacatgtcgacgaatgattggtagaatgctggatcatcaaccccttttagtccatcttcgtaaaaattgtcaccagtggagatcacaaaatctatgtctagtttctctcccacaattcccatctaaaaaaataagcaatgaagagttactacttgatacctcaaaagaggaagaaaaaaaaaccatactagcaacttaaaaatgggattggctgtttgtaaaatctaaacttaattatctcactttatagtagatgtgcatacaacatttttggagtcaaatgcgttattaaccgttcaatgtcaaaccctcgagcttaaacatgatagaaagcaggaactgccacatctaaatgtgaggaaataatagcttttcttttgtgaataatgtagaagaatgtaaatgtaagatggagtacattagcgtctcaatttcttaataagatcttggaggaatgccatatattattctgtcaaacttgtaagttcgttcatgtgtattttgttttattctagataggatggttttataagaaaaaaaggttcttgtctatttctgcgaaaataaacttctatgatttaataataactaacttggttttgatgaatttgagtatagttattgttttatattgtcatctaattatactttgttatatttttagaaatattgagcacattacataattattatcattgtcaaaatttttaataatatgtgatgctatttaatttaattatagttttttatataattacaatacacaggaacagtttttatttacttttaaaaatgtataataaattgcacaatttaaattagatgcagtaggtggatcgaaacaatttggcctttatatgtagactgaacagaacacatgggcttatctaggttctatggggttgagtcaatcacaattttctcattgagggctagatctcatcgagaaataacttatttggaatttgcttacacctcaagagtaagaactcttgaatcattcaagtgtctaactcaatcaagttaatttattgagtgatgattgtctcttacttatatatatatatatatattttttattgtagacttatttctattttatatctaatatttttagacttagtgtggagataacatgatgtgtgacttttttaatgaatttaggataaataatgatactatcttagaatatgaatttgaatctagctcaatcctataaactagttcataaagtaaaaagaaaatgaataataccaacaaatcaagtttacacgagtacattgcagaattatatagcaacacctaataatcctaatatcctattatctctggtatgtttttaattaattttatcctttttgtctcttttctctcttctatattataaattttaacaatatatgaattttttctaatatatatagttttttttttacttttaaaaattaatagcaaataattttttgaaagacgtatgtatgacttgagtttttagattgctttatttttagaccgtcccgatcaatgtgacgtgtatttcaattgttattattattgttatttttaaaagcatcattttgttgtattggaatatgccttggaatatacatatcgtctatgttgtattggaatatgcgtgggattatctccacaagattaaagctttgatgcttggccacgtcgttgtggtggtttagaaaccataggtctcacaagtgttgtccaaatgcattaaaaactctacagtgtctacactatatgaaggtttcatatttgattactagacaaaggtttgggaccatagttttgggggagagagattatcagaggcagaaattaaaatcgcgcatcccaaattctaaaagacaccactataaaaattaaaaagggcaaaggtagatgagtgatgatgacatgtatgttagtatcattaactagtggaagacagggatagatagatagaagacaaaaaaaagaagtaactggtcaaatgtgtaacgtccactttgttttgggggtggatgagggagtaattggaagagtaacattataaaaaaaaaaaaannnnnnnnnnnaaaaaacagaagagaatatacttaatgcatgttaatcaataataacctgataaagctaagggaaaaagtgaatttatatattaagaaacccgtaaagctaaagacgtgaattaatgctttaaaatgtatcagcatctatgcgaagcatatggaatatgcctcagatttatatatatgtttgatgaaatatattaacataaaaaataataataaatcaattcaatttaaactgatttagactagttaaattgaattggttttagatttttaactaaatcaattggacgatataatgaaaactgattaattaattgaatgaattgatttttctcgttatcaattctgcaaaaatgctattagtttttgtacatagttcgactaaacatacggatactgaaaataccaaagtgcactccgtatagttagcatcaccattgcttttagtcttaaacaggggttatacttatgtgattaactaaatatccataatttagactttgggtaagagcattttttcatgtgaactaaccgatcacatgttatgtgcaggtgcatgcaaatttaatgtgcagaactataatatattccattgaattatgctttgtataattatctattgattatatatgacaatgagattgataaccttctaacaaatatgtctaagaaattaaaaatgaagatataaaagaagagggagattaggcaaaaattaaacctgattggcgaccaaagattgattgtaggttccttttcttccccaatctccaaggatcaatatattaagagattgttgtttttttggagggtgtttgaatatgggaagttccgcaatagaaggagttaccattaagcagaatataccaactacgaacataagagggaataacatgcgttggtttaaagatgaagccatggtttaatttttaaggacctgcaagttctccaacccagagaatgagagaaagagagagggagggatagagagattgcaattttatgagagaagatactatatatatacatacatacaaatttgaacgtaataaataatattttttcttttaagatagaatattaaataacagttataaactgtactgtatattttatacaagacatatacgctactgttaatttataaattataaaactatgaaattaatataaaattattaaaatattattttatttctcatactcaacacttgaaattttaattattttatttataaatattttttctagtaaatcttaatcaaactaaaagtaccacataattttttttttaaaaaaaagtgttacgaaaagatgtattttaacataaataataatgcaaacatagacaatcttcttcctacgaaaagaatagcgtacacgattgttaatccaagaaacttctgatggtattcttttataccaacagtacaacgcatattcctatttcccatttccttcggaaggaagagaggggaaaagaataaatatctgacattctttattttttattttttattggccttttcacatttacttccttttcagatttaattgtagttttaattctaattgtataaattaatggcttcctaattaaaaaatttaaaggataacattttattataaacatcatataggaaaatacataaaattcatgaataaaacaattttacgaatttcaataaattttttctttcaattctttaaccaatgtctcaataaccttatggtactaattaatatttgcttataaattaaaaggagaagttcatttaaatttatcaaagaaaattcttttcaaagtgttaaattatttaatgtcaatatttagtttactaaataatccaactataaattaaaagaattcaattcattttttttaaaaaacaattactttttaaagtaattaattatttgttgtaaatatttagtttgcctttttctttttgaaacagaaagctcaattcatatctgcattaatagatagcatgaatacactggtaccggtgtatgccaaaaaattgaattgaactgcattttatatatcaattagtaataattttgaccatttttttggcatataaaagttcatcactatcttttaaccaatttagagttttttcacaaacaatttactgaaaatatgcacaaaaattgtttacctgcaaatttgtttcaacgtttggaactcgtaattttgttcataatcagatgttattttattttagtatttaaaaagacattaactaactaaatggaataccttaagaagtgggagaaaatgtattaaaagttcttggtgtcgctatgatgcccaacgcttttgattatatgatggccaatcactaccttccaggtcgctgttgattgttttagtgccaaatccacgtccttaccaaattaagcaacgtcaatggtcaaatacatatatcacaaatttgtttaaatttatttattgaaataaatttttattttaataatatatatatatatattttagtatggttgtctaaattatttcctcttaaaaaataattttttgtttattttaagaagtaaattcaatctgttttttaaaaaagttatataaaatacacttattttaaagttatttttattttttttttaaaaaaactcacccataaataaaataattttccttcggtcgaagagaatacttaattaaaacgatatcgtattaattaggtttattcaagtttgaaatggaaattatacctcgcaattccaaatgtcaagtatgtatttatgcatttagaaagaagtttgacttctcttcttaattaaataaaattaaaatatatcacaagtgataagaaaggatatatcttttgccactgcctacccaatatatatatatatatatatatatatatatattttttttttttngaaataaattcccattatattaaatataggagggcttatctttcttcacatttaaatgttttgtattaatgttttttaattcataataaaattaccttgagaaggttagaaatgtaaagcttcctgggtagtacgcctctccagtcgtagatatggccttttttctctatgaagtatttatcgacaaaaggtgttgtgtctacaaaaaagaagtctacattttctgccaccaaataaagcaaaattatatcaataaattctaattgtaaccactgaatatatcagaatgtattgtactgggtaattaaaattctaataacgtccttatctttttgaaaaatgaataacaatttttcttctgatgactgaaaaatatgaaaaaaattataaatatccatcctttttattatcactttttttttatcaatcacttatctcacatataattttttttcatttctcttttaactccattccactttgagatggacgttaatcagaaatttcaaaaaatattataaatttttataggataagaaaacatgttttatatagttgtgtaaaaaaaaacatgttttatatagtatgcagtaaataagagtaacaacaataaaaatcccatccaagaaacaattgttatctaatattatttataggctaaaatgattacactacaataataaataaagagcctaaattttttcatttgaatcataacctgggtaaaagtagaaagattattaaaacagtaagaaaaggattagggaatttatttataaaagcaacatgaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctatatagataattgctaatgtacacttccttatcttaaaaggagtatgctaataaattataattgtgattaaacttatatttaatttaatgtcagatcaagaggttgagtaagattcaacaaaaaaactaaaaaaaactaactcagagtaattagatcggcatgggttaattataattattcatatccatgaacaccttatgttaaataaaatattaagaatacaaatataactctatcatacttaataaaatgtacacttaaataagatgtctcctttctttaaaaccattatagatatataaattgatattatgtgcattttttatttattaaacaacagcgcaagtaatatataataaaagagttgattagcttgttttcttaactttagatgctagtttagtttagccttttctgtttggccaaccgtggtgttttacttattaactactgtttcgtgtctatgattcattaataatagtgattaaattagaacaaaataacaatggtcttaatcaagacgagctttaataggtatgaataagatgaattcaaattcgcttcttgttactcccttagtcccaaaatattcggttaggttatttaacacagatgaagaaaaaataataaatagattaaaaaagaatgataaatttacaaaattaaccttatatcatcattaattcattttaaaattttgtagttcatcataatatataaggaatataagtagaaaaataattaatattacattaaaaaattaaaatcacaattattttaggataatttttttttcttacacaaaaattataatgagatggaggaagtaattattaaagaaaccaaattcaattaaataaataaatagagggctaaaaaagtaggttagtttttttacagagtttatattcttactccgagacatcaactaatgacaaattagaactttgtggtccctgtaacgctccatctactcaacttctgggttggccatgatggtggaccgcagcagtggaagctcggcccaataagagtccatgtttttgaacagaataagagtccttttttagttagtggtccaggtagttatagtagacctcacactaaatgaaaactttcagcctgtttagaaagggaaactccactggatgaagagggttccccacaaaaaggaaactcacaaccaccatttttggggtttgggtttgagcatgctctctatctctctttcactacgccattgtcatttggcaagtttgcatgttgcaaacgtttcacaaggaggaacccaattttaaggaccaaaacgtccaatgctttgtggccattggttcacaataggctcaacgctcaatatgtcagtcaagaccagaggcataccaaaaatatacttaacgtctgttatttcccattgagaacattcttttaccacaaattgtttttgagaaaatgtaactcgaactttgtattaagaaatgagtaaatcccatttcattttgttgtcaaatgaaatggagtttaaaaagagtcataaaaaaaaggttacagaactaaaagaggagagtatttagtgtgaaaatcataaaagaactcaaaaaagatcatatataatgcaattttttgtatctcccaataaaaattttttattttaaattctttaattagtgctctgagggtactggttagcatttaccaaaataataataatattagtgctccggggtcttggaatgctaacatggtatgacaaatgccactggatgatacatatttaatcagaggcaaatgataactagtgcatttaaggtactgcttaaaaaaactaaaaatataattctttttatagaaatgcgtaaaattatgttgtccatgatttttctttttcaatctcttatgattttcataacaaatacttatcctttcagttccttaaccaatgccataaggacattagcccttaattagatatgcctctttttttatgggtccatgcttcagaacttcctcatctctgtaaatggtcaagatatccaacacaaaaagaaagggaaagtctaaatgctgaggttgattgtatagacttgcagtaccgtgttctaaactgtgtaagttctctatgcaatgcaatgatcgattctcaagtagtcaaccaatcaaagaactataaatatataaatttcaagaacccattatccactggcatcatcaacactgaaactcctatcaaatgcataatccacaaaactgtagagaggaaagactcgttccccatacttctcaaatccatccaattcttccttagcctttgctctgagctcttcagctttttctattgccttttcaactccataaacctctgcataactattacccttgtttttcctgtcaccacgtccctcaactttcaatctctcttctataatatcatccataactgcatacaatactccaacagctctcccatacctccttagtctctctatctcatcatcttcagctccagctaagaatcctccacacactgcagaagactcccccatttcaccaaactttttttcttgtataaatccaactgcattgggtcctccttcaaggtccaggaactgccctgcagccattccagtggagcctacagaacgggcgatctcagcaatcacgcgaaggaggtgcgattcaggcacaaggtcagatggagtctgtgaaacaatgtgctgaaatccaaggggaaagagtgcatcacccgcaagaattgccatgtcaacaccatagatggtatggtttgaaggctgaccacgacgtgagggggagtcatccatgcagggaagatcgtcgtgtatcaatgaagctgcatgaacctgatttcaacagaaatataagattaataaacttataaccatgtatgtttaaaatactcaaacacattcagtttatagtcattatttttctagtgaagtaaatatcattacttcataaattccattttgtatcccatcaggagttcaaaacataccgatccagagaatctattttgttaaagaacaatgtaaattgcaaatgtaggtatttttaaacctaaagattcttaacagttcatctaaaggtcaatgtaggtaggtaccctatgatgcaaataaagctagagctagctaaagatggaaaccaaaacacttatttgcatgaacaacacaacacacctacaactaaacatgcatttaatgttattctaaaaataaaaaagaagagggaatcaggatcaggtttataatgaaaagaaaattgtgacaatgataaagcaatctctctcaaatgtctcaagtataataatagaaaaacaaattacaacacaatcaatattaccatttcaagggcacaggcagtggggaaggcggtaaggcggctgcccccaaagagttcacaagcagagatgcacataacaggcggggctcgcttggcacctttggcaaggactgaatacctcatagcttcatatatctgcggaggaaactgaaccggaatagcttcgtcgagcttctgattgatctgcaccattaggttagcccagtatgtcttcaaatcaaagtcagcagcttttgatcgagtggaaaccgaagtttgagaagacgcggcagtagagcagcgaactcgaaacttcaagtttgtgggctttgggaggctgcagatgtgagaagagggcagtgttgcaaaagcaaatggagccatcctcaactactctatatggaaaaaaagaataaagaaaatgaattcaatgttagccttaatatccattccatcaagcaactggtgggcatgaaattttcataaatacgaacctttgcttcattctaatttaagacacaaacaaacacacatagtaaggcacaccaatcaacatggaaaacaactcaaactccaaaaacaaagtccctatgatcaacaatttcaaatttcaacatcatagaaccaatcaacttcagggtcaaacatttctattctatgttaagccaaatagttgaacacccaccacccaaaatactaaattgcacaaaaataagtcaaaaaagaaaaagaaaaaagattaccgacaattgaatcgcaagagtgaatgagatccggcaattggggggagagagagttgagtgataaggtttggtttgggagtcaatgggcgattgcgataaggttatggtatggtacactgtgtatggtacagtgttggcgagaccctgcaaaatacaaatgcggttttttctagcttaaaattggtattttagtttattaatttcattggataaatgtttaattttacataattaaaatttctaataaatattttcttaaaatataaattagtaatatggtaattaaaattcataataaatcattattacttatattttagatcatttaaatcttgatataagattatttttaattataatattttaaaatattaaaatttaaattcaaaaataaaaataaaagactatacattgataggaataagtaattaagataattaaacacataaataaacacacacacaaaaaaaaaaatgcttttgaatatccaaaaatttgaatttgagttaaaacaacttttgattcatgagttaatgataaaaaaaaaagaggataagttcgaaaaggttgagagatttttttaaaaaactaattacaagaatactatataaaatgtgcatctaaaaaagaaaaaaagagagaatattaaaaatggagagtaaaaatcctactttttaaactgtggattctaatttagaagatatgaatttataaaatatggtgactgataaatgataatcttgcaaaacttggaattatccacgactttagtgtggacctatacgacattccttatgctatcctttccttggatttgttagctgacaatcccaatgttgtttctgttagctagttgtttgtttttcgggatttagcccttgtatccagcagaacaataataatatattaatatgtaagccatacaattctattagatttcataatttaaatttctctaattgaatacttatggtttaaattttttattataaagtttttaaatgttagcattataaatatttgttaatattattatatagtatttttatgaattgaattaaaacatactaatactataatagtttttatgccccatcaaccataaatgaacatactattaaaaataattaatttaaaaaatatatatatagagagagagagagaaagagagttatatgttaactataagaatgaaaatatttaggttggcaatttatcaaagttacactcttttataaatatacatataatttaatttttatccattgttatttttcctttgtgactcattatccattataatgtatatatttttatactatcaattaattaacaattattcaaagtataacttttaaaataactattatgagtatattgaataaaaacataaaaaaaataattattatgaaagtcaatatatgggatagtactaaaatagaataactctttacttgtaatttcttttttaaagggattgtaatgattcgatgaaagaaaaatgagatgtagaataatggtgtcaaacaagtcaattcaatccaacctatcttcaactcattgaaaaacaagatgagttgagtttagctcgtttttatattggattaaaattttcaatccaacttaacatgtcaacccattttttttataaaaaaaagatttaatcattgtacttgtcttaatttttttttcaaatttgataatcaaatataatttaaaaagagagaaaaggttacaaatctaataaatcaagaaaatacttataagattatcataaaaatataaacattaaatttagtttgagaaaataaaaaaataaaaaagttttaccgattgaacatgtgaatccaacaagtcaaccttacccacatcaagttgggggtttaacggccaaattaaattacatacatacaaattaatgagttgaaatgtgtaacacaactcaatccatttgtgtggattacatggattgattgattaggtcgaatccattttgatagtgctataatgtaaagagtttagaagttaataaaaatctttcaatgtgtcttttatagtttagtaaaatttattattagcttctaatataatgaacacattgtcttttatatgatttttttttttatattttataggcacaataataacccacaaatctctctttctttccctattctaatcctcagagtgagtccttttaattattaagtattttagaaccctaagttgaagggtgtatgagcagtaggtgttgaaatgatttagtttggatatatatatatatatatatatatatacacacacatgaaggaaacactgcaagaaattcagtacctgttaaccggtataggaatcgttgttgtcaagaaaaaaccatatatttacgtgaagggaacattccaagaaattcagtacctgttaaccggtatagatgtattttattagtaacaaaaattaaaaaccaatcaaacaattaattttcttaaaaaatgattcctaacaacgaactacgattatgtatctcaaaaactgatttcatctatataataataatgcatgaatcatgatggtcatttctacaataatttatgctaccatggtttggtgaattattttctgtgttatgaattgcttcccataagataagaacagaactcttttaaaattaaattaaaacacgtagcaatgatacgatatgatacgatttcctattaacaaatggaccccatggcccatgcgtatggtgcttttctcttcttctccagttgtacaaattgcgttataacaccactcagttagtgttgtttgaaaataccctcctagctcgtcattttcatctggaagcataataagtatatatataaagttgttgccacttgcaatactcatcaatcaaaatccacacccaaagctttcttttttctccatcaaattctctgacctcaccatggggatgcagcttgtttcctcgacagtgcttgagcggtttgaatgagcacctaaacaagatggatcacttagtttcttggtcattgaaaattggggaagaaaaggagcttacaaccaatccgaagttgcattccaagtaagttacattttaatacacaccaaccaattgcatgtcgacaaatattagtcattgttagtatgacatatctctttcctcttttctttccattcaaacaccaaaccaaccttaaaaccgctcaagcaacaatgatagtctatatgagtttggtgcacttaatgctgatcagcaacaatgataatattcatttccctccacaaagtatttttaatattttatttcacttcatttctttcttcacaactttcttctcctcctatttctggcacggtgtgtttacacccatggagtgtataagtacgaatcatttaatttccatgcaaatgcaatcttaataatttagaatgaatttaaaaacatttaggtagtggacaaactagtggccattgatacagcagagaaaccccaaacagttatagcagaggaggagcagccaatgaatatcgtgcttttccttgctatacaaagtggtcactgtgtacagattccttacactctttttgtatccattaattaattaataacaacaaggctcctaaaataataattataatatattaggccaatcatgcagcccatgcacgcgccagtagtttagttcttatttggcccgaaacatctgcatctgtattatctcattgattattttacaaaaatgatttttggcatgacactgtgagagaagaaaaaaaatataaatattataaataatatgataggatataataaaaagagagaaattgtgaatgttaataaagatgataaaattgtagtgttcaaatattatataacctattattttattagtgtgttgaaaaagcaagtggtatattataatgagttaacgactaacgggtaactataaacaagtatattaaatatcttattgaataaattatttaaaaataataaataattttttgataaatcttattaaaaataatacatacatttatattatttaatcacaaacttatatatatatatctaaatttattaattttataataattattttaaaaatcatattaaaaataatttatgattgactaactttacaatttttgtatggcacacttaaattcttgagtgatgctatttgttaagaatggtgagatgcaggaattgggcacggaaactgatgtgtaatgctgacatttttctaaatcaaacattgactagctaataaattaagaaaaatgtaagaagaaatttaactgaatatacagtcgtgtgattttgatgaaatatattcgtcataaatagctagaatttttctaaatttgtgtataaataattattttgtcatggaattttattaaattttattagtttttttatactaatttgaacaatttaatttctgagcaaccaattttaagaattgtttggaccaacaatccaatccaattttatgtctgcaagcaaattatggtcaatttttcatgtgtctttttgcctccgttcaataattaattctgaaaaagaagtgaattaattttttttctagatgggagttattggagagcaattggacatcgatttcgtgatttcaaacggcgacaatttttatgacagtggcttgacaggcatagatgatccaacctttgaagactcatatattcaccaaaatctacactgcttctagcttgcaaaaacaatggtacagtggtaagagttcaatttcataaatcttatttaatttcaacggtacacgtgaaaggaatgcttattagtgcgtgtttaaattttagttggaagaatttataagtattttcatcctacaagtaacaaattcgtcttttttttttttttcattttatgcattagaattgtaataaaattagcaaaaatatttttcaaactttaatacaaatcttgacaagagatggctttgcttgagatcttttactgtaaatgcaggtgtagagcaacctctcttgttttattcttcttcttaatttcaatttatagaaggcttcaaatattaaattcaagtaatataaattcatgtgactttttacattctttgtttcagaagttgcagagtttttctttgtagacactactccgtttgtggacaaatacttcccagaacctaaggaccatgtttatgattggagtggcatattgcctaggaaattaatagtgtgccataaacaaaattgttaagttagtccaactccatatgctttgttcttgaatgcataactaggttatgagctagagccactgtgctcatattgtcacaaaagatcactggtgtagtgtgtttgacttgtaattcagacaacaaagtatgaacccaagtcacttcagcagtagcaagagctaggcttctatacttgatctagccataactttctgcttcttagaccaccaggacacaagattaggtcctagaaaaattgttgctcctgatgttgatctcctatcattggggtctgaagctcaatcaacatcacagtatgcctgaagagagaaatttgaagaggtagaaggttgtcgccttaatccaagattggtagtaccatttatgtgtctgagaattctcttcatagctatccaattttgttttgaaggatctgacataaattggcatactttattcacaaaactaatttcttgtcttgttatggtggcatattgaagtaccccaacaattgatctgtaaagagtagggccagagaacctctttaagcctgatttagagagttttcaacctaaacataggagaagcaatgggatttgcttcatccattttagtctttgctagcagatccctaatatacttgattaagagttcgagagccatgagcttgattagatacttcatcctttgtatagaattaatttattaaaaaatgctagtggtgataaaagtaattcagataatgacagtatgaaagtatcttggaaagatgatatggatttaattacttggaaatattaacctatatatgttaaaccatgctagctctgaattacatggttccataagaaagaagactccaaaggaaaatgctattgcccattaggtcatgaccatttagttgccaaagcaatgttcttggaaaccaaacccctggtaccgacctaccttccattctgattgaactataatcagttcctagatgagatacgcaaacaccaaagtttgctaacataagttaacgaggatgaagagtttatttttgataaaaatagagaagcataaatagagatccgtagcctcataaatttctataaaactagtaaattcgataattttgcgaagaggttttcatagtaacagaaattttccaaagaacagaacagcttagagcaggggggccaataatagtcccagtccaggactgcatgtagatatcatgggcatcatccattccatagctaacagttccatctccaattcccttctcacctctctcaagctcttccaataatctgaagttcctaggaactgcatacatagacaaaaaagtttaacaagataggtgcaaattacaaattaaaaaaaaaagttacaataaaagttgaacacaatcaatgataagttacatttacaagtaaattggaaaaagggagcataagcaaaaacattaaattgcatcataacttgagtatatatttggtcacttctcaatatctgagttcacaaaagtcccaattgacctgcctgaatcttgtctattgttccttcaaatctaataaaagaaagaaccaacgtcaaaacagaaatcccattaactgatctttagaagagtgacaattttacagtacatgttacacaaaactatgtttagcgtttcatataacaagtcaataacaaagagagggggagtcagagagtgcattaaaaatacattcattttcagatgatttttaaaaaatcatcgtagaatgttaactttttaaagatgattttcattatgaaagtttttaagatgatttttgtgttacgaaaatcatttttattgaaaaactttgtattttcaaaattatcatcttaatggtgactaaaacaaaaaaattgttgcaactacgtaaaaaaaccaattaaagcattagaatttaaacatgtacttgtgcatccacacgttgtattagtattagaatttaaacatgtaattgtgcatccacacgttgtattagtgttaaaagtaattttttttactttttttaaattttttttaaaatgtaacatttatagttctttatttcacttatcactttgtaatatttcaacggttgataaaattgacccataaaaaatccaacaattttatacttgcatttattcacgtcatgacatgatctttctaatattaattaattattttttattcaccttatttacttgatgtttttctactattgataagactactaattaattgcttcacaattttcaatcattctcttgttttttttatggtatataagcaaccatatactcatgttatttttttcccctcatgatgtcaatttataccgctttatcttacctttttcccaactaattattaaagtcaaaccttgaccacaatagttgcctgtgaagatttgcaccctggcaatttcttcgacagcacacaagaaaatgacatttgagcttcgagcaaatagggttttatgtaactttctcataagtttaaatcgtcaaatctgttctacaaattaacaatataataaccgtttaacgacaattaaatgtgtgaaattattaaagaaggaaaatgcatgtatcttttcaaagttctttggttcattaggcaagcaaatgtaagtctaagatcattcaaaccccggcccttttgttggagtctttttcttggtttagctaattagataaggacacaaaacttacttataaggatttgaccttttcgatcgagtgattatttgaattttcattaccagcaataattagtgaatttgaacgagaaacaagagttagagtgtattttgacttcctagataaccacaatcgaggtggattattgcatccttacttccatgcatgactaaatttctagaagcatatactatatttatatataaaaacatacaccgagataattatttcactcaaaaaggaagaaacaaaaatataagaaaataagttagcaggtcaatggattgaagagacctgtatgttttcgagctttaagtagtactattggaatcgttatttgcacgtttctgttacccaaatttccttttattaattgtactaataaaatctgacatagttggtaaataattagtcccataaatatattaacagatgttgatttcaaactgtgcgtataaaaaaaaccatactgaaaaaaagttatatatactctgaacaaaagacaccctaagtacataccaaaaagaaaaatccatttattgttgaatttatatatttttttgaacagttattgttgaatttatattggtgagtttttataataatttatcaaataggccttacgtaataccttacttcataagttattctaaattaatagtctgtgatgctaatgatatataacatagtaacctgatttgctaatttatcttaagcacctttcttccgttattctaaaactgtcacccttagcctgcacctacttaatttgtggctcttggtaaaatcgcagtctatttcgttttaatgtgaatggtgatactaattaataaaagagataaattaatggtttgggggatgaaatgaaaaggaaacagggaggaggaaatagaaaagagtgtgtttggtaagtagataacaattaagtagggagaaaaataaaaaagatgtgtgactctaacattattatttttctgtaaaaaaatgaatggaaatgaatagtgaaaggctagaatcatgactttttatgatgataagtgatggttttagatgtttattggtgtgcttttttgttttctgaaaaggatgtttactgatgatttaaaatcctaaaaaacgtatataatcgattttcctacgaaattaaaattcgcaaaagctcatcagtggattaaaattcacacaaaaaatccgcagaaaacattttctgcaaatttttaagctaactccgcagaaaaattcgcgtctaattttttttttatgaacaattggagaagatcaaagcatatatactttgtaatgagcattggtttgggacgatacttgaaccaattatgtacgtgttttgagaatactattttatacatttttttttcttttgatagtactatatttgttttatacgttcttgttgtttacaactttaattctgccttttctcttttaatattttattaagtttcattatgcccttgaaaagaaaacaacacactttttggtgcttttcgttaaaaaaatacatagctaaatttattttatcaataaagtttttccatgtacgcagttcgagaaattaaaaaagaacaataataaattagagcgcaacacttgttccaatatcttggtagtgagttgagttaaattctagaacctggtgtaccactaatataagttagtattttgcaaatgatagctacaaatgatggatgtgcctaatttaattgactgaatactaataatagagaaataatttaattgaacaaatgactatggcttccatgcaaaggggtttttctacactgttaattagtgtcttagagatcaaagcacatgcataacacgaatggtgtattggtgtgtcattcactatatacagcactaggtgctccctccgatcccttgccttgcccctttgggcattttctgagtcccacatacctaatttaggttcaccacttcactttcatcccttatgaatattaactgaaacacaaaatcttaaattgttggcagaagaaaaattatttaaagtccattgtctctacccaaaaaaaatgtaacagtatgttatttttttagtttttaaagttaattatgagtagataagattaatttaagtgtgaaactaataaaaaaaattaaatcatctatatttagagctcaaactggttttactttatcatattaataaagttaattttctaattttaatttagtgaaatttaaaatcgtaagtcattgattgctgagtttgcaaggtcatgaatcttgatattcattggatggttttctttctcaccattaaaaataaagaataatatactattaagttattgatttaagtgatattaattttaatcttcttaaataaagtttgaggtcaaagattaaagaataataatatacttttagtacggtacaatagtagaagacattgtaattataatattatttttattgagaggataattgaaaaggccaggattaattaattggaccacagcgcaggagtctccaaaatgacactggacctataatgttgcatcggtataataatgaaactgcaacatgatttatttgagtgcgtgatattaaaattaaaccatagaaacatcattgtacatacgattcccttccctcttgtcttcttgttctttttttttttttgaagtggaaatctcggaatataatgcaatgtggtttcatacatggaaattttatcgtggggggcaccgagccactaatatcaagggagaatgttgtccatcagttcgtatttattttgtaagtttaaccaattattcttctaaaaaaattaatangaagttttatcgtggggggcaccgagccactaatatcaagggagaatgttgtccatcagttcgtatttattttgtaagtttaaccaattattcttctaaaaaaattaataccatacacaattacacacattttttaaaattgattgtatatagttggtctatatatattttcataaccggaaacagaaattaaaatgtaaataagtgattcaaagtaagagcaaaacgcaatgatctatgggtgtttgtaatttgcacgtcagttgcagcaatcaaaaaaggtatgtgagagagaaataagtttaagagaagagataaaataatttttttattctttctaaaaaataaacacaaaattactggaatgttcctaaattaaatttggtaaaacagaataactaatttgtttcatgtgagaatatgttaaaatatgagtacgtataatttgtccattcttagataaaacattgggttatataccctcactcacccgtatcaaatttgatcccgatattctaaaatccaatctaaacaactatcaccagatagccggatccacactcggagcgtttgagagttgaaaaaaatttattgaaaaatttactggtaattgaaagttgttaaattacctaattaagttatattatttgataaaattatccattatagaaactaataaatgtaaaatatgaaaatatacatatttatatgatatttttgtataaattttaaattattttattaataaaattaattagtttttgagagtatttataatttttggttttttaattaactttaaactcttgtaattttttatttatagttagttattttaattatatttttagtttcaattgcgatcttttttatattgtgtatattctattattaatcttgtcacatcttaaaatattttcaatcaattttaaaacaaaataaaaacaacataaacttaattagaagtcatatttttattatgttgatgttgattagtgtaatactctatctaaactcaaatatgaatgaaattaattaatgtctgggtaatgtcatggaaatcaactatcacatttaaaaataacttttttttatacttaaaacatcattgactggaacttgaattatttttttatgaaaaatcattaaaaatagatatcaattaattaaaggatgtttttaggatgatatcattcaatattgataaaaataattaaaaattaattatatttgagtccaatattttttgttgcttatattttggtccagagagaataattaatataatttaaaatatataagataaatagtgtaatggttaaataaataatatattatcaaatactcaccgaacatttttattttattataaggttttaatatatttttgtttatataagttcatattttttaattttggttttcgtaaaaaaagtttatttttaattcctataaattgatatttttaattttaattcctgtaaaatattttgttcattattagtcgttgtaaatttatatttttttaattttgatccatgtaagtgtgaacttatgaagattactaataaaaaaaaatttaagatcttaaagggtttaaaattaaaagatacaaacttataagaattaaaaatgaataaaaaaatttatagcgaccaaaatttagaaaatattaacttacaaagactaatttttttaaaaaaaatcttacatgaacaaaaatgaaaaaaatgttaacttactcgaaaaaaaaatatttaacnttagtcattgtaaatttgtatttttttaattttgttccatgtaagtgtgaacttatgaagattactaataaaaaaaatttaagaacttaaagggtttaaaattaaaagatacaaacttataagaattagaaatgaataaaaaatttatagggaccaaaatttagaaaatactaacttacaaagactaatttttttttaaaaaatcttacataaacaaaaatgaaaaaaatgttaacttactcgaaaaaaatatatttaaccctttttattacaatccgcaaaacggcaaaaggacacccccttgttgtagtccatttttcttggattgcttcatatatttttgatatatttgatttagaggagagaagtacgaaagatataaatagaagataaataatttgaaaaataagaaatagagtagaaatagaatgatattttgtgttgtttattttgaggaaaataagtgagaaatagattaatcataatattatgaagttgttcagtatgaatgaaataagaaagagagaattaaactttaaaaaataacattatgtcctagaaaaatggaaaggacagacttggtcctctttttttcgtctgatgcacagaaaaatacagtatgcgggatccactcttttcaaaattgtttctgctctttctttgacaccaaaagcagattattcatttatatctggtcaattgtttccaatttccatcgcccataataaaaattggcttcaagcacaaataatttagagtaacaatacatactcaacaattatttatatattttttattgcattattcattttaactatcactcttctctttcgttatctctcttaacttataaaatttattgtataaactgatctatgaatagcattatccaataatttattcttactgtcccatcttttgggattgaacattaaattatcacgggaaaaagtcaatcttgaaattctttaagggcttccagcagagttcaatgtccttacaagaaaagcgcaggttcactaaggaaaagatataaaaaaataatatcatcaatagattggtgtattaaagaactatttttaaatttaattaaatatataaataaatttaaaatttaataagtaattcaaataaaacattaaaaatacaatttaaaaatatttaatttaaaaatataaaatatgcatgattaattttaaaaataaatttgttaattaaaaagaaaaaaatgattaaagtatgcgattaattaaaacatgtatttaaatttaatatataaaattaaaattttcaaaaataaaattataagaactataaaagaataagaagaaaaagaaacaaggttttacgacttttattttcttcttcttctttaaattatgtatgataagttgtaataacaacaatatggtgtcaaatttcataaaaacaaaaacaaaaatggtggcaaatagggtccagagagacgccggcacaaaactgattggcccctaattgtattttgttattcttataattcttttttttatgcttatattaataattcttttaaaatacctaaaaaagaatcgataagatgtgtgcgtattggccataaatagatattgttaaaaataacgtatgtgaccttgaaatagtatctatgtattcattctatacactgccgtggaaaatatattttttaatagttgcggtatagttagtttctaagatactaattcaatgccttcttacatattatttttaaagatttgatttttttaaaattaatttcttaatttagtctctgaatctaatgttatcaaacttgaagtgatgaattgatcatgaacttagttgaaattatatgtcactattgattggactgataaaataatatataaacttaaatgtgcaataaatataataattaaaatgttataatgagtatatagttgtgatgtaataagtaagaaaaaatcatatatgtattaataatgtaaattttatattatcttcgattattttatgagatgttatcttttaattaaaaaataattatagtaaaattgttaaattttataagaattgtttaaaacatatataaataatattttctatttaatttacaatataagaatttttgtatcggtagtatgttattaaacataataattaacatcgcttgatgagttaattataagtgatacgttaaaatttcattcatactcttctaaattaaattaaaatatatattttttgaacaacaaatcctaaatcctaaaccaagacatatatacccttgtaactttagctagcaccatcatctttatcattttggaatgcaacacgaagctaaaaatttactacaactaattgcttttccttatcacattttctgacgtttattgtgattttatatatttttacataagagaaataatttctacaaaaaatgttcgataaaatatgaagagaacgtgtattaataatttctacataagaaagaaagaaatatattatataaatagcattaccattgttgaaacttgaaagtgggtccatcgtttacaactaaagaaagacaccctagcgtaaagtatttaaccatgacatctacttcaattaacttgaagatgtagttccatctcaacggatttccgtctcaaatataattcttaataacttgctaataaccattggaatctgcagaatatctcgtttagttgggcacaatcctcaaaagcgatgtatttttttaatgaaaacaatgcatgccacaagaacgtttatatatacataattttactaaacaaatcgtatcgtaatacaaaactttattattattataacgtgatttgtcactttttgcttcagaaaaatacttgtacaaaacattaagacaataacataagttgccaataccatacataaaactctttaatgaatcataatgatgaaaattgagagatatttagttccatgataaagagtgtgtttgtgtgggaatttgaccaaacgcaattggcgttccagcgaaaacttttctcgtgtttggcgttttgtgcctcggaaagctaattttctccatttaaggtggtttggacggattttcaaacacactcacagcgagtccgtttcagtagaagtccttccagcagccccccttcccccaaagaaaaattttaagaacaaaaagagaaagaaaaaaaagaaaaaggaaaaacaagtcacatattttattcttatgtcagccaaaaacttgactacctgtagatggggcaataataactagctatttatcacatttcctagctaattgcctattttgttatggaccacactcccacttgcacccatcttcaacaatttaaattaggtaataaacattaagatatcctttaaaatctactcaacaaacagaagaattcaaatctgcaggaaaggtagacccatgtttaatactagctttctctatctctctcccactgggacattaatgttcctatatttcaaaaaaaaaataaaaaatatatatatgatgagcaatgcagccaaaggtgcatcatcttttacgtcacacgaaagcctgtcctacctcttcaagctgcacaagcctttctctttcccagaatgattttttccttttcttgttattattactccttttggactttctatataatactttctatatatgttcccaataataccacattactcatgtgcctggaaaagaagcagcagtgagcacctagcaatagtgctctcaccttctctcaatcatttttcatttgtcaacttttatagacctcgatttgtgtatgcaaatttctttaggacatgtggcctacattagtggctaataagatattcaagaagagacttggaagcagcaattttatagcagattttcctagttataaagaacccttgctgggcatagtagacattgatcagaactcaaaacccattcttaatgatcacaaggacacacaaaaatacaagtaagaacacaaatatcctcttctagctagtacttttctatcttatgtatcatcatatatagaaaagttgtagatggctgaagtatatgcctgatcatttatcaagttcaattctattctgggttggttctgctttctatggttttgttcttctctctatttttttttctttcaatttttctgatattgttttttacttcatgtaagggtatttgttagtacatggaacgtaggtgggattgcaccggatgaagatttgaatatagatgatttgtttgagacatgcaacaactcttgtgacatctatatactagggtattgtcagaactgcttcaggttttctagcatatatagaaaaacacgtttttaaatgtgtataaagaaactgaatctttgatctgacaataatatttttattactgttttccaatccaggtttcaagaaatagtgcctctaaaagcatcaaatgtattgggatccgaaaacaatgagatttctatgaaatggaattccaaaatcagggaagccctgaacaagaaaacacatcaaaggggcaaagatgctaaaaaacaggagctaaagaacaattttcccaataagaaagaaaatccagctaagtgctgtgaagccccacatgatttccaatgtatcattagcaagcaaatggttggattattcatatctgtgtggattagaagagatctttgtccattcattcggcatccaagcgtgtcatgtgtaggctgtggcataatgggctgcttaggaaacaaggtgacccaacaaaccccactcaattgatgttacttttgcacctgatcgaatatacgtatttgttttgtcctatgcactcatacaaatcattactgtcaacatcaattttctataaagcacctaaggcactcttggtaaagagccatgttaagtaaaagtttatcacataagagtttattcataagcttcatgaagcttatcaaaataagctttaaaattattttgttatagaaaatttagaaatgaactgaaaatccttatagaaaagtcataaacaactattaaaagttcaaataaattatgtataaactcttccatatgtcttaattagtgcttattaatagtcaatagtctaaagctgatcgcatcagaattggctatctaaaaatcctaattggggttttttttttttttcctttctgttttacaactccaattaatttgcagggttctgtatcagtgagatttcagttacatgaaacaagcttctgctttgtgtgcagccatctagcttcagggggcagagaatgtgatgaaaagtacaggaactctaatgttgctgaaattttttctcggacaagttttcctagaggccctttgcttaatttgcctagaaccattattgatcatgagtaagtgaagtttgaaaccgtccaaactgattctcaataatttttgcccccttgctttttgtttaataattatggtccttttccaaaaaaatcatgtaaacaaggtgcaaatattaaatacatttatgtttcgtttggtttgttggttcttgaaataaataatttgcttaatgaaatgaagatgcagcattaatgatcatctccggttttgaatttgtcccatagaaatcatgccaccaaaacattaatatattattcttcggtggtttaacattttaaactgaactgcacctacaaagttaattaactttgataatttatgaagaaattgttctgatacatatagtggttccgtgagtaaacaaaagttgtcaaaaaagacaaacagaacagaaaacagtagagagatatatttgcactggtaaccgtaaatgctccctccatttcttttcatctgttcatttaggaaaaaaattatttctatttatctaatcaattaaaaatttaattatcataatatgaattactggcttttcaattatatctttatctatatttaatttttgaatactttacatacacacttatcataaatgagagaaatttttattttttttaatcaaaggagattgtacaagaaagttaaaattaattttaatgtaaataaagatattattacattcatcctctggagttgaattttttttttcttttttaaaaaaagaatattcaaatgacagtaacaattaaactcatattgaccactgaaccatcaaattaataaaatatactatctcccaacttcatataattggttgtactttgaatgatatacatgtattattttagacacctaatcactgctggtcttgtgcagtcatgtaatattgcttggagatctaaattacaggatttctctaccagaagaaacgacacgcttgcttgttgaaaaaagagactgggattccttattagaaaatgatcaggtatgtatgatcaagatttaaaaatcttgttgaattgaatcctttaaaaaaataatctttgaatttgtttgcatcatatttatctcttagaatctaactaaattatattcaatgaaaacgaagctaagaatggagctaatgactggaaacatgttaagaggatggaatgaaggagcaattaaatttgcacctacctacaaatattgtccaaattcagacatttactatggatgttgctatcatggcaaaaaggcagaaaagagaagagcaccagcatggtaagagacaatataaaatccataattagatatggtcacgttcaaaacatttacattttactgttgaatacttattattaaattcttgttggttcttaatttaggtgtgatcgaatagtatggtatggtgagggtctaaagcaacttcagtacactagaattgaatcaaaactatcagatcataggccagttaaggcaatgtttatggcagaagtcatggttttaccagagctgatgaaaaacttgcaaagcttgttcctatcagaaagatacgagcaaattaaaactccccttgaagtttccaccactgatgattttgtaaatagaaaacgatcaagcttccggttgtgaataatttgtgtgattcaagctaggctttaaattgcgattgtgatcaatgttgcaattttatcacaatcttttgtattggagaaaaattgcataaaaatgtggcctttgcgatctctaattacaattagagactccaacaaccgtgacattgccatcaatattgtggttgcacgtgttttctaaaaaaattgtgtgatatatgtaaataaatgttcaattttacattcggaaaaaagaaaaaagagctagaagttcagaggaaggaaattgagaaacttctaggagatgagatgagatattatatgtttttgttgctgatgagtatacagtgaagttggttgtttttgaattattatcaagtatatatgtaatgtgacagaacatggaaatatgtcaaaacctattggaaaaaaaaaaactataatccaaattaataaatgaaacatttttgtagattgctacttgagaatcaattaaattatagaacaactacgcatccaaaatggcaaaataaattatatggcaattattgagctagttaaggtcctcaatattgttatctttgacaggaagtgggaacatcacctcttatcctgtgtgcatgaaagagcattgttagataatttttttattgatatgcgtagaagatatcattttataaatgcaactagggagaataaatgagctaagtggtgtttttctgaccaatggtatattaattgaggcgtgcacttgctgagggaaaacaaaaagagttgtgtaataagacttcatctgaaagggatcttgaatcgtgtcctcactagtccttgagatgctcgtctagagggtatgctatacagagccatcttcatgaagcacttgaaatttatagtggttgtcctgtttcactttatatttcacttgaagttaaattgcacggatggaggttacaaaatcaaatttggtaggaccccagtacagaatcacttatgctaacaatttttaattgatctcatattattttaaaatttattcccttaaaaattatgtattgataataagacttcttcatttgattctttcaacaacaaaaaaagacttcttcatttgataaataatattatatatacttttttatcgatatcatttgattttaacttatatatttttttatacatatttgaaatatattttataagatatactttaattttagttttatttttctttaatttaataatttaactactcaaaatgctgttaaaattgatattttatatttccaaattaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggtttcttgtttctgcaatgtgcttcatcaaatatgaaaatatcaaacatttgggagagtctgatattactgtataaaattatatgaattattaattaaaataatcactttttattagttttttaataatacaaaattgacaaataagctattattttctcttaaaataaaccaattcaagtcatacccgtatatatacaatttggaacattgctatttgtttctctattttttgttccgggaattctgtacctacacacctgactttgcaccaatagaaattatttatgggatttatctttacttttagaaaaaaccaattggataaattataagtgatgattagatatgtacaagttgatttcttattttcggatgttcaagttggtcaactggaggaaaatattttcttaggcagggatttcaatgaatgttttttttatcagaaaataacttgtatttttttttttgaaaaggcaaaatatactaaaacgatcaaaactggtacaaggagtaccagattaactgaaagtcatacaaaagtatttataattacgtcacaagctctctaacttcccaagtatatggcactaataattaacattaacgagtgaagctatgccaaaagataatcccgctcaaaatctaacacctgcagcatccccacaaaattagaaatacattacaattgctgcactatataaatattaatgacagatttccaacccaacaatgccacttaacgttgatcaatacacgagatgggattagaaatccacgaattcaacgagtaaacaaaccctcttttgcggatccttagccatttccatgctagatactgtgcatgagcagataacttgtatattaataatatggtcaaggggatttcaatgaatgttagtagagatagggcaattttgttggtgtttcgaagacataaactaggacaggctattttttattatttctttgtagcttatgatgttaaaattatgaaaacttgtttaaaaaataccttatcacttataggactgaaagttcaagattgcaaattactttctttatgataaaaaaaatgctgataaaggggtttgtaagtgtaaggattgcaaggtgattctgcaaaagtttttttatccttgatgttctcttagaaaggcataaacaaaaaaatccagcaagttaccaatctaaggatcaggtggtggtaacttaagggagataaacttcttacttttaagtggaaatttttgaaggaaagtaattggaaaataatttaaaacaggaggttgctaaagataaggaaggttgctaaataaattttgggtgaatcaagaagataagaaatttttgtggtggaatgaaaatgttcaagaaataaaaagaatgctttagaatctttaatgtggtcaataatgctgaaaattgagtaaggtgttgaaatgataggaatgagataagaatagttgtgagtgaaacacaatctaaagcttataagaagttttacaaatatcttggaacaaagaatgaataatgtaagatatataagatcacaaaaaaaaaaaagaagaaaaaatgagagatttggatcaaagtgtattaaggatgaataagggattttttttattatcataaatcaccatttagagaagagatgggagaatattatttcataagcttttcaattaacgacaagatcgactccatgtatggaatgactagaaatccaaaaaagattaacaaattaagtttgtcttattaccgtagaattcatgaaaattaatttgattttatttggagatggtttatgttgtgttgaacaattaggcaggttgattaggtggattcaaccctttttatcatttttatttttgacaataaagtaaatactgaagtcaaaggtaagttttatggtatgatacacgactgactatattttatgatagtgaatattggatttgaatgggataaaaagaaaaatctaggaaaaatattaaaaaatgttaattcacttctttttaacatagaggagttgctaccagcataccacaccaccttgcacatccataccaaacacgggtagatactctacactcaaaacacaagtgtgaaactaattcatcgtgctttttacacaagctaggggcataacaaatcacccccccgacatccttaatgagacaactttgttgggttgatagtgaaaataacttgttgtatttaatgcataacgcgtcgatttgctcccaactaaacatctttccaaaagaccacatcatttcctttcccaagcacacaccccatgttgatccagaaccaatcctcttgagagtctgtatgacaagttgatgcaacattcatccaccagcttgatgttatagggtgcttcaattaatagatcttcttcattagcagctctagcttttataaccagcacccaaagggagtccttctctctaacaaatcgccacatcaaagatttattgaaacttcccatattcctcaaccccagctcaccactaccctttggaagacagacctactgtcatttaaacccaacatatattttagcttcctagactcctcgcatgaatacatgctagcatatggactatacaataattcctcctaattaagactccttatatatctctatctctcttttttctcttatcacatctatcattattattattattaattataacaagaatcaaattatattagaaaaacaacctaaactatatagaattaatttaacaaatttatcaaccctaacttggaggattttatttacacagaaaaaaataaaacaagaaagaagaagggggtaaaaatcatatgattgcttaaacacacacacactcccttcaagtcccaagagctcttggcttacaaaacactctagaaaactttctttaatagttacaactaaaaaatatgccaaaagtttgtaaaaagtcttatgctttccattgttggaggtgcatgcattttgactttacatcatttgttcatatttctccttcagactatgttgcatcttttgaccaagttgcttcatttgtgtgggtgatcgagcataattatatcgatgtctctttaaagtactagtacacaatttataaattactttggacttgacttctcatgcatattattgcttaataccatggattgtctgatcttcaaaaacccaccaaaatatggataaatttcctacaccttaatactttcaattaaccatgagagacttttttatttatttatccaaaccacatttcatttaatactctccttttaaagatcttggaagataaattgattaaataaattgtaatcactctcattgtcattaattataagatacaattaactaatttatgcttattaagaaaaatagataatttaattatcaccattaatttttttataattataatattttttaaaatttattcttaactttattaaaaaattagttcatcttgtctaatctccataagagagaaaaaaattaaaatattatagtaaaaaataagtaatacacaagagagataaaatatagttttataataaaaagattaaaacgttattgattaaaatattaattctaatgtatatatattatgccacgagttctacaataatcaaatggtactttatattttccaaattcgtataaaagcatttcagtttcaatcatatgatcactctacatagacatgaaactcctagaaaaattgaaaaatttgatgtttcatcttatgggtacgtacatacacccacatcttcctacaatgattatcaatgaagctaaccaaatattgagcaccaaaaagtaacctttcagactccaagatttagtttcatctttttccatcttgaattacattgaacaataactccccttataaccatatcagtaataccattgttaaggaaaataaggggttaaaatattgaggacatctctattttttttatgacttttgaggacatctctataataaaaactacgagtaaagtatacgaataaacttattattatattcaacttaaaatctaaagacattaggtatttttttctcttacttatatattaattttcttattcatatctaatgagtgactacctcacactaactgaaaaccaaacagagcataagatgtatacgttatattcttcaaaaaaaatgtatatgttattaggtatatcccacaactgctagtaacttttgtgctcgtttatttttaattggattaattatactttaatttatgtataactttggttcttttaattataattgtttatatatttagcctgtacagattctcaactattcaaactaatttccttccgcctaaagtttcatttaataattaacagaatataatggggatacgagatatatacttgcaaagtaaaaanaatgtatatgttattaggtatatcccacaactgctagtaacttgtgtgctcgtttatttttaattggattaattatactttaatttatgtataattttggttcttttaattataattgtttatatatttagcctatacagattctcaactattcaaactaatttccttccgcctaaagtttcatttaataattaacagaatataatggggatacgagatatatacttgcaaagtaaaaataataatttaaataaaaatgaaaatacctttaattacattttattatttccatccaaagaatatagaacaacaaatgtacgagtaatatcctgctaaaaggaaaagaaaccttgaaaagcacatccacaagtgtctttaaaggtttgtccaaaggtgagactaccagggacttggtgcaactttttaaaagataaattaaaaacaaagaagaatttggaatggtgcatgatgatgatgatggagcttgaggcacacttccttctcatagcaaccaaaggagaagccctcatgatgccccacaaaaataaaccaaaacaattcttaaatatcaaaagatatatatatgtaaccatatatagaaatatgatttcatgataagaatgaaagaaattagagtttgttcaagacatccttcatcaagctagggttggcagtatgaaattcaatcaactcattcagtgtaatgtatccatcaccgtctttatcaatctctgccattcgacgctcaacttcctcctgtgaagttaagcctagcactttgagagcatctgcaaactcagacaaggagatattgccatcgccattcacatcaaagcgcttgaaaacgcgttcacactcttccctttcactacccataacttttttcacgagaggaattgaatgtcatgtactgaattaatattgaaatgagtgagatatttatttaagaagtaaaaaaacaaaaaacaaaaacaaaggtgcctctagctagagactcggtcttgatgctatatgatcggacaacctttggagttttaccacatgcaagctcattcgctggaatttgtataaccatattgatttcttgtctagctccaacttttctttcgggtttctatgacaaactattgctcgagattcatggactttctttagcatacttcataattaaccaattttagttttgtatgatttttttttattttttttttgtgactggtactttgtacatatatgaacacatacaaatttggaatattaattcttttgtgtgttagcaacctatatatgtgtatatatatatatatatatatatatacatatatatgcaccttgggaggctaaggccagtttttagaattttgaaggatatatgtacagatctagatcactaattcataatggagtagcttgaaattgaatagattgattggatatgatatagctctattgaagaaaatgagaaaaccattagttaagagagaaaatgaagaaaattaagtgacaagaaaagccaaagaaaagaaagtgaaaagaggtctacttagaatattaattaggaaaaataattttttatatccttcgggtgtatgtggcaattaagagatggaaactaatattttaaaaaatcttgaattgagattgaaacaatattaattaaataatacataaaataatagtgttaaaggaacataagaccataactttaaaatactaaaaactaaaacacaatttcataggttcttaacatttaaagtatataaaaaattcaaatcaaatatattacaataattacaagttaaagtttcaacaatacacaaaaacatttattaataataataagtttacattcagaataaaaaagaaatgaaaaataatttaggtggattttcattttttttaaaaaaatcataataattttgtattaaacaattttcgttgacctgctatagacttttttttttcgattttcatcagtttctcaattttgacatttttttttcgaccgatttttcttcaagtcgttttgtggtttatttgaatcgaccatctaattgattcacccatttttcagttcgaccaactgatttgattcgattttaaaaacttgcataaaagccataaataataaattaagaaaagaagttagaaatacagataaagataaaataaataaaaatgtgaaaaaatgctaatagtgtaagacttgtgttaattaggtcttattttttacttttatcttaggggattaaaattgttattttattgttaattatctccatttataaaactagttaaatataattttgttccttcaaatatagattcatattagttttagttgtccaaaaattattttattgcatttggtccttgaaattttcaaagttttttattttaaatttttcggttaaaagtttgtaacaataattgcttcaacatcaacaatttcatttctaacaataacattcagtatgccctgcaaaaatagaaaaaaaaaaaagaagaaaaaacatcttatggctctagttttctcaaacaaggagcatatacagttaaactcatattatctatgatgttggtagaactgattctaggaagtaggaacaaatatcaaaaggtgcattgacagcaaaaggttgaatctcagtaatattgtctatgaaggtaacttacatttaataaaaaaaaatatcaactaaattaaatactgggtttaaaagaaaatttaaaaaactttaattttaagaaataaatacaaaaaaatatttttaaattatttttaatatatttttagaagtctaaaatcaatattgataaatatttggaagagcaaaattatattttattttattttctcattgctgataagatgttcaagtttagagaagagaaaaataagaaaatatgttgttgaaaaaataaaaataaaagtactgaggcatgaacacacataccacgtttcaatggttcaacttgctatagtacttgctgtggaggcagcagaacagggaagtgagaccggtggggtagcgttgaacgagtaatggttgagtgtgatgaaaacgatgacgaagcaacaatgtcaatgtcaatgtccatggaccctcgcgcgaggcacgcacgagccataacatcacacgccaaagaccgcgcagtgtggaacaacctcataacccactactccaaatccaacctctcatcctgcgctgtctccctgtttcacagactcccttttcctcccaacgttgtctcatggaccgcattaatctccgcgcactccaacacccccctctccctccgccacttcctcgccatgctccgccacaacactcttcccaaccaccgtaccgttgcctccctcttcaccacctgcgccgccctcactgccgtctcttttgccctctccctccactccctcgccctcaaactcgccctcgcccgccaccccttccccgcctcctccctcctctccgtctacgccaagctctgcatgcccctcaatgcacgcaaggtgttcgacgaaattccccaaccagacaacgtttgtttctccgccttggtagttgcactcgcccagaattcccgctccctcgacgctttgtcggtcttttccgacatgaggtgtcgcggttttgcgtcaactgttcacggtgtttctggtggtttgcgtgctgcggctcagctcgctgcgttggagcaatgtagaatgatgcatgcacatgcaattattgctgggttggattcaaatgtggtggtgggtagtgctgtcgttgatgggtatggtaaagcgggtgttgttgacgatgcaagaagggtttttgaggatagtttggatgatatgaatattgtggggtggaatgcaatgatggctggttatgcacagcagggggattatcaatctgcttttaaactgtttgagtctttggaaggttgtggacttgtgcctgatgagtatacttttttggcgatattgactgctttgtgtaatgctggaatgtttctggagatttatcggtggtttacgaggatgagagtggattatggtttggaaccgagtttggagcattatacgtgtttggtgggtgcaatggcacgtgctggagaattggagcgtgcggagagggttgtgttgacaatgccgtttgaaccagatgctgcagtttggcgagctttgctatcagtttgtgcgtatcgtggtgaggctgacaaggcttggtgtatggcgaagagggtgttggagctggagccaaatgatgattatgcttatgttagtgttgctaatgtgttatcaagtgcagggaggtgggatgatgttgcggtattgaggaagatgatgaaggataggagggtgaagaaaaaaggtgggaggagttggattgaagtgcagggagaagttcatgtttttgtggcgggggattggaagcacgagaggtccaaggaaatttatcagaagttggcagagcttatgggggatattgaaaaattagggtacgttcctgtttgggatgaggtgttgcataatgttggggaggaaaagagaaaggagtctctttggtatcacagtgagaagttagctgttgcgtttggagtgttgtgtggatctgcaccaccagggaagccgttaaggattgtgaagaatttgaggatttgtaaggattgccacgaggcttttaagtatatgacaagagttttagaaagggaaataattgtgagggatgtcaacagatatcacagatttgtgaatggtaactgtacttgtagagacatatggtagcatatacatgtttgaggcttgtttctaattataagtgatgctgagaaagaaaactgatttttccccattacggtaagtctttttcttactggactttctgtattttgctttcatgtttttgtttccattttgacttcttttgagttagatcaagtttaagatatttcattgcaacctttctagtgaattcagataggtgaacctttactctgaaaattttagtatccaaatttctcttacaaacaaggagatatatttggaaattgtgttattcccacagttagtttgttgttttcttatggttattgcatgagatgcagatgcagttaagatggctgagtgggcggaactccacttaatccacttgacatttgatgtttgaataacattctgaaactgtcgaggtgtctaggtgagtacactttgtgtctattgtatctgaaagattgcttgtgagacatgctatttaaatcccgagcttgttctttttcttgactgaacaatatattaaatagggccaacgattgctatacatagttaaagtcctacctatggaaaacaattatgcaaaaccacaaatgcaaaatttgttatagcttgtctcaatgtactcccattgaaaagttcaattgccaaagttgatggaaaatgagggatgtgaggagccaggaggtaggcatacaaaaaaaaaaacgccgcatctagttatctgtttaaacaggcaaggaaaatttatagtttctttatattgttttcattctttgactttgaagccacttaaattcatgaattgctaaattctatcgggtgaattgatgcttcaatctcaataatcattggtaaattaatgcattgtcattttatcagtgtaccatatttggttttttgggtggtcctaagtaagtagtattgttaaaatataatgaattttttgtagaagtagaaacgtaggattaattgggtcagggttttgcatccatcgatatatttccaccttcatttaggctgaaggaacctatttgtacactgtacagtcacaatgtaaataccgtccaagtgagttttgcatccaacactttgagtcgttacaacaacctaaataaggagccatttttaaggaagctagttaaggaacatggtttggtaggatttaacaaataaaatgtcctcgatgtttaacttcgcccaaaagactcttgagtccaaagtggaaaagtagatccagttagaggtcaagttaataggactcagatgtaagcagattactattctaaaagaaatgcttgtaacacactttttattattacaaacaattgtaggtcacatttcttatttaacgagttttactcataattttatagatttctgtaaattctaatcaataataaagagtgtattgtcaacactttttactctataatttaattatggatagagttgagtttgcgtttaggaagtatatctgtatcctaagcccacccaactccgccatttacattttgggggaaaacttacctgaccttaggacaaattaagtatttcctgtcaagtttggggtcggttggggccagtgccctttacccacagctttgtcagtttataatttgaataagcaaaatttcaatgtgttcttgttaagctttattctataagaaaccaaacacactctaagtctaaggttgagtgccatttaagccattacaattcacaaataattcaatgccatagtagcgtcaatcaacatgtttttaggtaaatcaggatgaatatatatgactgaaaatggagaaaaatcaaaagcaccccgtattttcaattttattaaatatttaaaacttcgtcttactttttttccttgtttccagttttaatcacttgaaagactgcatgaattcatgcatcaaatacagagagattggggagaacgaagtggagaaagatcgcatgtttttggaatcagtgaggaaatgcttatagaggaagaaggttgaggctgccattgtcaaaacacgccctcataacacttttaacagctgaagaagtgaagatttcaacaccactagctgcctttggggaacgtattattcattcattggaaaattcgacagcttatacaaaattcaaaaatcaattcatacttagcataaataattaattgtgttggcttcaaagggtaaagttattgaaagatacaatatatatgattgatattctgtcatagatgttactgcagattactaccataaaatttccaaaagggacaattgcaatgaactctgttgaggttagcggtaaatacacctaaaccctacttgctaaaatattatacatatctttctcatcttatatattgttcatatccgttatttaaaaaaaaaaaaaaaaaaaaaaaaaaaaaaaaaannnnnnnnnnnnnnnnnnnnnnnnnnnnnnnnnnnnnnnnnnnnnnnntggaatcagttcaaacgatcaagttactttggcagtatcggttatataaccaactagcattgaaatccatgctctgcacgaattctaaagaaaaaaaaagtcaaaaaaaaaaataattgagtaattgaataaaaaaattgtccaatcaatacatgatggtggtttgacagttttaataatattattgattatataactaattatgttatatctaaaaccaattatataatcggttgttggataaataattggttatttaaccagttttaagaaacaaataaatttaaaagcagattttattttatatattttctaatggagtagtttagtcattggttaagttgaaaaaaagacctttctaaaatggttctagcaaaatttcaactatatcattaacttagctatttgttttctttaattagaatcaaaatattttgaattgcattttattgcttacaggttagagtcatggttggaacaatgaccattatgccacgtttttttaaaatattttccagaatgtcacgtccaggaaacaatttcctacaatgccacgtgggttagttcgttgggcttgtcaacgaatttggtatgctgacgtggtgggtgttaatggacacataattcgctattcatagctgccttggaattttcggtcaagccacgtgtcagcccatgcatatttggttatgagtgatagcaaaataggtgtgggtatttcgctttaagtgctagcgaaataggtgtgattatttccccattataaagagaaaataaaaagattagaggaaaaaaaaagaaaaaaatgaaaaaaggaatttaagtaatttgagtaatttgaaaaggcaattaacaatatatatttttattatttgagtaatttaaaaataatttaaattttgtagtttaatataatttaattaattttaaaaatagataaaagtagtttaactttattatttaaaaatgcaaaggatactttttgaatatgatttaatattttttgtaaatattttaaattatttgattaagtattttagtaatttatactataattactttgaattacatttaatattttaattaattttataaatttttgaagtaatgttaaaatttaaattttgatagattgattgttggatgaaaatattttggtaacaattttaacttgtaaagcataacataacatatatttattttgattttgataattaaatatattgattttgttgatgaatttttacaaatataattatttttacttttgttaacacaatgtgataattatttggggtatattttaaaaatattactatttaaaatttaagatttaaaataaaagattgaactaaacttaataaaaaggggtgtaattagccattttcaatttttatggataaacttattaaatactggggtgtatttagcagtgtacaccacttcaaagccttcaggttactcaagactttaatgtcatggaggggtgcagatagcaaatgagggtgcagatagcgaaaaattaaaacaaaacgaaaagtcgtatataagttacaactttaaagtcatatatatatttatgactttaaagaaaaaataaaaaatataaattaataattaaaattatatatttattaaaatatttaactatccaatttattaattttcaaacaatctaaaatttaaattttatttttcaaattaaacttacatgttattaaaaaagtatatataaatttatttgtcttttcaaattactcaaataataaaaaatattaaattaataagaaatttttttaaattatctttttaaattatattaaattaaataaataattacttcaaatattatatatatatatatatatatataattaaacacgtttaaaattatgttcttttaatttaaagtcattataaatatttaaataaattggtatgtttcatattataatttaaagtcattataattattttatcatcctctaacctaatgttttacatcatcctttaacctaatattttaaataataaattttgaacaattaaaatacaaagagcagaaaaataataaaagtaaaaactaataggctcttgggaggaagtggaataatattgaaggaggaaagtgagagtgagagtaaaattgagggagaaagtgatagtgaaagtgaggtagggttaaaggaggggggaggagtttatataggggtgggccaactggacctaattcgctggatccgcctgtgaattacctagttcgctactactccttgcgtgatatgccactatgatgaccgctctgcccctccaatacatgaatgccacgttgcgctgcctattttgctcagggtcccagcgaactaactcacgtggcattgtgggaaattgattcctggcgtggcattttgggaaatattttcaaaaaatgtggcatattagccactgttccatcatggttagggactaattaattaattataaggaaaggaaaaaagtgctttaagtgaagattaacaaaaaaaaaagggagggaaaggcacaaggggggaataattgtgattcttctttatattcttatgcattagaaacaaaataagatatggtaataacgttactattttgccgattccaatcaaaatatcctcatctcaaataaattactcatccgacattgagctgaaagtatatgcatgcttatttctaatcataagcatctgctatccagaatgatatataaaattttatagtaatatagatgatattaattgggctatatcagccaaattctcaatatatatctagagcaagctaggtccttttgatagcatctctaaaaattatatctgatttcttctcaccttaatcagactatcttccctcatatccatcttttgcaataggtttctactttctattactcttctcctcaatacatggactaaacaagagtttattgtatctttttttaataaaaaaaagataatgtagcaattgtctataaataacttttccaattgtctttgatcttacttgcaaatgagataatatactgatttaaaaaaatactatatactattatattatatagtagctggcaattaatatgtctttatggtattatttggatcatgtgcatttataaatgacaattcattagtatatgtatgcattgacgcagctctgacattagccgagttattgtgatcttgaggtacgtcatcattggctcattgctttgctagttgtattttaagcttttccggttcaatatttttttgaaaaaaattctaataagtttatggttggtgaatgaacttaatatgtatgaatttcaatagttatatcatttttaactttttatcacatgtattataagacaattaatgaagtcacaaataactatactacccgttcaaataaaaggtatatgatgtaaggctgatatatttcagataaaatataattaatagaaattctaaatatatatgatgatttgatgaaaaccacgatttgtttcttttgattaaaaaaaaacttttcgtaacatttataatttctctaaagataaatgccaccttctttccaaaggaatgcccctttttcttttggaaaatgttactagatggtacgaaaaattcttgcacaaatagcttgataaaaagtgtattagcagttctgttttctttctattattgtccttaattgttattttcagttgattttaaatactttgttagtgattttgagaatttattaaaatgtaaaagaagtttcgaacattcttgttatgcacttgaggttttcatccagaattttatttagtttttaaaattttaaactcgaaagcaatttgtaaaattgtaaaaagaaacaaaagacttattcataatacttttacattatcattccatcgcaaatcacaatgtatacaagttttttgaagtgcgtagctttttctctcaaattataatatgtattaattaaaaaaaacattacagtataaaaactttcaagtgcagagtaatttaatcttttatgagaactactacaaacaggacatccgtacgttcagatattaattaatagaatgacgtgagttgggcactaaggtttgctggccatattgcaatctgatatcaaaagtaaaaaagaaaacatgctacgcgtcaaaaaaatggaagagatcttactgaccaaatctcataaaataattcgttgaagcataatatagatttcattattttacgataactaaaacaaaaattattcatgttacataatatatatgaacatgaacatgtttaatttcataacatggattgaaaacgaagtttataaatggattgaaatgagtgtgttattttggagttgcggccagtgattccaattttccttctatagtcagttttccaattgtatttgtttttatccagacgaataagtttataagtattttcacttttaaatatttatttggataaacttttctaaaaatagttataggagaaggaaaaaaaataagtcttttataaattaaaatgagttatttattaactttattagttaatcattaattaatttataaatgtattttattttttaaagaaattatataaatattttttacaaattaattaataaaaatttattttaatttataaaaaaatatatttaaatttttttattatacttaaagaaacttatctaaatatgcatcttcttattgactcaaactttagatagcaaaatatggtaactcgcataccatcataatgtagaataaaagatcttttttaatatagtgagtaaaatatcggttacataagtacatatccacatcaacttttactatagaaattaaggtccagtattagagtttctgattgataaactatatacaacaacctactgacataattaaaggatgctgacccatcagatagttaattttaatcttttaccaagtcaaaacttttaaccctcattttctccaagtgtgacttcccattaagattgcgtgagaaaaagtctttgaagtaatcttccatcaacatgcttttgaacaagggtgggttctcagaatttaacaaacttttcacgggcccaatctctgcctcaaatttggggttgaagaacatagcaatagaaattctctccttctctttgttcactgcagccctatgctctatgctggtataggccccattactaagaatctgcaagatcaccgacagcatgagttatggatgaggaaatatatagtgagatactatcatttataaataagccatgattatcaactacctttccattaattaggtgttaatgcatgctgtttcagtttcaggccttgatatagaaatgtgaatacctagtacgttttgtcagtgtttatgacttgtctcatgttgttcttaatgtaaatacaataaaaataaagatggacaaaaataacaagaaataaaataaaaggagttttctttttagtttcacatataaaaagtttctctcctaaagtagagaaaatgttcattgtatttttttgttttactttttcttaaattaaatattttttgtaatgtaagaaataataaataatttcatgttaagaaaagaataatatggtacaaattttatttttttagttaatttaatttttaaattagtataaaaggctttttatacaatttatttatgtttcacttactcttctacatctacctctaaagcaacataatttctttatttctttatttttcatgtctatttatccaaacaaaacatcttttattattttatttttcttttacttctatcagtttttctcttttttcttttctctctatttcacttctaattcaaatacacataaatctaaacttaaaaaaaataatttcattaaacaaattaaggtaaaattttttgatcgataacatatttaaataaaaaagatcacactttagactatttaaaaatattttaaatatgatagagttataagtttatattcattatttctgtctttgagctcaagaaactgtttaaagataagtttgtcaatctattttaaagattttattaaaaataaactttaaattaagcaaaaaattattagttttgaaaaaaaaaacttaaactaaataaaaaaaattaaactcgttttaaattacaaaataaatataaaaatataagctgttttcatttatttgcatcatccatgatcttgacgtgacgatgttaaaaattttgctttatccatttaaagcataaaaaggtttgtacagtaaccggattaatttattggacatagtttaagttagatgcacaaaactagacttatgatatatatgacattctagggctaagttcaatagaccacgtgctgaattaatattagaaaaattgaatgaaaaaggagagaaaagcatgacacacctccatgatgtccccaacgttaattacaaaagcatctggaagaaaggtcacaggaatccaaaccccacctttctttatctcaagaccatccacaccattgacctggtgaaggatggttatgcctgtggcatcagagtgcggggtgagccctacaacaagctctggctttggacatggtggatagtatgtcattctcactgactgcatgccatcatcaaaaaactcctccacttccttcatctccatgcttatggcttttcctaataaccccagaagtgctatacctagtttcctcaattctctgaagtatgactccaaggtatcccttcacaaatatatatacatatctcataaggtatatatatacataaatatctgattacttttggtgttagttttccaatcagaattgatatttaatgtaaatcttataattattaattatacatacataagcatacaaattattatacatatctcataattaaggtatatagatatatacatacatatctggctactttcatactgttctccaatcagaattcatatttcatcttaataatttacattgatattgaatgtaaatttttattacgtacttgaattatcaaagtaaaactctgaattctaattagaaaacaacattaaaaataaataaggaattgcatataatttttctctttatttattgagggtttaatagaaaataaggaaattaagagagagaaattaatgaaagtatatacttcaatgatgcagggagctcagggagaagatgtggctttcttctttcaagggggttgatcaccatgtagaatctgtccccccagtcaagcttttgatctttacatcttatcacagttccatagccttgaacatctcctggtcttatttggtacttctttttctcttcaatgggaagcttgaagaacttctcaatctcaagtttcagcgtctccagcagttgagagctaacaccatggttcaccacctgcataaacaaaacagtagtcttctcatataagactaaaacacaaattattcagtagttaacaattaacagcaatgactaattaagtaattatattaattaattaatgcaaatggaaaagttatcactaattctatatttgaaattaaggatataatatatatatatatatatatatatatatatatatagtttgtgaatttaaaatctttgaatttcaagatcatttcgttatttacagacatagggtacaaacctgaaagaaaccccaatctttgcatgctgtgaacaacttgtcaagttcagcatcatctatagcattttcatgtagcaaggctttgaagtcaaaaacgggaatggttggcaaagtggtttcatttgatcgaattgtaggttcttgtgggcaaatatacatttctggtattcccatttctggtttcttgggtatgtccatcacgccaagaacacaaccagagctcccaaagacacgaacctgctgtgatgaagccattggtaaattaaattaaggtacaatgacaacgaacggtgtgattggtatttatgcagcaagaaaatgccgtattcagtttggactcgttcttggaggttaaaaaagttattaaaatgtggatatatttgactatgacgacttaaataattaatttttacggccatgatggctatttatttgccgcagtggaagaacttgtttcaaatgtgcatatgtgttacgattgcaactaatatatatccaacactgtaggttatgtatttgtcataattaatgtatttcgataaaatttagttgaaggatcaactgtcttttattttatttttatccatcacattgatttagagtatttattaattttactaataattattctatcaaaaaatttaactgatcattttttgttaaatttcttttctcaatcatatttttataacaaaatttaaatccaaaattttatttaagaaaaattggttcaattaataccacttgaattaattacttatggggttgatcaaatatcttttaatgatgtgattgcaagtcgttaaattgacaacacctacttggcagcgatcatttaaattaaatttggaattgcacttctagatgttatgtttcaggaaattaagtcctatgagaattcaattacattgaacatgcatgtgtgtgtatgtgtaagaaatgatcaatcatagatatacttcgtgaaaaaggatgatatttacttttcaacaactcggcttgttatgtagatttgtcatatatagctgaaaactcttttgtttttaaatttctttggagttttcgaaaaaaattccttctagtatttccttgactagctaaataaattgcttggtacaaacacggtttgcattcagactcaataaacaaaagcagaaaattcttgaagtttacccgaagagagcatgcgcaattattatacaatttatataggataaagatggattagttttcccttagctagcttattgcagaatttatagcaattaataaccattaattttcagcaagaaaacacaaattaaagaggtaggtgaaataccataaaaaaagtgaaataccattttagagtgtattggggtgaaaattaagaagggaggaacaaaaagaaaaaaaaataaaaaagaggaaaatatagaagagaaagtgattgtataataggacatgtcctaataagcaaatgaagtataaaagagatatagaaaaaaatgaatatgtatttacaagatttgtggataataattggacatgctttatttaataaaagtatctatataataactgaaagtgaaaagcaactgattttatggggaaaaaaattacgtcttttttaaagctccaaattaattaaaatgtgaaaacaatttttttggggactgattggtttttattttcaaaaactactgttttcattccaaatgcaattaataaaacaaggtttgcttaagcatagttagtgaagagtggtatagtaaggcatgaaataaagagagaaattaaaccagaaggaaaaagaaaatgacaaaaaatctttatttatgttttttttaattaaacaaggtttttgtatattaataatgatacttttttatgataaatgttaagatatatatcaccaaaatttacagtgaggtaaaagttcggtaacattaaaatatcgaattaacataaatatttacggtcggcgccgttccaacaatcatgcatgaaatgaagggcattaggcacatcagtaagttttacgtacaaatggccttggtaagccatgataactaattacctatagtaaaattaaagaaccgatgtccaatttatggaccaataactagtaagatttgacacttttaataatgatcttaagaacagagaattaacaatgaaaaatatttgtggtttataaaaaaacgattattaaagtttgaaaatatcagttaaaaaagggaattgaagaataaaaaatctccattagttccacctcaaccagattgcaagttgttagcatcaaagatttgatagctggatgcatgaagcaaattgaagctcatgcctttcatcaatgaatgctgttttagttgcaattatttgacttgtagccttagtggatacacatgtacatctacaaaacgtaattgtccccaaattaaattgtaggctttctttctaaagacattctttaagaaacttaaaatacaaagtttttttttattggaatgcaaaaaattaagttgataataattatattaatattctcctatagtttttatattaaatgttttcttcttttaatttcttaaataatatcataagagtactgattaacaagattattttccatatatatgatctaactagctatcacctctcaacatggtgttcaccaaatttctcacgacaattgcacccccacaaagtgagtcgctagtggccactaatggtccccaagatcagattgctattctcaatcatgcatctccattaattacttattatttgtttaaaataaatattttaatgaaaaggagcatatgttataataccactagaaaaaaaaattagaacggtatctatgcataagtttcctagtgagtttacaacaaaaaaagagaaaaagttcaacaatgtatttatgtttgtttcttaacatcacattagtatagagtattaattaattttactgataactaatctctaaaaaaaattaacctatcgatcataatttgctggtgggtttagcgttaaatggtcataatttaatgagaaactaaatatgaaaataatactcggtgtcaatttatgaaaaggtcaaaactaagcatgattatctgtgttttcaattatttatgtttagtatacttatttattttaaaatttggaaaacatataaacaaagttagatgtaatacaaaaaatactctatattataacaaattgttacgtatttcgaatttgaatgtacaaaaaaaggtatggtttcaaggttggaacacggactctatatatacaattcataacaatttttatgtaagaaaaaataaataaaaaatgaaaaatggaaaaatgaatgattatgatgggtcaacctatttacccatcattaaaatggtggcttatattatattatattattattattattattatcatccaacaactttttatgcatgctattttagcttgtcttgtatatagtctacgaatcaaatgtaaaacgacgggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcagattgataaaaaaaaatgataaatctaaggaagaaaaaggaaaatagaaatctgaaaaccaaactaagaaaggcaaaatgaaaattaagatttttatcaccttaaacattgcaaggttgaaacaacattaacccaatcccatacaacaccatatatcatatcaaaagaaataatgaaataagtgaagataagttcaattaaaaaaaaaaatcatacaggaagcacacaattctaatttttttaagttgttagttattttgtcttcttaagtcttttttatttgaaataaattttttcttatcaattatttcgatattcttctctaatgtgagcacactcacatgtctaattagtatttgataatatatcaacttctgacttagtagttttctttatttaataatttattatttttataactgaattccattaaaatcttatctattttaattttacgaaatattaattttcatgaatataacttgtatataaatatatttttgagtttttgaccgcactgatctactttgtatagtttcattcatttcaaaatttaaaggaaaatgaaaaaaaaaaaccctcaatatccctcaaatataagataaatttttatttgattttgcaaatatcattaatgtattttaattattctcaaacaaaatacttctgtacagagaagatttttctatgaacgtattgtgtgtgcgtgtgaatgtattatacgaataaattagaggcaacaaaagctaaacaagcttacgaataaattaaggttgatgagaattttcgtatcgacaaattttgtgcagagaattcaaaactattttattatcaagaaaatattctgtctatttattgtctgtcattttaaaaatacagcataacaatattattatctcatttatattgaaatcatttatattttaatatattatatatttaatttttatttattattctaattaatatctttaaaatgattttttttatctctcgtaataaataaaaagacaaatatattgtaaaaaataattaaaactaatagtattatgtaaacagaagttaaacgtgcctatatatccatttggaaggtagaaaaatatgcatttgaagttggaaaggaaaagcttttcagcatgcaaatcacgtgaaaaaaatgaaggcatctcaaagtgattttccaacgtcgtacgtcaatcctgaactttttggacaaatgtggtagaggatgtacaccacacacatatagtcatcaatggcgagtgactaatatagactagttgcagtcttcgtcactataatggctgtattgcatcgttcacaatttgatgaaaacattggtatgtcgacttttttgaaatggttgagggagaactttcttttttaattataaaaatagtgtgcgaaaattgaaatataaatttaaaaatggagagagataatattgaaaatatcacaaataaaaaaatctttaaaatgtctaattaaaatagtaaatagagtgagaataaaaaaatatatatgttgacttttttttactatatttaaaattatagtataatttgtaattatacattatatgtcatattaagaaaatatcatttatatcattattattttaatttcttttttaaaaaattaacttgtatttagaactaatcacacaacaattttttttaaaaaattaacacaatgttttctttgtgtattttgaaccaatacaagatggaaacgtgttatcatgttgtattgcttccgcacatcttgtaacacaacaaaacacttttttgttatgcattataaacaatggaaacctgtttccatcaagcgtactttttgaagaaaaaaaatacatatatgcatgaaggtgaacttagcaaaaaaatggaatccattaacgaagtccatacttttatttagggatattcattagttgaattttactaaacttattattaattagatcaaattctatggattgggttggatcaaacttgtgcatttttattgtcaaactccaaccgaataaatccattcataaacaagttaattcttgtgttagatcaatcgagtacatctaaattaattttttttaatatataatgactaaatgtctttcaaagagatcaaattgttataatatttgattattttttgttacaaagagtatttgattaatagaatgaatgattctaatgcttaaataatattttatattaaatagatatcagcatgaaaatatagatctaagaaataaaaataaaaacatcaactaaaaaaacatggatgaattaaaaattctatacatatttaattatatacaataatgaatttaaacatattagattaaattttgactcaaatcttaaaaaaaaaagattagattaaattttgactcaaatcttcaaaaaaaaaaaaaaatcgaaccaaactaattagatcattttaagtgattttgaatttatggttatctatatccgtgaacactttttattggattgttgaatcaacatgggactgaagactaagtacgggggatggaggatttcgggcctatgtttttgtgaacgatgcccaccatcagaatgttgtgttttgaactttttggagaaaacaatgggcctccaagtccccttacacaatcacaaaactaaagatgaaaaaatattttcattcacatgccacattgtaattatttaaataaatgaaagagacatgaaataaaaccacaattttaatttatttatataaaaaaaattatatactctttgatcataaatcctaagccgtctcacttccagatgaagtccaaggccggactgaacaaaacgaatgtaaaggtttaattcataaatagccttcaccgattctaattaagcctgtaaagtgtaaactaaaaagaaacaaccaaattaacatcccatagcctcagttgaagatcatggaaccaagtgctcttgtagtgccctctgtcctggaattagcaaaggagagattgatgagaatcccagagccttatgttcgtccgcttcatgaacgtccaatactatccatctctacacctttaccccaagttcctctcattgacctaagcaaactcttgtcccaagatcacaaggaccatgaactcgagaagcttcactatgcctgcaaagaatagggtttctttcaggtttgtcataaatttaatatagctagatacaattttcaatattgcatatagacatgatatgtatgtgttttagtctatatacttttgatcaaacatgattgaagtctttctttattaaggactttgatcaagaatttgcttttcaaactttacatatgatttaatgtcatatttaagaattcatgatgtttttttaaagttataaaagactatattcatatgtttcttacttagcttttaatgtttgaggattaaatttattaatataaaagtacaacaattataaccatgtttaattaaaagtataggaactgaagacatatttttctcactaggatgatttatcaattaccaattactcatgtaatcatgtttttagctaatatcatgtgcaaattaaccatgatcacagctaattaatcacggagtggactcttcattggtagaaaaagtgaagagaggtgctcaaggattatttgatcttccaatggaagagaaagtttgggcagagagaaggagaagctgagggatatggtcaactcttcgtggtttcagagaaacaaaaagttagagtgggcagatttgtttttcatggtcacttattccccaaccttcccttaccattcaggttctctttctctgtttgtcttggcttatgattttttgttcgtccgttaatctgtagagtatagtaaatcaatacgctttttttaacagagtatagtaaatcaataggctttttttaacactaagtatgttggtactgaattaaaaaacaaaaaaaaaaactccaacaatttctttgtcctcaatgctacttcattttgtggaattagtcatctctttgataattatacaggtatttagaatatgaaaaagatagatatttattgtttcaatcatgttttaatttgtaccaatctggataatacattaatatttatgtattcgaacacattaaattacatatatatatatatatatatatatatatatatcaagtaactccatattcaaatagtcaagtgacaaataaaataatttaatttggtgataatttttactctttctttgattttttttatctttatgacattaatgtgaaatattcattaagtttgttgatgattaatattcacagataaatttgacttattatctttaattaaattttttcttttaattatattttttcatctataaaattcaaacttaaaattttatttaaaaagactaattctagtctattgagaccaataacatgttgctactctcccttaggtttaatacggtttccttgtattaaattactaaaaaaatatataaaaatgacttagttaattttgacctatttattttgtatttaagttatgtaaaaatttgaatatatattaccgagaagcttttaatgctttacagagatgggtagcatgtaattttcaaaaacagtggatattgttaatgtgggtagattggtgtcttcatttgcagagatgatttagaggcttatttaacagaattaagaaaactagcgatccaaataattgaccttatggcgaatgctctatcagtgtataacatggaaatgagagagtcatttggtgaacggactcaatcaataaggatgaattattatcctccttgtccccagccagagctagtgatgggactcaatcctcattctgatggtggtggacgtgcgattcttctccaagccaatgaagtggaaggtcttcaaataaaaaaaagatgaacaatggattcctgttagacccctccctaatgctttcattatcaatgttggagacatgattgaagtaattatcttttatttcacatctagatagacatgaatgaaagaaattaaaagtaataattaaggtgattagaaaatagggaaaaaaaagtgtaagaaggatgtcaaaatttaaagtgtaaaaattattttggattttgacaactagtttgctctatgatttaataccttgttactttgcttacctttcctattgttttggcagataataacaaatggaatttacagaagcattgaaaacagggtaacaattaactcgaaggaggagaggatttccctagccacgttttacaaccctggtttggattctattttaggtccagcaccaagcctagcctgttactccccaaacaccagcactgttcaagagaattagtacaccagactactacacgggatatatacctttccaaagaactccgcgggaaatcattccttgatgccacgaagatccaaaatgaaaatgatgttgagaataactcttagaagttaacaattgatgaaagcataaaagttaaagcattaaaagcttcttggtaataatttaaaagttcagaatgaggacaggctttggtagctaaatcttaaataaatacctacaactgccgcgaaaagatgccttacaaggataaaactcaaacttttgagtgtggctgtatttattggggtcaattgagcttctacatgtttgagaatcttaggttaaatttagaagaaaaaaaatatttttaaaagaaataagtatgaagttagaaatttgtaatttatgattatttttaaacagttttgttttgtaagttgttttcataagctgatttctctaatttcatttcaaacaaaaactgattctgattataattgatgattataacaaaaatgctgataaaaataaatgaaaaactttaattaggaaactttcttttacaagaattaaaacctaaattctgaaatagtttttttaagagaaattctgaaatagttgagaagtgaaaaacttatttaacccttactatatatatgcaatgcatgagaacaacgacaaacatatagggaacatgccggccggcatgctgttgggaaaaagatgcttctttagattatagattaatagttggcctgcttaagcattatgaaattaagctcgaaaattacgaaattagtctctagtttgaaattcctaggtttgccattcacgagtgtgtcatttatcttaaacgtagcatatataccactgacagaggtgaagtagtactgttggcgtgtggaatccttagtcctattctagtataatattgtcattaaccttcaccaatcatatatatatatatatatagtttcattaagtagtatcctatattaatcctaccagctgtgtacaacatagtctatgctcagttgaagctatggaaccaacgtctcttacagtgccctttgtccaagaaatagcaaaggatgccttgacgagggttccagagcgttatgttcgcccacttcatgaacgtccaatactattatcaaccactactacacctttaccccaagttcctgtcattgacctaagtaaattgttgtcacaagatttcaaggaacctgagttagaaaagctgcactatgcctgcaaagaatggggattttttcaggtttgccatcgactttttcgttgttgttgtgtgtgtacaacgtacaatagcgattaaaacctaaaatcttgtacaagctatccgaaactctcaccactagtttgaccctagtgaattggtttgtcgtcgatctgatatatcaaattggtacaaagaatattatcctgatcagagaaaagttgattaattgtacatattagatagtcataattcatagctaggagtatcaattattaatatataaaagtcctgaatggatgttgcatataaacaaacgccttttattgataaaacataatattcattttaattatgaagtgaatgattcatcaatcaacgattaatttacagctgattaatcatggagtgagcacttcattggtggaaaaagtgaagagaggtgctcaagatttcttcaatcttccaatcgaagagaagaaaaagttagggcagagagaaggagaaggtgtggagggatatggtcaggcctttgtggtctctgcggagcagaaattagagtgggcagatatgtttttcatgctcactttgccaccacatttaaggaaaccctacttattccccaacatccccttaccattcaggttccactctttatctcttttgttgattatatatatgctttctgcttttctacgtgttccattaactgtttcttccattttaactttgaaaatatgataaaccagcagtaacttacaagaaaaacagtcattaaataaggatatggaattataatgtgtttatattataactagtatagtatccatgtggatacttgagttagtcataaaattaaatcaaatgtataatataattatatatatatttaattataactgttaaatatataatataattatgtatatttagttgtaattttataaaatttagtaaataaaaaaaaataataatcattgtctattttaaaaaaataagaaagtggatgaataatataaaatatattattatcaatatttttttaccattttttttgataatgtatatagatgaaattatatctcacaaagaaaatacttgtacacacataacatttaaaaaggtagttaagacaacatattatatatctagattggaaatatattaaaaaaatgcaagatctagtatagtttattaatgacaaaatgaatgtgtatgcaaaaataagagaaagaaagaactgaagtttaataatgatttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaaattaaaaacatcaagaaactttgcggttagaattacaaaagtgaaaacgaaaagaaaaaaaatggatgagaatcaacacaaatccatggcttcttgttgttgaacaaaaccctttttatttctcaaatgaaaaacatcaaaaaattcattaaacaaaaatgaaagaaattaaaaataaatataaattacatgtaacaataagaaaggtgccataaagatgaaacctacaccaaatgcaagatgtaccaacaaacaattactatattatcgatggtttaaagtctcttcaaaagaaaagataaaaataatattaaaattttgtattacaggttagtacaatactctgagtacataggtaatataattgtttacgcattaaagagaaaacatgctacagagatgaaagaaatgagataataggtattaaaaatttaaaagaaaaagattaaaatttaagatttaaaaaaaagattataatatacttaataaaaagggatgtaattaacaagtttcaatttaatttttagtctggaagtcacacgtgtcaggccacttccttttatagataggtgatattacatgtccattctccaatcaatgaagaaatggttcagcttgaattccgatcgaaaacttttattctgtccttgtacaggtcctaattttcccttcaccttagataaacattagatttgagaggaagaatcttggcacgttaaaaaagtttaaaagtttaatattttttaatgtgaaaataatgttaaataataataataaaattatgtaatccaaaaatattaattaaagatattttggcgctaaaaacaaggatttggattacaacactcaagttgatatattcgtcttcttgtatggttggaaacacttcactttgattccatttgcgttatattataactttgtgttgcttttaagttaattgaataatacaatttgcataatatttttttttcaatcacatttcttatcttatcttatctcatctcatctcatttttttttcttttttctttctttttttatctttctctttcctgagaaaaaaatattgtgcaaaactcccattgaaatgacattgtccctattaatttggtagcaatttttgttctctgtgatactaatttatttagaactttctttattctccttccaaacaattgtctccctgaaaatcagctaccttaaaaaaacaaaaaattaatatatggaatatgtcaagactcttgatgccttgatattcaaattaaacttgtctccatgcgtggacctaattatttaatgattataaatataataataataataataatttttattattattataataaaaataagtacattgacaatgtgacaaagtgaacactacattttttttaaaaaagaagtcaacactatataatgcataagtggtatcgcccaaaccacaaactagtggcaaactaaattagacttaaaaaaaaaaatacgtagcatctatatagtatattgcatattgacattgtattttactacccaaaacatatttttttttgtgggtgttacgaatcttcatttggtggcagagatgatttagagacatattctgccggattaaagaaacttgcgatccaaatcgttgaacttatggcaaatgcccttaatgtggacaccaaggaaattagagagttatttggtgaaggggttcaatcaatgaggatgaattactatcctccatgtccccaaccagagcttgtgatgggactcaatccccatactgatggtggaagcctcactatccttctccaactcaatgaagtgcaaggtcttcaaattaaaaaagatggatcatggattcctattaaacccctccccaatgctttcatcgttaaccttggagacatgatggaggtaattaattatactattaagtattaacaagctagatcaactttttttttaatatacagtgattaattgtctaacattttcaatttaatttttgcaaacatgtttggtcctttaccttaacaaccaattgggtagataatgacaaatggaatttatcgaagcatcgaacatcgagcaacagtgaacttagaaaaggaaaggctttccatagctacattttacaaccctggcatggaagtaaatttaggtccagcaccaagccttgttactccaacaacaccagcagtattcaaaacaattagtttacccgaatactacaggggatacctctcaagagaactccgtgggagatcatatcttgacagcatgaagatccaaaatgaagatgagaaaagctcttgacattgctgtgacccaaaatatgaatggtacaaaagcttctgtatatgaatttgacgttgctggggatttcagtttattattattgttattttaagttacgcatgtgctttctcatagtttcttttcatttttaggtgtttgttttgtataataaataagttttttttttaactactgcatgaatgaataaggtattataccatccatcaataagaaatctagtttagttattaaatacgatgtggtagaacttaaacacaaaagaagagccatatcaaaagactaattcattaagagaacctcaagacttaaatacccacatcaaataatttatttttctgtgtgagactcctaatataatgcactagttattgtaacctatctaataactgttatggattaatatgaataacaaaaaggttttataccattcatatccacgtacaatatatacgattataagacattatattgtattgtaattgaacttattgttatatatagcactgaccactagccactagatgatggcatatacattttcactcaaaattttaaccaactgtttaagtaaaaaaaattccataatggtaactacgtgcgtgtatctctagagcggcagtgatagtcatctctaacaatactctaacgctcaagtgagtgagtaatttaagaagcaacagaattgaattatgcataccttagcgatagtagattttatttctgttgggtggcatggatttttcaaaacaattgaaaaagtcattgacttgtttaagcttgaaccagtcattgactctatggaagtattgaattactgagtcactgattcatccaatgagctattggttgaatcggtagaatctctcacacataaattagtacaactatataatcaactagtctcaagctcaattctcaactatggcatttatattaaatatcttttacaaccggttcaatcatgaaaactgatatctacttattcagatctaattaagactagttcatactatttcacatgcacgaccagtctaataagatacatagatcagttacttgaccaattcaaataacatttcatatgaaatttaatttcaaatatagctcacatgtatcaagtcattttatctgggaattaggttaattgatttatctggaaatgactacttcatttttctcggcaatatcaaatgactacttcatttctgcatacagtcaagtgcaccaatttcaaattaatgcatctaattcatttatgcatagtgaatcaatctggttttttttgttgatagttgaatctcttttcatttctgcattctgatttttattttatttttttatgaactacttttatgcacttccagttgtagtttctgtgccaaccagatgctcaatcattttaggagcaataaaaaaaacacatttgatcctcaaagcaagagtgatcatgtcaccaatattgtgtgtgaattttttaatgcttgggtcagggatgataggaagagactgtccagtcaatgatgcaatcaattattagtagattgatggtgctttcctaaattaaccatgtttacagctaattaatcacggagtggactcttcattggtggaaaaagtgaagagaggtgctcaagaattatttgatcttccaatggaagagaagaaaaagtttggacagagaaaaggagaagctgagggatatggtcagctcttcgtggtttcagaggagcagaagttacagtgggcagatttgtttttcatgttcattttgccaccagagaagaggaaaccccacttattccccaaccttcccctcccattcaggttcttcattctaaatttctaatttgtctcttgtatcagcgtgcttttttttcactgcttttgcttcggtcaattacaattaatctctaaaatatgatgattccatgctttaatattaagttcatgatattacatttcctttaatagatggaaattggaaatcatataaaaatttactatttttctatcctatatattttttataaccatattgatgcgaagtagcaacggctttgttgatatcatttttcttaaacaaacagcaatcatattatatagtgccaaattgttatactgtagaaggagtcatataacaaaaatgtgaggctgatttgttaaaagttttaccatgtaattaatcattgattatttgtgtggataacttgataccttcaattgattgcaggggtgatttagacgcctattttgaagaattaagaaaccttgcaatccagatccatgaccggatggccaattctttttcaatagacccaatggaaattagggagctacttggtgaagcagaacaatcaatgaggatgaattattatccaccatatccccaatcagagctagtgatggggctcaatcctcattctgatggtggtggtctcaccatccttctcgaagccaatgaagtggaaggtcttcaaataagaaaagatggattgtggattccagttaaacccctccccaatgcttcatgttattggtgtaaaatatttctcgactttgtcaataattaatcttcaccggtaaatctttagtgtggtctaccctctcaaccaattttttttcctgtctatataaaacttgaacccgagatcttacttaaaaagattgaacttattgacttattgattcataaaatagtttaaaatagagaacatagattttttctaactttttcatttcttacaaacagtgattaatttgttcttaccatatcaactgattaatttggcaggtgatgagtaatggaatctaccaaagcatagaacaccgggcaacagttaactcagagaaagagagactttccatagccacattttacagcactgctatagatgcaattattggtccagcaccaagccttgtaactccaaaaacaccagcaatgttcaaaccaatcagcgcggagattacttcaaaggatacttgcacaagaacttcgtgggaaatctttccttgataccataaggattcatgctgaaattgaggaaagctcttgaacacttcaaaattgatggagacattaaattttaatatatggcacacaagcttctgtatttggcaatgcatctttttcagtgaagcatgtcataccaacagctattgtatgagtaaattgagactaagggtgttcaactccaaaccgatccaaaataaaaaccgaaaatcgaattaaatcaattttttttgaattggtttggatgatttttttctcaaacctattgatttggttcgatttgtaatttgtatttttgaaactaaatcaaacgcaatacttatattattttaatattatgatgtgtatattacttaagtttcacagcttttgtagttttatgtatacgaatttatacaatgtttatcattttctttttcatatgactttttaaagatatatttagtttaaaactgacgaaactttgatagattttattgttgaaggtttaacatattaataagtatcgtatgttgttattagtaattttttaatgtaatttaatttaaaaattgaaaataaagtatctaaattttaatgaaataatatcttagtaaaaattacaaaaattaaacaaaaccaaatagtaaaatattggtttgatttgaattttattttaaatgaaaattgaaccaaatcgaaccgtgagcacctctaattaatgttattccaaaaatgagaggcttttaaacaaagttaaaataataattaataaacataattattattgttctgttctgtgagaacagaattgtccaacaatggtgttggggtgtttgatgtatgatcaggttccccccctctctctctctctctcaaggagcttatgggaataaagcagctcgaggaagagaaagatcacagcggcagcgatacggtttgggggtgcagtgtgtgccgtgcgaatgaaaatagagggatagaatctctgtgtacctttcaccgtgggagatgtcgcatttataagaagctttaccttggaccttggaggtgtttcgccctggactcgtcatcgtgtttccaagatatttggagatacgtcagtaatccttccatttttattcaatcaggatctgattatcagtaattcaaatatttgggtcattaacaaaaagatacgatatctttttgttcatagtacccttttatccgtaacaattataaaaattattaagatggaatgtggattcctgttcaaccctttcctaatgctttcaccattaaccttggagacatgtctttcaaaacaaaaaattaacattggagacattttagaggtatttgaacaaaactattcacaactttttgtgtaagttgagtatctatccgttaaatcattgtaaattagtagatgtaagaagagaataaggccttaagaagcatttatatttgtgatgattttgatatctttatactgctcaaacctcaaacaccactcgatgactcaattgcctttgcaatatggttttgtaaatggtaacactggaatttatcaaagcattgaacatcgagctacagttatttcagaggagaggatttccacaactaccttttattgccctaatggccatgcgactaaacgtccaacacctagccttgtaactctagaaagaccagcacacattgaatagaagtattagtgttgctgaactctttaaagggtactttacccgataactctgggaaatcatacattgatgaaatgaggatctaaaacgggaatgatgaaatcaattagaacatgtgttgaaaacacaacaattagtcatactagaatcaagcaaagatgatcaatgaatatattattaagagattagaatgagtcaatttatgaaatattataataacataatgctctgataaaaaaatttaaataaaatcatgttgtaatggtttaagctagtggtctggtaagtaaaaagcagtatggtattactgaaatcagagaaaccatgcatatgcagagaagtcttgctacttgtactggggattgtgttctcttatctctggataaatatgatttagcatagatgcattatttacttttgttacttttgagataaatatttaataagaaggtttggtatgactttaaactatttactgtacttctttatatataattcatggaactctgtcatgttatatattgacatcctgcagtcttagcttatttacctttcggtcaacctttgagattatgattggccacaccatgaaagaaagggtcagaaaataatttagtaaggaatatgcatgtgttttattcttgagtgtttgataatgatgcctatatttccatgagtacataaagttgataagggaagaaggatgataaaaaaaaagaagttaaatttcagcctggtctcatggaaataattttgtaggaaataagggttaaaggtatttttgagcaatgtgtaaataatgttttagaaagcaattttaaaacaaaaaaaaagcgagagagaaaaatcaaatgtcctaaattgcgacttttagatttttggcaaactgttttttttcttaattagtgcattttcttaattaaagtagaaattagtgcatttatttttgggaccaaaataaagtgcattttctctctctcctagatgtgttctctccctaccttcttattactgttctctcaaaagtcaaatcacattaaattattgttatcattttcgatgaaattcataattcactctttcaaaacacataaatttgaaacgatgaagtttaaaataatgtcaaatataaattagtgttttgagcacattgattaatgaattaaattattttattaaaatatataaaattacacttttataatttttttgtttttcgatgattttttaataatattttttaattccttcgttcctttttgatagtttccataagatatatagatttgaagatctctctaattttttctctagtggtagatctcattttgaaatcataaggagagagaaaaaggtaaaaaatttattattttttgaactatgtgcatatcttgaaagttattctacaataacttatttttcatattggagatctcttcaccttctttattaagtgatctagtaaagatcagatcttgaagtcaagatttttactcaagatccagtactaaagatgctctaaatgtacaataatcattttaaataattttaattcaaggtatttttttataatagtagtataacatatgcgtattttccctttttccgtatggaccaaaaatatttttgcattaattaacggtcacagatctggccgtaattaacttgtctgaagagttatgcatattttgatcggattagattaacaaaaaaaaaaaagggtaagaaaaacaattatgatgccctatagcagggaaagagacaaaaaagagttagtgaaagtacctggtacctgcactgatgcttatatttagcttatgctagtcctgcgactgcaacctcgataaaagggaaagaaaagagaaaatagtgcgtgcaattatggaaaataaataaaaacaaaaataaaaatgttggagtggtagtagtacactaataagcttagctaaatatggatgttataacattcggaatcatagtcggcattatcatcctcttcttagtaattgtttgctacatcaccatcgaaggcacttgcaactcacgctcttgacaccaacactcttcaattccatggcattgggtagaaaaaagagtgtgcaattagcattattgcttctcctctgtttgtgtttggatctgggaatagcgcatcagcatcagcatcagggtcattctcattcccattctggtttctgtgcatccgatgcccatcatcactgcggggatgaccatccccatggccatgcgcatgaccatgaccatcacaagattgatggtaggtcgaagcttcttcccgaagagttagcggaggaagaggatatgaaactctatggcttcggtttgccccatcaccatcaccatgatcacggtatcgaggctgcagaactctccggtttaggtattttcatccattttctctcactccttaatgttgtgtcaattttaacattcttaatttcaaatgcagctcgtgggaattaggtcagtgatggtttgattaccaaattttgtagggaattagaatctatttatagaagctttgaggggccatgtgattgtggtcctatcctgatgtagggtttatgtgcaaagtgccgctagggtttatagactgatgcagattgctacgaagcctgtgtttcgtgcaatttataatgtaaaaatgggggtggtgatagggatttccacaaatgtacttggtaagtaacatatgatgtataaaagtcacctaattaagttacttaccgtggctacttccctatgttgtatagggtgggctgaggtgctaatcaggtagaaaattatggattggaggcaattcttgtattgaggattgatggaatgagtgtgagatgtcacttggtaggatgagggactgctagcttatctccaggatgtggaaaactctgtttgtttgactgagtcctgtttagaagattatgctcacggctttccttgtcccatagaggttcaattggagtaattcaacttgagtcttaaatacttattcaagttgaatgctcttctcgtccattaagcttgcacagctttctgtccattaaaagcatcctcctttaagtagatttttcatcttagtaacaacaaatcaaaagtcccattcataatgacatttggaaactattacttttttatttggagattaagattatcttcttcttcttcagacatttctaatagaatgcaattcccttataacatttatatttttggattaaaaaaatggacaataatagcataagatgtgtgctgttaatgatactctagctttctggaagctcaaatttacagattatttcagttttgatgtttatatagttcattggtttttattctaggcctttggttgaacgcattgggctgttcatttctggtgagcatggcttctcttgtttgtctgattatcctgcctgtaatttttggtgagtattttttgtcattttatacaatacaaattatgagggcgagccctggcacagcggtaaagttgtgtcttggtgacctgttggtcatgggttcgaatccggaaacagcctctttgcatatgcaagggtaaggttgcgtacaatatccctcccccttacctgcgcatagcgtggagcctccgggcactggggttacagtggtttttttttttatacaatacaaattatttatttttcaataggaaaggcttatctacagtatacaaaactgaatactccggtttattcaccaatttcagtacaagggaaaccatcaaaggctgttgttgattcattggctttatttggggtcaggtttcatccacctactttctttggtttcacttatcttgaattctctttttattgcttttctttctggtcatcttgggtattattcttccttatttccttatcatgagattttatacttcatggcttggaaatcgagaatgctagcacaatgctaactgggaaaagttacgaaatcatctgctgtcaataacttgattaaatatcttcttttatttctggttaacagtttttgcttcatttcattctcattggtcatgccttttgcaggcaggagctatgttgggggatgcatttcttcaccaattaccacatgcttttggtaaggaatgcatcataacctgtcttcagtacagttgatgcctttgttgattgattttgtataaagttcagttgaattgttgtaattgctagttttccattatttgatatcattggaggaaattatgtgtctcttttcctctttctctgatctccttttaactttcttattttctacgtgtgtatctgatagaggtcataataatagatggggcagaatatatcagagaagaggagttagtagtaattttgattagaagcaatagttgttaagtgaaaccacagcagtaacaaactaattgtagttactagacagttagctgttataaatagacagagaaaagagagggagagttagttagaaacagagagtggagagtggtgtctcgaaatcaccattgttactgtgtaattcaggcaaattgcctcattgtgaataaaagctactgcattttccatattttcctgatccagttcttatcaactggtatcagagcccagattctagggctttgtggaattgaatggcggcgaaggcaaataacaagatggaagcaagatggaaagatttttccgactgcaggaggtgcggacggaagagagaatggagatgatcttggtggcactggaaggtgaggctttgggatggttccaatggtgggaacagaggaacccgacaccttcttgggaggaattcactgtggccttgactcaaagattccagggagcaatgctaggtaatccctttcagttactgcttgctctgaaacaagaagatactgttcaggagtttgtttgtcaatttgaaaaattagtgggtactatgaatgggctggatgagttgttcttggtggaagtatttttaaaggggttgaaagatgagattagtgctgaggtgaggctacacgaacccagaaatttaatggaggccatgaataaggcaaggcaagtagaagaaaaactgagggtatgggcaagggctccaagaagcttgggtagagttttaccagtgcagaaaactaatgtctggagtgtgaagaactggaaggagggatcaaattggacaggaaagggggttgaaggaatgaataagacagtaagtggaggtgaacagatcatggcagccaagggtggccatgagaattggaaaggaaagaaaaatttccacaaattgtctcaagctgaaataaatgaaaaaatgaggaagggtgaatgtttcacttgtgaagaaaagtatcacccaactcatgtttgtaaaaacaaacagctgagactgatggtgatggaagaaaaggaagaagaggaatttcaaggaaatcaagaggaagagggaagtgaagggctgtatcaattgtcattacacagcattgaggggttcacataaaagatctctcaagttgtggggcagaattaaaggaagaaaagtagcaattcttattgattgtggtgccacccacaatttcatatcgaccaggctggtaagggaaatgaaattagaggtaacccccactagcccttattctgtagaagtaggtgatggacataaggtgagtagtaaaggaatgtgtaaaggactagctgttgagttgcccaatttacagattgtgcaaaactgttatttgtttgagttgggaggtgctgatttgattttgggtgtagagtggttagctagcctaggagaggtaaaggctaattttcagaagttaaccttgactataaaatctgaaggtaaggaagtttgtttaaaagctgacctagaattaataagggccgctatcagtttgaaatctattagaagtactatattggatgacgaccagggattcatgattgagttgaaaacagtggaaacaaaaagaggggtggaagagaggtctgaattggtgttgggagtgttggatgaattctgtcagatttttgaagaaccccagagtctgccaccacatagaagcaaggatcatgccatcaatattcagcctggagttaaaattcctaatttgaggccatacaaatacccacattaccagaaagatgagatagaaaaactggtaggagacatgttagcagcaggaattattaggaccagcataagtccatatgctagtcctgtcatattggtcaagaagaaggatggaagctggagattctacgtggattatagggctttaaacaagataactgtgcctgatagatttcctatgcctatcatagaggagttgctggatgaaattggaggagctgagtggttttccaagttagatcttagggctggataccatcagatcaggatgagagaggaggatgtgcagaaaacagcattcagaactcatgaaggacattatgcgttcttggttatgccctttgggttaaccaatgctcctgctacttttcaggcactaatgaatgaggtgatgaagccatttttgagacagtttgtattagtattctttgatgatattttgattttcagtcctacattagaagaacacattatgcacttaaaagcagtgttacacgtcttgcagcagcaacaattatttgttaacagaaaaaaatgtagttttggccaaagaagtttggattacttgggtcatattatttctagtagaggtgtagaagctgatcccagcaagctggaagctatgacaaattggccagtgcctagggatacaaaagggctgagagggtttttgggtacaggaggtttgtaaagaattatggacagatagctcacccattgaatgcattattaaagacaaatgcttttaaatggggagaggaggctgatagggcatttgatcaattaaagacagcaatgaaggagttacctatattaaaagtaccagatttttccaagcaatttatattggaaactgatgcttctggtactggactaggggcagtgctgttgcaagaagggaggccattagctttttggagtaaagctttatctgaaagaggtcagcttaagtctgtatatgaaagggagttaatggctgtggtgttggcagtaaaaaaatggaaacaatatttgctgggaaggaaatttataatcaaaacagatcaaaagagcctcaaatttttgagtgatcagaagttattaaatgaagatcagtttaaatgggcctccaaactgattgggtataattttgagattcaatataaaccgggaagagaaaatgttgtggctgatgctctttctagacagtttaatttctctgctatatcagtggtgcagcaagaggattgggatgaatgggaggaggaactgcagtctgattctcaaatgtatgacatttacagaggaattttgtccaagacaatggaaaaacctggttattcagttaagggaggcaaactgtattataaagacaggttggtgttggctagaaattcatcaagaattccattgattttaagagagttacatgattcacctgtgggtggacattcagggttttttagaaccttgaaaagggtagctggagtggttttttggaatggtatgaagaaagatgtgagacaatatgtggctgaatgtgagacatgtcaaaggaataaagctagtacactggctccagcaggattattacagcctttacctattcctaatagggtgtgggctgatatatctctagattttattggcagtttacctagagctcaaggtaaggatactattttggtgattgtggacagattcactaaatatgctcatttcttggctttgagtcatccttttactgctaaagaagtggctgatatattcattaaggaagtagttagattgcatgggttccctacatctataatttcagatagggacagactgtttatgagccaattctggaaagaactattcaggcaagctggaacacagttgaaaatgagcactgcttaccatctacaaactgatggccaaacagaagtagtaaacagatgtttggaagcttacttaaggtgtttaactggagataaaccaaaacagtggcctgctcacttggcttgggcagaattttggtttaataccaattataatatttcagcaaagatgtccccttttaaagctttatatggacaagagcctccattgctgattaaaggagctgaccttccttctaaattagaggaagtgaatcagatgtgtaaggacagagatgaattacttcaagagttgaagagaaatttgttaaaagcacaagatcaaatgaggaaatatgcagataaacataggagggaggtggagtttcaggagggagaatgggtgtttctgaagttgcagccatataggatgaagtcattggcaaagaaaccgaatgagaagctcagtcccagattttatgggccctacaagatcattcaaaaggtgggggaagtagcttataagctggagttaccagtagacagcaaaattcatcctgtatttcatgtttctttgctcaagaaggcagttaaacctacttgtcatcctcaacctttacctaaggttttgaatgatgacctggaactacaggtgcaggctgagaaagtgatgcagaagaggactacagcacaaggacaacaagaagtgcttattaaatggcacggtttacctcatcacgaagatagctgggagagtttggaagaaattagttctgtgttccctcaattagaccttggggacaaggtctctcttgaaggggggggtattgatagaggtcatagtaatagatggggcagaatatatcagagaagaggagttagtagtaattttgattagaagcaatagttgttaagtgaaaccacagcagtaacgaactaattgtagttactagacagttagctgttataaatagacagagaaaagagagggagagttagttagaaacagagaatggagagtggtgtctcgaaatcaccattgttactgtgtaattcaggcaaattgcctcattgtgaataaaagctactgcattttccatattttcctgatccagttcttatcagtatctctctggcttttctttttaccggtgtcattctcagcattagagtattaatggttgtgttagtttgatcgctaatgctttgaaaatgtaaaaaatctgaaatttgtttatcagctcttgaaggaaacatgtgtgaagtgatagtgactagtgtgacagaaagactaaaagtgtggtactggttattttacttgattttttttttcttttttcaaatcaaagattggagactttaggatattgattcttcctgtaattcctattgtctctttgttaccaactttcttaattgagaaaagtttcttcttgatccacaaatttggaaatctactgttaggtaccagaaagagccaagagaactagagaataaactttcatgtattgctatcaagtatcaagcctgtatcgaagagatacctggttctgcagtatgagaaacggagtacaagtgataaagaagaaaaatattctaggcaattcaagagtgcctagtccctcccagttcacacttccgaagcttataccccttgcatccaatccacacaccccaatcccctccctacttccagctcagcagttagttactaagtggaatcttactcccattctctttcccctgggtatgatcctctacatcacacctcttcctcttcctcttccatatacattttatttattttgggctttggggtcttacactaaggtcaactctttgatctagggagctataccttgtaggatgtgatgacatacagattcgtaggtcctgtactgctctttatactgatatttgtgttttggccagatgaagttaagaaagagtgagcgttttacttttacaatatcaggcagttgtttcctttggaaaagaattttttggtgtgtttacttattttgttattttatttgttgggagtaaaaattgtttgatgagtattaggtggttgtttcaatttagagaaatttctcatgctccattttaaatgttttggtagaaaaggatcaaggatatattgtactggattctgtttactctagtccataatttattatgcacattactttatgatttgcatagagactgcccaagcttgctgtgttcttgattgagttgattcatttcaatttccatcttgttttttttcccctattttgttaagaaggatatgttatcctttccctagttcttatgtcccttttcctttgtgataatattttgtttcctaaaaaaagtgttagtttgtgacataatatgattctcttttactgtaggtggagaacactctcattctcatggtgaccatggagatcatgaccatcatgctagttctggacatggtcattcacattctttagccgatctttctataggaatatccatccttggttagtagtgatatgcttgatgttcttactgatcatgttggttatttacctgcaaggatattttaaattattgacttcacttacttccagttactaattgcatggaataagtttatattttttcttatttgtattcagataattcagacttttggcctgggtgaaggaagtttattatgatcttttgaaaggagggttgtgttaggctctcaacaaccaatgtaaaacatgtcgaaatcccaaacatggatcactcacgatggattgtgtgctattcctagatttctatttagaattaataggttgtatttctcgagtacactgtttaatgagctagagttgttgtgttggagcttggattatgttaaatgtgcaagggtcttcacatttttctagaggaatatgggcaacaatatgagttcaagagtgccttattaggtttggtacttgaaatattggtactatgacaagtaagtatttggagtaggtgggcaccatgattcggaaaaggattaatatcatgtgtcttcaagaaactaaatgggctggagaaaaagctaagtatcagatttaaactttggtacatgaaaaaaagttagagggaagattgaaagaattacatgagtattattgtggacaaggattggaagaaaagtgtggtggatgtaaaaaggattagggagataagtttatctttaaaattaattggttgcatgggagactatcaatatagttagtgcttatgcaccacaaggtggatcaaaagcacttctgaaaaaaaagttttgggaagatttgaagggtttggttcaaggctttccacgaggaaaagaattttgtaggtggggatttaaatggacatgttggtaaaaaaaaaattacgtaccccaatgcccgcaggctccacgctatgcgcaggtaagtgggagggatattgtacgcagccttacccttgcgtatgcaaagaagctatttccggattcaaacccatgaccaacaagttaccaagacacaactttaccactgtttccggacatggtggtagtgagataaaaaacaatttccatatcttatagtggttttggatatctaattggggaaggacagtttattcttgatttgtcaatgatgtatgatttcacaattatgaacacttgttttaagaagcaagcagaacatctagtcacttattgagtccaatggcatcatgtaatctatgtagccaaccatacctagtaggataaggctatttttgttgttttttgtatgacaccatcatgacaaaccactttcatagcagtgagaaaaaaagtggggacagggaatttgaggttgaattttcttcttaaagccatgcttgtagctgtgattgatctcttccttcatcgtctcaattttctttcatctctatatttctctagtcatttgtagtcttcagaaagtaggactatgcaggtgggttctcttagaaccacaatttgttacaatgttttatggttcttgcagctggaattgtgctctttcttcttgtggagaagttagtgaggtatgttgaagaaaactcaggaggagctaattcatggacgcatggacaccaccaccataacaacaatagcaagaaaaaattgaaagatgataacagttctagtgtcaacttgcagtcagagtctaataatgcaaaagaagagagattgatagatgagataaaaaaagatgatcaagtgtcacgtgactccttgaagggagataatccatctcaatctgaaacctcactcagaaaggtaagatgagcactggtatgtcacttcagctgactgaggttggaatgcaccatttggtttggttcgaaccattgttgatgtcgtacatatgccatgacttttatcagtagaaattcccatttagccttcagatgtttgagcagttgtgctggaaatgcaattactaataggataataatatatgcaaaacctgaacagctggaataggatggttacacatgttgtataatgctctattagacatttagtttgaacggaatattggaggggatgagaaacaattatctgacaaatgaaatacttgtatcacagagaattggaagcaatgtgaccaaaggtgatccagacactaatactgtagatagcgccacatataatgtaaaatcttcaaatgttaaggaaccagttatatcaccaacaagtcttgtgtttggttatctcaatcttttctctgatggagtggtaagttatattttgacctttaattggttgtaaattgtaatgaaggaaagttttcgatgtattcatgcaaaatatattaatattgcagcataacttcaccgatggaatggctttaggaagtgcattcttgctttatggatctgtcggtggctggtctagaactgtgtttttgctggcacatgagcttcctcaagaggttcaaattcatctttattctatcacatgttcagttacatgagtattatgccaatctgcagaacattttcatcccatttttaggcataacttaatttgtaacaaactatttcctgaaggcctgaaaagtttgtttaatttgacaaagtgaagcaaatatgtatctttgttaatgtgacgtttatatttcttattgcctaattatttagttaaagttcataaagtgcttactgcttagatctttttattacttgattttaataagaaaattagcactgatatgttaaaacttgcaaattatggtgtcagaatagccaaacacatgattcacatgatgacactcaatttaatttatcattataatcttcattgttgtgtatttttaacaagcataaggtactatgaaacttcatgaacaatgttatactatgaagaacattctttctgttctttgatccaaacattttctctcaatctctttctcactacctagctaatactttcactagtagagggttcctaaaaagacttcatctggtgacatttatgcacatatgtcttcatcgatgtacattccaggtgtatattcagatttcagttagctattatattatctttactaaaaaaattctcactactcatctggttatgcacatttataaacatatatgtccgtgtcataattgaccagccgtccattgtcatgcacattccataccatggatccaagtccatgttatgaatcttttaagctgatgtttatttgaatcttatacattataagcaatgttaaacattctaggtcatctgaagccttgagactctttgagccttgattaatctggcatgaaagctgtaagatcttaagtatcctgccttaatgacacattcagggaaatataagttgaacattcagtgctatcatctcctaattgaggaagcgaaattcctgcaagtgatcatatttctgctattttgggtttcatgctttgttattgtcattttataatgttttcagcttagtattttgttcttgcttttttatctgatttttctgtctcaattttgtttattgttgacatatacattccatcggtattattggattgagatcttacttttgtcccaccaaaagttttatgctatttgtttcttccacatacagattggtgattttggcattctgataagatctggtttcagcataccaaaagctttgttcttcaactttctgtcagcacttgtggcacttgcggggactgcattggtgagtgttgtcttccattcaatatttcaaatgagtgagttgtttagtggatccacaaacggcttttacacacaattaacattgaaacaaaaataaaagtgaatattgacaataatgtgttaacaaatattattgtaaatgagtgcaagagaaataaaagggtaatcaacttttttttgaaaggctaaaagtgtaagtaaaaaattaaaatgagctaaaaatgaaaagagagattaattataccttagatttctatatggtaacaaaatgacgacttctaaacttttatgggactattataaatctttttaaattgtgtttctctgaggaatttacagttgtgttaggacttggacaattacgagtatcacatctacatacatttcaatgtcccagattcccttttcttgatttgcttcccgtcattattattattattattattattattattattatgcccaagaatgaacatggaatgaaatagaaaatcactgtttttggtgtaggctctgctgtgggggaaagatcctggacagtcatctttgattgaggtaaggaatgtttcataacgaatttatactggttgattgcaagttgattgattttagcaataatttgtctccttttttacagggatttacagcaggtggatttatatatatcgcaatagcgggagtacttgcagaaatgaataacagtgggaatacaacattaagaaatactgttgtccaaataatctccctgaccatgggcatggctgttgcccttggtatttcccttgtagaatgaaagaaatgtgttctgtttaggacttgcatgtctagattcctgattttccaattatttcacaaaaaatatgccaaccagtttacgaatgttctctttatatttttgctttatgctaaacggtgaacccagaaaaccttgtagggaaaggggaattgatagaaaatgagggatcaaacagaatgatcagggctttaccccatatgattccttactccctaacagagtgaactttgtacagtacatgttttttcttttcgtctttaatactaacctagcacaagaacgtctttttgtcaaaactgtgtattttgtaacattttactctcttttgagctgtatagcagtcaaaatggtttcctctttctgatgcacgtaagatgaagacactgattgtgtctgattgattttgtaccttttttcctcggttgtctttatgttttgggtttttgctgtctttctattttattctcttccaatggaaattgagcctgcacgcctacatttggacaagggtggtttatctcatatgaaactcacttcacacattttgatgggacgtaggtaagtaggttttgaaattgttaagagtatctttgtggtagatctcaaattgaaattttaaattattttggtggactcaatagtatcacataggattgaaaatctatcaagattttttttatttttttctttagtagtagatctcattttaagatcttagggagagaggaaaaaaaaattctttttttaacaatatacagatttcgaaggttcttttacaagaacttattctccatgttgaagatttttttacttcctttattgaaaaatctagtgaagattagatcttgaactcaaaatttttgttcaagatctaatactaaaaatattttaagtagaggctgtagagcatttgacatgcctagttgggacaaattttttttagaaatgctagcaatataactatttctacattatttattattggttaaaatttgttaaacatttaaaaaactgagggtttcattcattaaaatttgctagcatttctccaaaactttaccttaacaccataagtatttatccaacatgcctctgcacgatgaattgtataatatgcacatttgcaaacactgaagtatagaaatatctggatttagtagaaaacatgaggtacattttttgacgacccacacatgatgaatacttgggatcttgctgctccaatgctttttgtcttgctctattgaagcttactcagcttataaccaaaatgcatccttcgttacatggaatgttgtgatggaatttatttctttgttaagactcgaacttgtccatctgctgaagcacctgaaagatggtgatattctgggatggtaagggtgggaggggtggcattctcattaatggagtcatcacaaggtctcctccttcgtgtgtgagggtgtgatgccgctttcttactcctcgagctggaggctctgcgtcaatggtggtggttccttctccattcaccacggcccgggttgtctccactctcttttttgagctttctgcaaacctcttttcatgcatcctttcatcctgcaaaagccatgtagatgtcagtttcttccctgaacttcagagtgaacttcaaaatgcgttgaagtactccttttacactgcgttttctgagggcctatgaaacaaccagtgaaattaaatatcaagagggaaaactctggttcttattttccttataaaaaaaatccagacaaaccagtaactagttgtctagttgtcaacattcataggatctgattgtattaatttaattagcttccattatttattgttttatggtacaattttttgtacatattgtttaaagaataattctaaatctttttataaaatcaatttactaaatgcaaaaaatattaaatgtttcctttttatatttttaagatattaagtgtattttcttttctatttaatactggcttatatgatatcaaaagagaggataaagtaggaaagtatatccctctagctagaatcaacatctaaatgtttgacatgtagatatctagaaaacaaaatcgagtgatggtttatctatacagcatatctttttactaatttttaatattttattaaaaaatacaaaatgaaaaagtaattgtgtttaaatatcgtcttaagagaattaagaaaaaagatgttttagaaggattgagaatcatttaataaaaatcaaataccttgacgaacaccttatagctagatattgagaaatacattatgacttaatacatacaagattctttttttccttcaaagcaaacacctagacagattagaaacacattatgagaaatatctgcacagtactgatatagaattcttttctttcaaaagcttccttcctgttttgaatgattttctacgatgtactataccctaaaaagtcattctccacatctgtatgttgcaattcaaagttagaaagagaagctttggagggtgtacccctggtccagtatatatgtctttcaaataatgcagcccaaaaaaaatttatgtttagtatatcaaattcttgtgttttaatttatacggtatataaaagtacacctcctgaaactttacatgtcgattcctctgctagcaagaaacgattacaagaatacaactagaggacaaaatgcataaatacatatatatatcatggacatgatgggcatatgtaaaacaaacctaaaaaaacgaagctgcattaattatttttccttaccatgcaaacatcatatgataagaaaaacaacatatatgtgcttacgttgataactgaagactcgggcattgggcatttcacgggacgatcttcatctggtggctccatagggtgttctactgggaagaaatcagtgcttttatcaacaacaaccccttgaacatgatgcacttccatgatgatactgttttgttgttgtgttgcactagtctcatctatcaagggaaactggctctcttttccgtcctaaagtatgtaaaattgttttgcataagcaacagtgcaatatagaagaagagaaaagaaagaaaaatcatcaaaagattcttgtctattacagattctccaattacccattttatgaatgaaggagttggagagagaaacaagggtttgagagcacttacaaaatgatcctccccgcatgaaaatcccatgaacatatgagctcatgccagaagctgagaaaatgttggtttgtctgtctgttgtgtgtgtttgtgtctgtgagagcgagagaaagagaggaaaagatgggaaaagagaaagacagcataaaaaggaggaatatagcagaatgagagagaaagacagagagagagagagagagagaggtgcaatgtgggatcaccttgaacagttgaatacgaagaaagattcccattgggattttgctactagcttttaaaatcttaacctttcgctttctttgttttatttttgtttttaatttttatatgggtgcttgtctcttgacgaatcagaggcatggcttttcttttcttgctttgatgctttttaagaagggtagcagtgtacttggttgaaaatgttggtagcacaaatcatgtagatctactaatttagtgttattttatcttaactaattagtgatctcatattcaaatcttgatgcataattatattaaatagttaaagaaagaattttatcttccataatttaactcaaacaacatgattatctataataaaaaatataaatgatctagcaagaaaaaaaatatattctctcattttctgtttctctctctacacacaacacactttctgctttacttggattttgcaggaaggaaataaccaacagattttgtgcttggtgctgctgctaagttacgcacaacccatatatccgtcgtaaagagcaaaatcaaattaagcttagaaaatgaggtgtggagaaagagaaagcgagagccgaaagcaaaaatatcgcgtcattgccatgactttagtcttcacacttttgaagtgtagccgttcgtttttttcgatgtaacactcgtaaagtagtacgtagcatgtaacagtttcaacatcaaagctacattttacatgtatacacgcattaataatacttttccatagtatatgttcatatgaagatggtgtaaatttaggatgttaaaaccatttttttatgtatttcaagttgtatgatgccactgaataaattacaaggagaaaggtgcatctggtagctagggaagatctgcagcagcttctaacgtactaacttaattttccatatataaatttttccatacatttcattctctctttcatttccttcttttttttggaaagaggctagcaatgagcatcacagcataatccactctttcatttccttcttatttctctctttttttttatcatatcttttattttctttcttttgtacttccatttctattttcttttttatctcgatctattcactccatttttgaaaagaagttccagatcataatatgtccatggttaagacaattttcaacttataagaaagagttaataaaatttacttatatatcacgtagaaattagttaggatcgggatggttccaaatcatatagtaattctctattttgaggtagaagtttatcaacatataatttattagaaaataaaatatcacgaacgagactcattaaataataagtaagttttacaattttttgtaatctcaaataaattttagttaataataagaagagtgttcaatagaatgtgttatttctttaatggtttatgtattttaggaatattgtttgcatattttttccacgctagtatataaaatttggttacttcatattgagcaagtataatcttagttaatacgaacttggcctcctttttattattttaaatgtgatttaacaaaattttaattttctctttttgagatgaaatgttgattactattgctaaaatatttttctccctgtatatattaattgttaactttggccaacatacttgtgagagcgcgtcatgctcatattattcaatgattaagggggtgttcttgattaaagattcttgttattgacgtacgttttttttttattaaaaaaaacaaacttgatgttaagttttcgattgacgttaaataagcgagttaggaatgagaaacatcaaaacctagaaaagttgtctgtcgtagctttgttaagccgcaggttggggctattgagcaaaagtaagatgataacatcatccttaccgagcaaaaatcatattgaatttcttttaattaacttcaagccaaaataatctgttactcgttgaagcaaaacttttactgtagattagagcgaaacttttacttgtataaatgcatatgtaagtgtgtcaagtcactattgaatccatacattagtacataagaaaaaaagtaagtaagaaaaatagtatttatttaataatgtaaatagtaaaaggtttttttacacaatgttgaattagaaattgtcaagtatactttaaatactttataaatatttcaaaatttattgaaccaaccataatttttaattgattcacggtgttaataagttttttagactaataatgtaagtatttattaacttacaaatgtggttatttaatgtttgattttcttaagtctgatctttttgagttatatatatatatatatatatatatatatatatatatatatatatatatataannnnnnnnnnnnnnnnnnnnnnnnnnnnnnnnnnncaattacaaaaactaatttcatcatatataagtgtttcccattaaagcaagattgtcttggacagaggatatatacaatttaaacaaaaaataaataaaaattgctcagaacactgtaccataacttgaaggtgttttgatggaagcttcaagagattggacaatatatgagatacagaaatcacagaatcatgtaaatattggaattattcggataaattattcaatattatatactagtattttgtttgtgttgaacattaggctcaaaagacaccataaaaggaagaaagaccatgggggaaacaacagagtcgccccactcatatatgagcaaacaaaattgactgaaaagatggggcgttattgctgcagaatcaaaggagggaccaatatcaaacagtcagattctacaacgactcttccaaagtccatatgctccgccactaccaagccatttaaagatcctgaaaagctaaacccagaaacacaaaacataaatcacctcaaaggaggaccatatacccataataattatgttcatacttcatgcccccacgctctatgacaacatgtaaatcaacataatataataatagttaggtattattaatcagtatttttgagacattaattaagaaaaaggatttattatgaaaaatataagaaaacatgaaagaaattatatacaacacaattttatatattccaataaatatcttttctgtttttaatttcttaactaatatcttaagaacatcatatttgtctaataattatagtttaattaataatattgagtttaaattttaaatttataattactttaaaatttagaagattttttattattatttataataattttatctgacttaaataaaattatcatatgtaaaagatatctatgtaaaaataacccttagtaacccccaaaaaccttcatgcactgccttttgaaagaccaattatattgagcttcgcccctaaggagtcacccaagaaatgaaaagtctattttggagaatttggagtttgagagtagtcttaggaccacactacccttcgcatgattcctggtccaaattcaaatgaagtataaatttagatcacctaatttaacagtgggaaaataggaaaactttttcgatcctgtagtacatttttcctttctaaaaacagaaatcaacacatttagcatgcatgatgtacgattagttctctcttttaaattttttgttgtctcatttgaagctatattattagtgagggagactgaatattccttcccatgaaagaaatggcgttttttaaataaaaaaataaagattaaattgataagtgagtccccataattttaccaaatttttaattatgttcttgaacttttcttttcttaattgtatcttgaatttatttattttttttcaattggatactctgtctaattgctgctataaaaaattaatcatatacacttaattagatgtgtaaagagtggattggtgcttatgaaatatgttataagcataactaaattaattgtaaaagttttagcattctttttagtccaacaattatgaatggtttgtaaaagaatatatgaacttaattcacttgcaaaatacactattagtcatgagttatccagatatagtgtaccacatcaaaacatgtagattgaccaagaccatgaatatgtaatgctccgagacttgcaataattaatttattgcaaattttgcttacgttatttgtccaaattcgtccttagaataattcgtgcctttcatgtaatttggcaaactcagtaatttttttatcgataaatattaatttttataagaaatataagttggcagactcaacgattgattcacatgtcgtgccaaagagaagcatacaatcagattttgccaaccattaagctttgaagcaatgttatcaatatagattcatcttgtgaacgcaattcacacccttttttcttcttctcgtgggtcccttgtagccatttccccagtctactacagtaccatagaccgaatatatatatatatatatatatatatatatatatatgtatgtatatggaatgtatgcattgatttatttttcttttatttgcatttaaaatatggccgctgttttgcttttacgtgtagtacaaagtacgggtcatttcgtctagttttaataaaaagaggagtaaattttgggtatataaatagtatttttaattaaatattttaaaaataaaaataaagtgaattaacataaacccaatatcttaaccttttatttatttttataaacatcatacaactctcttgatttaaacataaaaaaagttatattttctttctttttctttcctttatacatttagaagtaaagagtcaaacttacaacttgttaaatttgagatccttatcttactcatatttgatacatttgtctcctataaataattttacaaagttcctcagtagcaggatcattagcaaagcacttaaacaacgccaaatgtttgtggttgagaaaagccagcgacattaacaatgtttatatatagccacaacatcatacacattcacgaaagcaacctaattaaggcatgtacgtagagtctcagcatcatgggacaagcatgtgaatgccaaacaaattccttctgacacagttaacattccagaataatctagaagctttagtacatatttggatgtccgatgcaattgaaagttgttgacaaaataaagtttacaaaagcatctatagtcttttttttttttttttgtatttagtttaccatgaatcattaaatttgatctctaacgaattcaactaaaaatcaaacatactcttagttgtgaaccacaaatagactctttattcgtttaatacatgtcaattagtcacttccaaatagcattttccaaacataataggatctagagttttacaaacgcatgacaactcatcccatagcaaagcttgttttcgactcatgatattaaggtaacaaccttaccaaaaatacgcaatgatgccacgtggatgtgttgtacatacaaattaaaccaacacgttaaatccctttgcgtttacgttgttgcacccctatcatccgcacgtcccaaccaccacacacacaattcacaaagttcaacaaacatatacaaaatatgaagacaaaataaaaataataacaaaagttttcaactagagaaagaagggaaggttgaaggtggtgaagaaaacaccaccatcaccctaacctttgttaattttccaccaccgtcacctttgttttgcagagatcaaaataatcaacaacaaggttttaaaaaatcatccacaaccgtgatttgagttacaacatcaaaaaatttcaactgtccacaaccacaattaaaatcacatccggttgcatttgtttgcaatttatcgcgatatcaacaaacgcgatcacaccgctactgtaatcgatatttaaaatcttactgatcaacaagttaagagaggggaaaatgagagtatttaaaagagccagtggagccatcaaggacaggaacagcatatgggttgcgaaattctcacgaaagggtccattccacaaccctgatttagaaaccgctataatcaaagctacaagccacgacgatcaccacatagattcaaagaacgtgcaaagagtgttccaatggctacgaacctcgcccttgtacctaaagcctttcgtgtgggtcctctccatgcgcatgcaaaagactcgaagctgggttgtggcgctcaaaggcttgatgctcatccatggcgttttctgcaatgacattcctgtggtgcaacccatggggaggttaccctttgacctttcaaacttctccgatggtcatttgagccccgctaaggcttggagcttcaacgctttcgttcgcgcttattttgcgtatttggataagaggtctgcgtttgtgtcctccgaggttaagccaacgacgaagcaaaagaatgttagaaataaaaagaaggaggtgaaggagacgttgatggaagagcttgaaaacctgcaaaagttgcaagggatgattgacatgcttctccagattaggccaaagaatgagaacttgaacgttggtttgattcttgaggctatggattttgttatagtcgaggttttcggtgtgtatagtaagttttgcaacaagattgcaaaagttttgttgagaatatatggggttggtgggaagatagaagccagtattggcctcaaggttcttcagaaagcatcgattcaagtggaggagatgtctttgttctttgagttttgcaaggatattggggtcctcaatgcgtctcagtgccctaagactgatagaatttctcgggaagatattcaagatcttgagaggataatcagtggtgcttcttccaagaagggtcgtggtgttgtgagaaatgatgaggataataataaggccattatggtgagagattgttcttccactgcatcggttttgcaacataaggagtcagagaatggtttgatgactgtgatcacgcaacaatgggaggtttttgatgatgatcatgtaatggttggtgctaaaggaatggataatgtgtctaatggtgaaaaggctatgattggaaccacaaccaatccttttgaggaatcatatagcatcgtaccttatgtacctgctcactatcaagctcttcctgatctaattagttggtagaatcatggaaccggcgtttatatgttgttcccttttcatttcactagattactatatatgtatattaatatatatactactagggagtccaagttctatctcaattaattgaacacgatacatgaataacaatatcttcaataattatggatcaaaaaaatataccgctggggaaaggaaaatccgaaaagtggaaaccaaaggggtaaaagtttttctgatgcatttctcttctccacattagcagaagatctttgtgaatccccccttcttcagcattaggaaagttttatgacgaagttattatgttcttattgttgttgacatgataattagatattgaaattgcagaacttgtgttgtcatctatttttattttttctcccttaattggatgttaattagctttttatgaaattgaacatttttaagtttagatacaataattagatcatggaactaaccaatttaattttatgcaaaatgtgatggacagatatctttgatgtggcagtataatggaataatggcgattgtcttttttagaaataacagaacataattgatcattatagcttagtacacatgagcgtttaagtaaccagtctattttcaattctgtgttgccatcatgccaattatatctctctacaccaggtcaattgacctatggctcatgaattgtattctttattcatgtttgagtccttcatcgctctcctcgcattgaaagtctcttcttaattctggttaaagcaattttacattttttattatgtcaacaaaccaatttcatgccttgctatgaacactttgctctggacttttgcctatgttgttttctcatacaagtccacccggtaacatgttgtatatgttttcttgtatttgaactttcccatttaagcttgagagtttcaaatccgttggaatcctattcttgttgttttcagatgatttaatttaattgctcaattttttcacacgtctgcgtcgatctctttccttgtacgctctaaaggcattttatctttatgactattcttttgtatagatgtgtttatgttccttgcatgtaagcatcaattttttcatcctctatgtcgcttaacatctaattcatcgccgacatggactcacccatgttattgcattccaaggttaggtaacatgctaaaacattttattttcatcttggctaacacaatgttcctatccactattcaatgctattttggataaaagttggggaaagtatttttgaaaatttcaaagcatatttcccaattctaagtttcaaagtaaaagtacttttgagctctccctattattagaattcaaatatacactcaatcataaattgttttgaactcctattaattatttagtgcaaaattacaacctaattaagtcgcacttgtaaatactgccatctcggttagtctacatcaaagattatttcagttagtaactactaaacacattttggacagtttgattaaatttaggaaagtgaaaaatataagggtacatattacattgacaccctctcctaacgtcaagttgctaacatctattatttgccttcatagtgtagcaagcaggtcggcatggcttcccaatggtagatttgaaatttcttttccaagttgacaatattccctttgaaagcactaccaaatatctagaattaggatacttttcgcattctcctctcttgctctatcaattcagccacaaactcggctatagccaaaattgaagactttagcggatctagttcttataaaataaaattagtagacattataacgctaattgaaacttaaagaaataaaataataaaagacaaaaaaatcattgatatgatatgatataatataacaaaaataagttagaaagaaatagaagatgtatcaaataagtatttgtaatatccatgtgcatgtccatatccatatatgattgttctattagtaatattttttcactcgtgacatttcttgtatttgatatatataacaatattataatattatattataaatatatatttaggtataaattataataaaataaataatatagtttaatatatagtattgaataatattatattatttacattacaatcaacaaaacaaaaagtatttgaaataaaaataaatattatattatttacattacaatcaacaaaacaaaaagtatttaaaataaaaataaaacattatttattatagttatttttattattacataaagtaatactattatggtctaaatataagaagaaaaaatttcttagactcaaatataagtaaaattttaattatttttatcatatttaataatatatctaaaaaatatccttcaattaatcaagatactatttccaacaatcactttttgtttttgatatcaagttctagtgaaggaaattttagaaaaaaaaatatttcttgaatgcaaataaaagaattaactaacttttttttaattaattagcataaagttagttattttttatatttaggtccaaagaagtatcataataatgtcattattttattatattatttagaaaaaatatgttttagtcattatattttttattaaatttgattttagtttctaaattttcaaactgannnnnnnnnnaatgctactaagaatcattaaaagtattgatttgatttttcaaaggaaatggttgttttgtgcgaaaaagttttcgtgaaacatgcacgaacgtgtgttgccgtaaaaatcatatttcctatattttttatttttaaatcaatatttactttaaaaaaacaatagtcttccagattcgtgctggaaatattctaaattgaagaaaacgcatagagcactcgagaaaggaattttaacacattagttaaaacattgggggttaagtttcatttgatttcatttatgaatcatgaattaaaatcaatttaattggactacttgtttcgtctaccaaagtcaacgttgcaactctaataaagttgcttaactgaattttgatggtcttttagtcgcattacatctaagaattttatccannnnnnnnnntagattttttaccgcccaaagttaaagaagagactaaattcaaatattctataaaatttaaggactaaattattaatttgagagtataagaactaaaattaagtttgaccaaaagtataaaaacaaaaaaaaaatatttttcctattatttgtaacaattaaaattgtgaataactaagtatttttctcaaaaatcgaggatcaattactaattcacaaagacaatgctactaagaatcattaaaagtattgatttgatttttcaaaggaaatggttgttttgtgcnnnnnnnnnnctcttacaatataatcaaatatatatggtacgtattacccaaaattatgttatgtttgggaattggtttttggagaggaaaggaaaagaacgacaaatatttatttctaaaaagaattatataatatttataaaaataaaccaaagattgatatattaagttctgctagtctattattttatctttttattttaaaaaattatcaaattagaaataaaaattatattctcctctcattttcttcaaaatccaactctgaaatgtgccatttaaataagaacattttcttaatagtacttttttatataatatcttgaaatgggaccaaaattatatatttaaatgatagaaactcttacaactcaaatcaacatgttgatgcgtagaagaactaaatgaaataataagtatgcatgagaattaaatacgaaagttttaaagttcgtgatgtagtttttacataaaacgccagtggtataaactttttcttcttttaatcatgattatatggattagataggaagaatcaccttttttctaacaagacaaattccaatgcaacttcttttatttctgatgaaagctctctagcattataatttccacttattatttatcctatttttcttatcatgagacttttcgtgcaaacggacgttgaataaaagcaaccctatattacattttttttttatgaagcctttttatgattgatgtggcatatgaatatagaggacaaaaaaatggttaaaggcaccactaacaaaatcatagaaaattgatcaataaaacacaaccacgtaagatttctgattttcaattcgtgggtcgaatcacaaatttcttttcgtgaaaacgggctcgaggtaataccgaacgaacaatcacgagtaaacgctctcaaaaggataaaaaggtgagtctaacaacgaaatgtcaacgcacaaaatccgaatacaattgcttgaaatgataaattgattaaaaatattttaagacattcaattataatgggaagcaagagtaagagtgagacatataaaagattgttaactcttaaaaattactgctctttattagccactagacaactgactcttaattactcaaacagcctctccctctcaaaaacaggacttagcctaccattagttttgttaggcatcataatcttctttcaacttctctatttcaactacattttagtttttcgggtcaaaaaccttttcctccttgtcagccattgaaatcccaaaaaaaaaaaaaaaattcttttatcgatttgtgccaaacaagttaatcgaaatgatggaactcattgttattatttctcacctatttttcactcatctcttctctagttatcttcaaccaaacacttttagtttctcatttattttcactcatcttttttatctcctaccctatttatctcctctacaaacagggcaataatgttaccgtagcctctactatttacagaatgagtataattttggccaacattgccaactaatgccaacatgttctgactattgctctatgaaagtaacctagttataatggaaacctatgaagaccaacttcctaattttgaatcggtaatagctgacttaatgccactactgcctcacaagagctaactaaaataaggggcaattggcattctatagagagtaaaaagatcgcgggtatctaatcatgccacttgtttctatttatgcaactcattgttatacttcaaaatttgaggtttaaaaaatatgctggactgcataatcgcaaggcatctcagatgtgattattgccttccaattgtgttatgggggagaaaaatactttgaaaaaatttcagctttcctgtccaaaagatatagctcaaccagattatggggaacaacctttttattaaattatttcccattatgtctctagactgttcagaacaggactgagaaatagataagataaaggccataaaatggtatagaatcatgaataaacagaatagatgactaattcaatggacaatagcactgaattaattgacaacaaacagtataaattcatccaaaattaacagagtaactcacaagggatacaatgcttatgcaatgaggtccctatcctgcaagtcccaggttttaatctcattgatatcatatagggtgtgattataggagaggaataggctcttacccccattatgcaacctctaaatccttggaaggatttgtcaggttttacatagtctactagaactgcaactgaaagattatccacacctaatgaagcacacttcaagaagcatccacttataggattgttaatgaactatacacaactaaaaaactgaggggctaagtcaaacaaacaaaggcaatgtgtaactgacaaaccaataagccaaaggaatgatgaaaagttaattcacaaaaaatcatagcatcgaaaaatcttaacaattttaaattaaaatgtgaaggagaattatccaaagctagtctatctagttataactcatctacataaatgttgatgccatataacatggttgtcccttatcacataaaagctgaagagggaaaaagaacaaaagaaccggaatatccaaattttaggtagaagtaccacaacagaaaaatcttggataacaaataactcaacatctgtgtgaaagaccacacaggtgtatatacaggtgaaacagaccaaatgtcatgtgtctcaacagcacctatctacctgatagtgacaaacttgttggtgccatgtctggcccaatgagtcttcagatcaatagggttagcaaagttataaccttcagctgcaagtttctctaaaacctttttaaaagcaccttggctcattttccgcccagctatccttgcaccacgccttttcatgctcattggcaaaggatatatcgacacatttgtggtgcaacaagccgattgccaacctccgcagccccaccgataacactgctgaggagccccagtgcacgaacaaaccggaataggtagaccagaaatgtccatatcaattccattaatcacaagctccatggtcttcttcggtggcttcgcacgttgaactggagcattgccattatccttcggcttcctaggtttcttagcttttggagtcgacagagcacccttagtttgccttttctttgacaggccaccttcctttttgacaactacctcttcgactctatccactttctcgtctcttgacgtatcaggtggttgtataatttgcaagttaggagctcccgatgtctctggaagaacagcataattaggattagtgggctgctgcatattaaaaaacctatctctttggtttatccaattatctctgacatagttcaatggcattggtgcttctgaaacaacacaatctcgtgggtgaaaagttccacttgcacccattaacatagccggatcacgaccaggcaaaaatggctttgtgtctcgtccagtcattccaggcatgagctgaagaccaagatgtccccctctgaagggttcataataaccccaattgggcatgttcagcacatcatcatcatccatgacaactacacacaacacaaaacaaaggatcataaagtttcaaaacatatcctttgcttcttctttcaatgtccaccattaaaacaatcttaaacaaacaagcaacatataccatgaactaataatacacaaacacttcaacggggaaattaaattccagatagacaaaacaccacgcaatttaattgaaaaatgagaaaataccaaaaacccaaaatcacaaattcaacaaaaattgaaaatgtcttaagattcccgaaaccaaattctcaaatcaggctcaaataagtccagattcactgttcccgagtgaaaaagatcggaacttgctcgatctaatcgccgcaaaacgaaaaccccacgatctgaacgccattacgatccctacatttcctcacacaccaaacacagcacacaaaagacgagctcggcgtgcagatccccaattcccattttagggttccaaaatttgggactagatctcgctcgttatggccaaggaaaacaaattcacagcacaaatgatttacattgaggctcagtggtagaagaaggaccccatcaatttcaaatttttaaggaaagcgagggagagaaggggagagagggtgggagagagagaattagaaagcgcaaagagagagagaaggagaaagcgcagagagagagagagaagaggtaggagagagaaaacttacttggtgggtgcaaacggtctttaggtttgcccttccggagagagaaagatgagagagacagaaatctgaaagagagagaaagatagaggagagaggagagagaaagatagaggagagaggagcaataggaaaggagagagagaagcggggttaaaaaatagggtatgtatgggcatatataatatactttgccacgctcgttttaaacaatatatatgaatatgtatttttggactttttctaatttcatataactagcttttgagttttgctaagcacgcatatagaaagagggatttttaaaaattaggagagagggcgatggggacaacataaattgggagaaaaaaaaatatgttgggctttgtatagaacttgccttgttctcgtaaaaaaaaaagaagaagatagaacttgccttgttcatgccagattttcttaatccattgaatgtgtaactccctcatgtcaatctcaatgccttttaaggttgatcctttttttagaagataaatccataatctatgtttatatttcaatcatagaagtagcaagaggtggatgagaaaatagtatagcatgtttggtttaaaattatattgactaaataatcagtttaaggataatattggtaaaattttgtttagttatgtcttcctcaaacgtaagatttttcattttttttttcattgcaactatttataaatagtggtataccttcaattaattttaaaatattaaaatataagttactttattataatgatttcctaatcttatgtaccgtataaatagatttaaaattaaaagaaaataatgtagtaggtttttttatgtaatgaattcctctttccttaataaaaaaacattctattttgaataatatgttctcaaaattagtctctaaaatttcaaatataatttaatttagtttatgaaactacaaaaatgttatgttatgttatactttcaaattactagatgtaaattattttaatatttattgttgtagcttcaagggataaaataataaaaacttgataactttagggtatacaataatatttttataattttaagaattaaattgactagttgttgtaattttgaggactaaataatgagatcatgatgatatcacaagctattaagatcaaatcatagtagaattggtgngttatcttgtattattagtcttcgatcatctagcatcagtttaaggagtataaacataatcttatgtgatttgttatatgaatcaatcgtatagtccaatcttaagaaattttgttgtaccatgccacaatgatttatttagagttttaaaattgaattaggatcaatcattaagaaagaataagaagtattttaatcaaataaggcttagagagacacaaaactttgatttatagggaatttgagctgaaagacttgagtccgaaaaatgaagactcaaatcccacaatccaaacctaagtctaaaatcatcaaattcaagtttacactaatagaacttgtaaagacttgaatccctcctaaaaagacttgtgattctcataagtttttgaggtttttggacaagtttttcaaatccaaatcaaactattattttctattgtggcttgagccttaaaagataaaagattatattttttttatcaattatgttatatcaatttgaattacaaactaaccttctataagtataaaaaacaaccttaaattttgtttgtgctcaaaatttgaagttcacaccttaaatttcaccaagcaggatggatcaacctaacctaatttgccacagctaacaaagataacaagaagcaacgaagattaagcagaaggtggagagtggttgaggaacgtgtgaaaagagatgagataacatttaaaatttaactaaaactagaaaactttctttttctattttccaaaaagtgagttaaaatagttttaaaattatttaaaaccaattcaatcccttattttctaaaaaaaaaatgttttcaaaattaaatttgaaaataaaaaattaggcattcacaacacttcatatagagccttacattttttgtgcatgtgtataatgacaaccaacaaagtttgaatttaagacttcatataaattgcccacactcctactactaggtcaacctagtaaatttttcttaacattttaattacgagaggaatttgataacataatctttaatatacttttaaatgtttttattattgaataaattttatataaatcctgttagatatagagtaaaataaaattatcttacgagacttaattacatagaatccaccggattgtaaatactatatttaaaattagtgtattattggtattttttgttattaaaaataattataactcttgtatgtaagattgtaaataagttacattatacatgaaatattcaaactaaactcatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagtttatatatatatatatatatatatatatatatataagaaaaagtttatcaagttgaagtgcttctatttgcatttgaacgcatggcataatttgagtcttgcaaagtcattagtatgcaaaaaaaaattgataaatattcattttcgttcttgaatgtataaaatattgacaatataatacttaaaagatgaaaattcaaattttagtctcaaaagtataaaaagtgtaacaaattcatccatcagttaattattgtttttaccattaatgaaaaagtttaatggcataaagggacaaaaatattataaaaatgattgtcaacatggcttatgaatagattttggacaaaaatattagtaagttatcattagacgaaaatgtcaataattttctattggaccaaaatgtcagtaagttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaaacttgaattaagtcatcaacattccactaactttatttatttattataataatatttacaataactttattatcataaacttatatagaatattttgatcccactgttacttctctagagctgtccatacagttcgtattaaagtatataaagagattataaaagtgatattactctaaatcctaaaagtattgggcttaataagtaagaaaaacattaattaatatttagaaatctttcttcttactcattttctatgtagaaacaattttcctaatgcttaaatatattttttatcccataaatttagaccaattttcctttttgatttctcaaactgaaaaatatttttcttagtatcttaaattaaaaatgactcacttttgatctttaatttgtgaattgtgatcttagactgannnnnnnnnngaaaatgctcagtgacacaaacacaagcatacaagatattagaataacgttacaacaatgcaacatatataaacaatgaaagatccacatgtacgctaaacactggctacattaacaattagcaccttgaaattacaaacaccaaagacagagatatcactaactcccattacaaagaaacctggatagagcctcgagcttttgttaaaattttctttccgttgtaattcctttaagatctacatgtgttcaccaaactcactttttttatttttataagagttcagtcccaataaggactctaacaagcttccctgaaaaggggaagatgatagacgatgatatacacaaagagaatgacgatacaggtaatcagtgagactaataggaaaaaaaaagtattggactataagtgtaaagataaaatttcacattagataaaaataaaaaagttaaacaatatataaataaggacaagatcaataaactcaaatcttaaaattttagattaaagtgtgacatcaaatttatgtatgtggtttgttctagatccaatggtgtagatctttctagtgtttatctccattggttttccaacaaagagaaagagatgaagatggtagttggaaaaggggaggagagatcgagaaagaggtggtggctggtggaggaggtgagggggtggtggtgagaaaaaagaattttggcacgaggacttcttgggccgttgaatctcaatattgaggccgaacaatctcttttcttgggccactgacgacaattacttcctgcattctccaaattgcttccatattacttctggaatgatcgttccaaaagtaatatgggaagtgcagaaaaaaacaccagccactaacctgacttgacgttgaagaggtccatttcccaatcaaaatcatttcttcatattacccgagtttcttgtaataagtgaatttctttcgatttaaaatttatttttaatttattcaagatggaaatgtaatccagtgagaggctcataattaccatcgtgggggagagggagagcgcaagcttatcacatgactgtaaaagcttttccacaattaaaagttaggaccaccaagttacaatgtaacaacatcactattatattgtggcaatgctaagatcagaactttaatcagaactgaactttaattttagtcgattttattacttccaccaagtgtttttaattgggtgtgtgtatgagggattacttaagtatagtattctttcttaaaaaaaaaaaagtgtagttttcttgttaaatgaatgctctctttttttttttcttctttttatctaccaattaacaagtacacgttctcctcctctttgcctatcttaaattatcatttactttttcatgcatgtatttatttggtatgtgacccaatgtgcaagtacctgttaaggtccaaaaataaggtcgaccagcctttgattcggcaagctaggctttctattttgtagaatctctttttcataatctagtttgccattccacctgaatatcctaaagttggccaatgagttacttggcttgtttcatgagttccggttttcatacgtacaaagtagataaccaatcctttatttaactaaaatatcattaattaattaaatggagcatagacaaacttaaatatgaccttttgtacataagaatgcgtagacttttataattttatctatcaaatctatcaatgtcataaactatcaccacccccacccacattttacaagaagtttaaaatcaattaggctcacattttgattcatgataatacaaaggaatcaatttcaaacaattaacacttcaaaaagaaattgatatgctcttaggaggataaatactgataggtattggcctaaggtttgaagctagataaatnnnnnnnnnnctcacattttgattcatgataatacaaaggaatcaatttcaaacaattaacacttcaaaaagatatgctcttaggaggataaatactgataggtattggcctaaggtttgaagctagataaattagttaggaaatgtacctcccctagagttattgaattttgaaatacattaatataagttgtttgtaatgagactgctcattaacgtagacatattttttctaagaagataaaaaaaatggttttcaggctagttgtcaacatgaatgacggaaattgcagagcctgagatggatcctacgatgacgatgtcgccatttgcctatcaaaactaacagaggacaaggtgagataaaacactaaacaaaccatacttgctaaaaaaatttaggaacaattttaggtgttttaattgtgacacacttaaatcgtgttgttaggattcaaagctataacaaagaagaaataagggaatatattaaaggcaaaaatggagagatcctgagaggatatgatggtgataaattgacatttttaaaaccaatggaaatcttgattttgaaggttgaagctactgcagtgtgccatagtgacaatgcgttgtagttgggtcctacaatcctaatgccgagtaaaagggtaatcttgctgagattttctagttttacaaggcaaaagaaatagcattggtgagattcttttgctcataagttgggtcccaggtcttggttttccttccttttctattttgtacagtttttttgcagtctataatcatttcattgcacgggtaattaaactaatacaagcattgtactattcaaattaaattactatattctaagatgtgttatctttttgcagagtaaaacatagtatttaactgttaaagtgcgtcagagagggaacattgtgcataagcctaagttgacctatatggatggataaataacacattgggatagtagtaatgatggctcaaggagttattgaaacgtacgtgtgtgactgtattattgaaatgaataatgtttggaacacaccttcattctaataatagacaccaccaaggaagagaatgaattaagaaaaatgtaaatatgatactgataaaatgtgatgtccacattttaaaaaatatccaaatacaatgaaaaaaactatttaaaatgtatacttaggaagtgatattatgataatgaggatatgtattaaattatatataatttaatgacatcaatagtaaagaaaatcaagatatgaagatatgaggttagttcaatgattagagaaggataaaggaaaaagaaaggagacataaataatatgtttgaatctttcaactaacatttataataaaattaacaattctactaatgagcaaaaattaaacaattttttttatcggtagaagttaattgttaattgttagttttttgttagtaaaaaatttgaatcccttctccctttcccaccaaccaagccaaccttataagttaaccaaagcaaaatggaagagcaaccaaaatagtttacacagtagcaaaacaaaatttgtgtcaacagaaaacacaagtaaaattgaaggattaattagtaatacaggagagcttaaaaatgaggtggaaaggacttaaaagggaaaaaaatagcaagggaaaatcccttaatcatttagggttaaattggacgctaaatatcatagtgaatcgttattgtatttccaatgaatacaacaatgatgtcaataagtcattgaaaaggtgaacaaatatgtgtgaaaatgtactttatattttagagtgaatggtatgtatatttgactnnnnnnnnnnccttaatcatttagggttaaattggacgctaaatatcatagtgaatcgttattgtatttccaacgaatacaacaatgatgtcaacaagtcattgaaaaggtgaacaaatatgtgtgaaaatgtacttcatattttagagtgaatggtatgtatatttgactcgaacatagagaagtataattgcgggacaaatgaattgaattcaatatatattcttgcactttttaggaaggaagctagcatccttaattacacaatcccataaataagttggaatgaatatatgaccaatcatttatcatgaacttgttctatataaaatatatatttattaaatatatcttgtaacttaaaatatacaaataattagataatattaaattcggctctaacaggccaagaaaaaaatataatttaataaataaattttaaatttttgcatacataaaatatacaaataaaacttcaatattatgtatacataatgcttttttatagataaaaataaatataactataccgaatacaaaaataatactatgtttgattttttatataagaaatgatgatatgtttctcccttgttctaattatataaacatagtttcatttttaaatgtatttttaaataaaaaaattacagtaaaaaatgtgttaattatatattttcttttataacactaacttattatgaagtttattaaagatacaatcaagcatttcactaatggatgcatgcattaattgattaccaaattaagttacactcattaatgaaaaaatacattccttaaattaggaatattgatattaaatacacttaaactatttaattctatgataatgttaattaaaattaaataacttaattattttattagttttgataaattaatcatatataagaaaagaaagaaattagatagataaaataattttggataattatatctcaacatcataaataatctattaaaacttataattttttcttaactcatttttttattgcatcatgttacttatcatatttatatttttattcttctcctttttctcttcttaatgacaactaacacagtaaattcatgtattgtttttcaataattttttttataaattttaaggggttcataatattttttataataatataaacacattttaaaaacttgggaggattgggttcaacaagcaatcgatatttcaggattaagtatgtagtattctttgtaataatagttcttattcatcgtattaacaatcaaaaaataattgtttgtctatgtttggatgagaagcaagaaataattaattgttattttttcactaaattaacattttgttcattaatggaggagacaaaattgatctggtccaacatgttggaccgaattgggctctaaaattagtggtaaatagagttaaactaatttggcttggcttggtaaatcaagtgggataagcttgtaaaaaattgacatgaaaattattgggtaaggtagaatgttattaatttattattttcctcttaaaaattaaataaattagacaaaaaatatgacccaatttggcctagttcgacgagtcaactggccacacacacacataatgaagattataagtattctttacaaaatgcaattctacttaagtttgataagactaaaataaataatagaactcttccacaaagtacttaacaccaccatatatgaaatatttaagctcgacaccactaattaaattgaaactatctcatgttaattgattcacaaattacatgtattttaagtaaatgttaaataagtttttgatttctataaaatttttgtttcctgtaatttagtctctatatacatttttgctctattttagtctattgtttatttttagtcatcagtatgaaattaaaattggtaagaaaataaaaaaaattgatccacaataactaatattaatggctaataaatgaagaaaaacaaaataatattattatttttctaaaatgataattttctcacaaagactaaaatttaaaaaaaaagtaaaagtgataaaaaaaatcaagtgaagtggctatggttacaaataaagaagacattttagctgactgggactggacaatattaccatacacatgtgttgggtaaagtttcttaagtttatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgtcaataattttctattggaccaaaatgtcagtaagttacaattgaaccaaaatgtcattaatttttctgagactagaatgttagtacgttttcattggatcaaaatgtaattaagtaatcatttgactaaaatgtaagtaatttttcattggatcaaatgtcagtaattttttgttgaaccaaaatgtcaacaagtttctattgcactaatttgtgaccccaaatttcattttatttaagtgtaaaatataatttaaaggtaaatcatcattcctctttttatcattgcaagcataacaataacattacaataatcacttaaaaaaataggaaagtaaacatatgttaaaagaaacataataataatcatactattgattaataaccataatttgtttgtaaaaatagaaaatatccaaaataaacattcatacactattgtgtgcatattattatagttattaatcaatattatgattattattatgtttcttttaacttatgcttattatcctattattttaattgattattgtaatgttattgttatgcttgcaatgataaaaaaaaaggagagaacatttacccttaaattatattttacccttaaatgaaacgaaagttggtgtttgacaaattagtccaatagaaatggattgacattttggtctaataaaaaattactgacattttaatccaatggaaaattactaacattttggtcaaatggttacttactgacattttggtccaatggaaaattactgacattttggttcaatgaaaaattactacattttagtctaatggtaacttactgacattttggtccaataaaaaattattgacattttcgttcaatagtaacttactgacattttcgtccaaaatctattcagcaaccatattggcaattatttttgtgatatttttatccatttgtgtcacgtaagctctttcattaacagtaaatgacggaagttatcagatgaatggatttgttacactttgtacactttcaaggattaaaatttgaattttcatctttcaaaatgaatttgttaacattctacacattcagggacgaaaatgactatttatccaaaaaaaaaaagacaagatgcaagttgtaacaccccgtgtgcacccggtgtattagcattatgattattatcagattagcgcttaaacactgtaattaaaacttttcgcggaagcataaatcaaaaccatatttcttgattacatctcatcacaagcataagataaacccctgctagtccagatcatacaaccaataaccataggcagatatactcaaattatctcaacatataaacaggagaaaacatcaattacataacataactggttatgtacacaaacaacatctgacactagcggtgtctatacaaaagaataagcatccacatgctttctgatctcaccgatccttcctcacacgagggcatacaaggtctatacaaatacaacataaaacatgtgtacacacacacgtcttccctctacaggggtacaaaacagcatcaaaagctgagccaccaagctctcctcaagctgcctcacagccaagcatatgttgtctctactggggcctcccgccctgagactgctcctctctgccagaaccgtcacctgaaaccacataagccccacacagggtgagataaacatctcagtaagctcagggtccttggaggcatctcctccaccttggctcactctccatgacacaagtcatcaggcatcacaaacaagctggcctcccggccctcatatcaatacaagcaagctatcttgctctatgtacgacggatttcatcaacgccaacctcagtgtgagaccggaactcacacccgtgccatcccatcgggagctacccctgacgcatggacgcacatatatggtacctccgagaatagaaggaatgtcccatctcctatctcttggtcttgagggatcaccgacctctgggatctcatcaaccatgagcaaaccaaactaggaggaaacccatctcctagggaggtccatatctatttaactggctagaagatctaaataacaggcttcatacatatctaaagcacagatacaagcatatatatcatcatgagtatgcaatatccaataatgcatgtatcatgaatatgaccatcactccacccggagtgtggtgtggcacaaaggagtgggaaacatccccaagggaccaagaacttacctggcaaagctgagctctgcagttctttccctgctctgtggcacccgccaccgacacccttggtgtcacgccttatacaaggcatatcggctcatatcgaacgtcaagccagaacaagcatacaagcttaagcatataacacggttctcaaccgtctcaaagaaaggaacctcaatctcttccaactacaaggtcagctaacctaaggttcaccaagtctcaacactcaaagccatatcatagaccctcggcggtctatctcatgcccaaaaggcacttgagtcgtcacaaggctcggtgcaagccaacatcaagagctcaaagctctacataagctcacacatggcttgaacggttctttcacacacaagacaccgttctaacagcctcctaagcatatcaaaaccaccaaccaaggttctagcatgtcaccacatagctaagcaactcagcacacaactagacatgcatatcatagagccaagaaatcaaagttcaccaaactcacaattgagagctaatcctacatcctcacaacattctaaacacatgattccaaaggacccaaggctaatactagctttatcacaagtgggtcactattcacccaaaaccccaactcacaaatcaagcggtgaatctcgagtttcttacctcaaagatgacaaggaaggcccaaggacaactctccctagcttgggtaaccacgaatcgctgtcgttcctcgccgaactcgagttctacgaacctcccttgagaaagggattctcaaaatgagtgggtttgaagggagaatgaggaaggattcaagctctacaagtgtttttcatcatgaatggtgtttaaaggacttgatttggtgaactatggtgaagaaatgaaacttggagcttcaacaatggaggtggggtgctggcggaagaagaaggaaatgttttccttctgaaaatcgcgattccctctttatatagtggtcctgtcaaagttgtcgcgctgatagcgccactatggcgctgatcacgctagatcccaggaaccatggcgccgtctgtgccatccccgcgcccagagcaccatcctccagtacctgtggcgccactcgcgccgccttggcgccccgggcgtcaaccaccagaacctatgtcgcctggcgccaggagcgccgcagttctgcagaatcctgcgctgttcacgcccaaaactcgcgctgtacgcgctgggactcagagttattatacaagttattttatcgtgacgtcattggggccggatcttgttgaaaacaactgagtatagaaatagtttcaagattaggggtgtcataagaaattgatttggacgatttgagttggtttattaagtgagttaattttatttgactcacttatttttttatccaaaaaatatataattcagctcaactgctcatgccatcatagtttggttgataggttatgcgagttgactcacttttagaaaataaaaatataaaagaaaaatagaaaaacttaaatacaaaaatataaaaaaacataaatacaaaaaaaatctataacatactaatttattgtattaataacaaactcaatgaataggaaaataaaataaaattctcaaggaaaattatgataaaaaattaaaataaatagtttcacacagtttggcttgatgataattgttatgcatacacaaattttacatttaaatcatataacaattatcttatttttcctcttttaacgcttcttttgtgagtaaaacgtaagagtttagctttttatgagtttttattcagttgatgctaaaattagttgatttatagtgtgttggttatattttttattttttgtagaaaatgatacaacagagacatgaaagatggattgaagatctggaatagcgcgcaaatgcgggcttagcgcgaggccaatttcaaaaaacatgacagttgacattttgaagaataaaaaggggaaaacatttggaaaaaggagagagacagaaacaagagctagggcacgaagaagtgggaaaacccactcccttaaggactccttcctccattttcttccaagtgtttgtgttctatctttttattgtgttatgcttaattataggaccggtcctgaaaattctttggcccggggcgaagtggaaaaaatgggcccctaccatactttttttttgaaatacaaataatattaaaactaagggatggaaaaaacggacccttaacacacaaattttttgaaatacaaataatattaaaattaagagatggaaaaaatgggccttaacacacaaattttttgaaatacaaataatattaaaactagggatgaaaaaaatgagtctctaacacacaaaaaatggatccctaacttacaaattttttaaaatacaaataatattaaaattaacggatgaaaaaaatgagccgctgacacataaattttttgaaatacaaataatattaaaactaagggatgaaaaaaatgagcctctaatacacaaattttttgaaatacaaataatattaaaattaagagatggaaaaaatgggcccctaacacacaaaatggacccctaacatagattttatttttattttattgtttataataaaaaaatttacttacactaccggcccaaaaacttttgggccctgggcggaagccctgttggccctgccccagggccgggtctgcttaattatctttatttatgttgaattttatgtttctgcattagtattagacaaatatcaactttaattcattgtgtgttaaaattaaaaatatataaacttcgagtacaatcaaagtccttatggattcaacactcgaacttatcattttattattatttggacaaattggtatgtttgccaaagtgttaacactcgacttatcttatgttagtgcatataaattgtgagtttattaggaatgacaatagagtaatatcaattttcaaatttgtgtttaaaagtaatagttgtatttgatttatacatgcgtaattttaatctcgatcctcatattcgtgtttaaaattctgttcaatagtctatgtatgttattgattttttatttcattcaaaaccttgaattttaaacgagaacaaatatttgtattataaatataaaacagttttgtgtgcatttgatacacaataaagtaaagcataatgagaataacatagaataaatatttaagatagaagtcaacttcttttctaatgtattgttttggtaaattatgaataacacaaacaaaataaatatattaaaaattaaatcgatgtttaaattttttattttaacaatataaaattattccttaaaaaataatataaaattattttaaagttttagttcatgatttctttctctttaaattataatccattgataatacatgcttagttttcgtaagaaattatatgatttcgattagacatttttttaaaattgcctatgttgatgtaattgatttgattaattaatttgtatatcttctactagttggatnnnnnnnnnnaatattaaaattaagagatggaaaaaatgggcccctaacacacaaaatggacccctaacatagattttatttttattttattgtttataataaaaaaatttacttacactaccggcccaaaaacttttgggccctgggcggaagccctgttggccctgccccagggccgggtctgcttaattatctttatttatgttgaattttatgtttctgcattagtattagacaaatatcaactttaattcattgtgtgttaaaattaaaaatatataaacttcgagtacaatcaaagtccttatggattcaacactcgaacttatcattttattattatttggacaaattggtatgtttgccaaagtgttaacactcgacttatcttatgttagtgcatataaattgtgagtttattaggaatgacaatagagtaatatcaattttcaaatttgtgtttaaaagtaatagttgtatttgatttatacatgcgtaattttaatctcgatcctcatattcgtgtttaaaattctgttcaatagtctatgtatgttattgattttttatttcattcaaaaccttgaattttaaacgagaacaaatatttgtattataaatataaaacagttttgtgtgcatttgatacacaataaagtaaagcataatgagaataacatagaataaatatttaagatagaagtcaacttcttttctaatgtattgttttggtaaattatgaataacacaaacaaaataaatatattaaaaattaaatcgatgtttaaattttttattttaacaatataaaattattccttaaaaaataatataaaattattttaaagttttagttcatgatttctttctctttaaattataatccattgataatacatgcttagttttcgtaagaaattatatgatttcgattagacatttttttaaaattgcctatgttgatgtaattgatttgattaattaatttgtatatcttctactagttggatgtggtgtgagtgatttgccattctccttacacttggatgcaacacaacatctctagaatatatattcatattttctctccaaaattggcggaagtgttgagtctgccgcccgattgattcgccaatggcaactgaattttcattgtaccacactatctatcctaccattagagttggtctcagcacgcagatgtcacgtgagagatggggtggggacgtgggctgtgatatgaggtcacgcatatataacacaacgttaacggggtctttggcccacacacacacacacacacacacacacacacacacacacacacatatatatatatatatatatatattcatgcaagcaaattacagtgccatgaacgaaataatgactactatgctgttgttttcttcttcttatgtggttggatggatcagagatgaggatgttttttttgttcctgtccaaaattccgaattccgcgtgtgggggctcaagctttcaaccaaatgtttgattnnnnnnnnnnnnnnnnnnnnnnnnnnnnnnnnnnnnnnnnnnnnnnnnnnnnnnnnnnnccatgaacgaaataatgactactatgctgttgttttcttcttcttatgtggttggatggatcaaagatgaggatgttttttttgttcctgtccaatattccgcgtgtgggggctcaagctttcaaccaaacgtttgattagattgggtcagttccaagcaaaaaagacacacacacgacacacccctctctctctctctctcacacacacacacacacacacacactatagagggagctttataaacaagacttgccttcaacctttacctgctcgaggtgaggggtcaatgaaacaacacaacaaagcaagaaagctcgtggcaaagaaaaagctagcaaaaaaaaaaaagccttaaagaaagctgattacataaaagcaatacctttctctctttctctattatttctattatctctatttcttccttcagttgtgccactatcattcctcatcttctttccatacgagtaaagctgaaaaccccactattgcaacctcacaacttgtactagttttgagaatttgatcgtgtgctaacatatagtcctcaaagcataaaaattttccacccatgttagacaacaacaacaacagtgcttctaattctggtgcaccatcttcttctgatgccgcctttgcattatctgaaaatggggtggctaacaacaaaaggaaaagaagacccgcaggcacacccggtaaaagttttttccttttgtataggggttcaagttttttcaacttccaagcttttttttttaaaaaaaaattcgttgggtttggttttctctccaaagttaatttcttttttgttgttcttgcagatccagatgccgaggttgtgtctctctcaccaaccaccttgctggaatctgacagatatgtttgtgagatctgcaaccaagggttccagagggaccagaatcttcaaatgcacaggaggaggcacaaggtgccatggaagctgttaaagagggaaacagcacaagggcagaataagaagagggtgtttgtgtgccctgagccaagctgcttgcaccatgacccttgccatgctcttggggaccttgtgggaatcaagaagcacttcagaaggaagcacagcaatcacaagcagtgggtgtgtgacaagtgctccaaagggtatgctgttcaatctgattacaaggctcacatcaaaacctgtggcaccaggggccattcctgtgactgtggccgtgtcttttccaggtttattaattagtttctttttgttttattttcccacttctcagttctcacacaaacatacacctttgtgtgttgtttgtctattattccaagtttccatctctcccctttcttgatttctgtgtttgtttttttttgggctcctcagattcagccccctgctcagcaattgtttttgctctcaataatagaagccaagttactactataattgttattattttactttttaaattatatatatataattatactatatgattatggtcaaaccctaaaattctaggtacaaggatggtgcagagaaacaaaaattctgaatctcagatacctttcatgtgaaagatttcccatcttctagaggttattaatattttatttattctagtttgcaacttcaaaaacatgtaagttgaaaattttcaaattcctaagcattatgttatgcatatgaatattacatatatacaccccaatccatctcattcaggccttgtacttggtgttcctgagcagcttttcagtttaagggcagtctatctccaattatccacacgtccattgattacttaagataaatccatatataggagggaaagtttattcttttcattctttttttgaacttatgaagaccccattaattagaatattagatcactctgagatattttattttgttgcactattcaatttaaacatgaccatagaatccatgtattataactagatctttgattagtcattttttttgttgcttcatgcttgtttttaaacactacattaacaggttttcatacatgtatatctttgtttgacagttttttttctctctctagccaattatatattcagagacaacaagatgaagccattacacatatatatcataatctaatctattttaattacctaaacttttgtcctttacagggtggagagtttcatagaacaccaagatgcatgcactgtccggcagcatcggccagagttacaagcacttcaaccagcatgctcttctagaacagcttcaagcgcaagtccctctagtgaggcaaactttagcatagccccaccattgcaaggacttccagtaccgccaaaaccagctgaacaaccagcaacgacagtcttattaacgtcagagatacacaataacaagtccaccacctcgcataacttagaacttcagctcttaccctcctcaataaattctcaagaaaaacgaagtccaaaggaaaactatggcttgaaactttcaataggctcatgtagaaatgacaaagggaacaatgaaccaacagacagagcatgttcagaagcacataggagcccaccagaaagaaataataataatgtgagtgactattccacattggaagtggcaaggttgaaggagtttgcaggagaggaacttaagttggccatggcagaaaaggcttgtgcagaagaggctagaagagaggccaaacgccaaactgatatagctgaacttgagtttgagaatgccaaaaggataaggaaacaagcacaagctgaccttgcaaaggctgaagagctgagaaagcaagccatcaagaagataagttccactgttaaggaaataacatgccacacttgcaagcaacagtttcagtcttcaattgttggagttccatcatcagaagaaacctccattgtgatgagttacatgtcctcagccaccacagaaggagaagcagaatgagtgacatatactgtgaccagaacacactgtgctaggaaaagaaagaaaagacaagctttattctgcctaagggaaagatatgatatgatgatatcacaggaggagtttacatgaagttatattgttcttaattttttcttattcatttttctctttaatgttttcttctctcttgactaggtgaaatttgttttattttaaagaaagttcatattctttatattttttttatcgagatgcagtgtttaggagtttgagagtctgactattgaagctttctttaaaggtgagttgtaacttgtttttcatgatcattatttgacatattcatcatccgttcatttgttgtatgacaattaaaattgaagaccatgcaaagatagctttacccttatgtctaacctaatatatacatgaaaggcaacttttgcaattttattgtaattagagggtaccctatatttctcttcaataataactaattaattcaaaatactggctggatttcacttatttgtggcttaaattgtactaactagaaaacaatagttgttttaacagcaattaatgtagattctaattccggattagagtaaggaaaattgaaacaagagagagaaaggacatatctcttccagggtttgattaatgattatatttggaagtacccggtaaatgtggatttttgggattacacattagaggcaatgcatgcatgtggtgaggaaaaaaagaagaattgtttattaattattacttattttcagaaaaaatggtggcgttaaatgttattaatgttataggagtgaagtatgatgttattgatatatgtcaggttgccttgtacacatggaccctttaggtaatattaaatgaatgatacatgtgacattcatccgggtgaatgatagcaatgggttgggaccattttttttaaaattgatttattttctgtataggaaccaaaatcaaagggggggctaaataaatctttcttttgatgagggaaaacaaaaaggagaaaagggtgaaaagacggaagggtcgttttcattgcataaacgatccttttaaatgcacaggttatgtataataaaaataaaaaacgccatgtttttcagtgccacagttgaaatggtaatggacaggcattcgtcactctcaacataaacaaacgcacacaaggctctaacgatgcacatgcttttaacaggagacgggggagggttgcagtgtcagcgcatagggctggtacagttgctttatcattaattaaggtgcaaaatagcatggaatccatgtcactgtttcaaatttttaaacatctttatcttttttgttttaccattatagatgtagtaaaatacttactgactttttaattggttaatttttgtccaaaaaaatatgaattttttctttcaattttttttaatattccttttatatagacaacaagtatcatgcattaatagattgtaagcattaattttcttttatgattctttttaagtatttaatgtaattatatgtttaagatttatattgaaaactttccattaagttgtagtaaccttacattaattcatatatgcatttggtgtaattcttttatatacatacaataacaatatattatttatctataaaaataaaaaataatatcataggatttgtaataatttgcatcttgtttagctaattgaataaattctttggtatataattaaaccgtttaaaaatgaacatttccttttttttattataagattgacttgaccgtagtaaaaaaaggagaaagagaaaaattataattcgattcctaactagtatttgctccaaaaataaattattgtataatttctcaattcaaaattggacgtttctctttctgaattccgaagggaactttgtgtctttgaaatttcaaagaaagaaaaattaggttgagcttttccttagagtcaattatattattgacctttatttttttgactttattattaagttttgaatttttaattccaaactcatactactttttgtaccatgatagacacgaaggttgcttaactttatgaccaatgcatatttaactataaaatggtattgtattatagttgtaaaaaatatctataaatgttttttagataatagagggaaaaaataactataaatgaacatggatttaaatcagaaataaaccagtatggtagtttcaatataaagtaaaatttacctaatttgtaacnctttgctccgttttagtttttatgttgttaatttatttattctaatatgttgttataatatcacttgttgaatatatgaaactataaagtgtacaaattaaattaaaaatgattgattcttttaagttttaattattttttacacataaatgtttcgtaataattagtctagtcttattatcacttaatagtgcaaaaaattgtagtctaacagtgtatcaaaatcaaattatctctatatataaactttttattcatatttattattatattactgtattttgaaataataataaaataacagtataattataaaataatataagctactccgttataatattaactgttattgttaactatataacccttagctaagtttttaggaaaatgttaattaatattatatttaataaactctaagtaattaacatcatatgaacagaaaaacacatataccaatgtattgtatagttacaagacttggtatatataataataaatagtcagaagaatttaaaagtaattgaattaaaagatgtcaaaatagaatcaatttatttaaaaaccatttgcttacaacattttctttatagagctttaagaatcaatgatttaaggttatctatggtacattcatgtgggtatatcttaattaaagctttaaaatgtatcagaaaaaggagaaggaaaaagtgggtgtggagtttggtaattgttctttgacaattcaaagcaaagcaaaagcgaagaggctagggtgctccaatccaacagggttaccttgttaatgatatctagtgtctgctgggaccacgtgcacctcttacccaaccttttaatgcatccctaccctttttggctctcaaatggtccaagagtctggctctatatatattctctagatagctacggtacaagaattctttatctttccaccagtttttaagagcaatgcgtatttgaagggctatcattctaatatatggcaccttcaataactcagggaactgtcaaaaaagcaacataagtttttcgtaccctgatttatattttttgtttttggctctacttaaggtgatcaagtaccatattaagtgtcttcggaatttcgttctagcatctcgaggtgcttcatttcaacccatcaagagagaaagccttttccgtttggatacattagaacgtaattgatgtttatttcaatacgaaaatatacttatttcttaattttgagctttagaaaaagtgcttcttcttttgacaagctttaaactacgatccaaatacaaggtaagtaaattcaattttaaaaatgttagtcgtgtaatctcctcctatcggatgggtctattttttgaaataaaatatccctctaattgtcatttcttgcccaagccctacgatcgaactcaagacatcgttaaaaaattcaaatattaaatcacttacgtcaacaattttgatgttgattattagtaaaaaattcaaatccataatctgtctttcttttctttctcccttcacccttcacaaagtaacaccattgctgcaacatgaccaacatcgagcctatggaaattgcaaagagcatcttctttgctcgtaaatcttctcaggctaaacatttttttccttttgcttctcactctcttctattttgtaacagacatttttgaattatattctccagatttgtgaatttgacttgctagtaaacctattatattttagcaataaatgttatagtttttttttctttatgtttttctttaaattaaagaattaataacgataacctttttttttttttgcttcacgacaatctggagatatactaaaactcaaacttcattaatttatgagtagagagagtgagagaacgagacagaaaagggaatcaacataacaaaccacgtgcttcatatgcaaataacattagagtgtattcgaaaaaagaaataaatgagtaatgagaaattgaaataaattatttcatagtgttttcgatttctatgaataaaaaaaataaatgaaaatttaacttagttaaaaaaaataattaaaagttcaaaattgttaactgaaaattgagtgtgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattataggtattaaatatttttttttgaaatagttgataaatataaaatgttagaaatagacatgattgtataattatttttttttataaattttaattacaatttatggataaaatatatatgtttgtataagtatagtttatccttttgatcaattttaaactcttatatttatatttatttaaagatctattattttaattattcttttagttttatttattatatatttttatattgtacgttttactaatattaatcttatacttatacttatactatatgtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtagacatcatatatattttttatgtttattaattagtataacaataagtatatttaaatatcattaagtattagtgttgtcatgtcatactaaatgattatcaatatcttgaagagcaaaactaaaataataaattagatatcgtaatggttaaaataaaaggtgtaatacagaaaaaaaatctgaaaataatagcgaaaataaaataaataaacctataatatattatttaagaataagttcaggataaaaaaatgaatacagaagctaaaatgctatttaaactaacaaattttaaaaaactttacaagctattataaaaacttatttgtcaaacatttttaatatttatagtcaaacaaataaactaaaataataattaaagtagcattcaaaaataagttagaagctgcaaacataaacttttaacatacttgttttaatcaaataaactcatcataaactagttaaactaatttataaatgactgaaatgacattattaaacatagcctaaaatttgaatttatgtgttcatatattaaattacacattgaactttaattactatttttttttggaaggttataccgaattcaaattcaattctttatgaaattatcttacgacaattatcatacagtttaagaatgtcgatacatcaagtttactgacgttactactacctcttaatagctttaatatgtatactttaattaactaaaaaacaaaatatatatacccatacacttgtgtggattactggacgattacaactttgcatgaataaatgaaagggaaaaaaaaaatgtctaggtgcttcgtgttatcatcatacaaacataaatggcccgcttgaaagagagtgattacagcaatgtctagtcatctactagctagctagctgcaacgatcacgaatccatacagtagtaatatgtcggatagctatatgttgatttctaatatgaggaacatatgtttatatatgtaagaaagcaacttcacaatttaagcaaacaaattaaagaaaacaagaaatccagtaattgttatgatcttgtaactaatccagatttagaagaataattatatatattaaatacattattaggtctaagtatcctctatgttatgatcctgtaatggatccggggtcgtgctcctaaaatagtgctatcgaggaaattagacttctgtgtccgaggtgacactttaggaaaaatgtgcttaagaggtaggaacccagaagggagaaacctcgcgtttattaagtaaccgatgtaggacccgaaagggggagacctcgcgtttattaagggaccgaggtaggaacccggaaaaggggacacctcacatttattaagtgactgaggtcagaacccggaagggggagaccttgcgtttattaagggaccgaggtaggaacccggaagggtgagacatcgcgtttattaagtggtcgaggtaggaacccggaagggtgagacctcgcatttattaaggctttagtaaggcgtcgaggcatgaactcggacgagggttgattttgagttagtaaggtaccgaggcatgaacccggacgagggttgatcttgagttagtaaggtgccgaggtacgaatccggacgaggggtgatcttgagttagtaaggtgccgaggtacgaatccggatgaggggtgaaccttagtttaataaggtgctgggatatgaacccggatgagggcagaccttaaactgaacttgcacaaggttgccccagctatgcatgccgagcttgacaagggagacttagtggcataatttgcacccgacagtgccagagtggcatcagaagcgtgtaacacacgcgccagagtcatttatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttccctacatctctgcatattttaaataaattaaaagaaaaggaaaaaaagatttaaaagttaaaaaataagactaataaaaaataactaacatcataaaagtagtgagtaactattaaaagagagtaataaaagtttaaaaattaaagaatgatataattatctaaattttgtgaacaccaacaaagaatatttaatttattaatagtatagattcacaaaacatgtttaaaacacgttacttattgtatggctggtagaaatgctgagtgtaataattgacattacattttctgtttttttttttttttannnnnnnnnngaaaataaaataaataaacctataatatattatttaagaataagttcaggataaaaaaatgaatacagaagctaaaatgctatttaaactaacaaattttaaaaaactttacaagctattataaaaacttatttgtcaaacatttttaatatttatagtcaaacaaataaactaaaataataattaaagtagcattcaaaaataagttagaagctgcaaacataaacttttaacatacttgttttaatcaaataaactcatcataaactagttaaactaatttataaatgactgaaatgactattaaacatagcctaaaatttgaatttttgtgttcatatattaaattacacattgaactttaattactatttttttttggaaggttataccgaattcaaactcaattctttatgaaattatcttacgacaattatcatacagtttaagaatgtcgatacatcaagtttactgacgttactactacctcttaatagctttactatgtatactttaattaactaaaaaacaaaatatatatacccatacacttgtgtggattactggacgattacaactttgcataaataaatgaaagggaaaaaaaatgtctaggtgcttcgtgttatcatcatacaaacataaatggcccgcttgaaagagagtgattacagcaatgtctagtcatctactagctagctagctgcaacgatcacgaatccatacactagtaatatgtcggataactatatgttgatttctaatatgaggaacatatgtttatatatgtaagaaaacaacttaacaatttaagcaaacaaattaaagaaaacaagaaatccagtaattgttatcatcttgtaactaatccagatttagaagaataattacatatattaaatacgttattaagtctaagtattctctatgttatgatcctgaaatggatccggggttgtgctcctaaaatagtgctaacgagaaaatcgaactactgtgtctcgggtgatactttaggaaaaaatgtgcttaaaaagtaggaacccagaaggggagatctcgtgtttattaaaggagcgaggtagaaacccagaaaggggaaacctcgcgtttattaagtgaccgatgtagaaatccggaagggagagacctcgtgtttattaaggaaccgaggtagaaactcataaggggaagacctcgcatttattaaggctttagtaaggcgccgaggcatgaacttggacaagggttgatcttgagttagtaaggtgcctaagcatgaacccggacgaggattgatcttgagttagtaaggtgtcgaggtacaaacccggatgaggggtgaaccttagtttaataaggtgttgggatatgaacccggatgagggcagaccttgaactgaacttgcacaaggttgcacggaccatgcataccaagctcgaccagggagacttagtggtataatttgcacccgatagtgctagagtggcatcagaagtttgtaacacatgcgccagagtcatttatatatatgatcattcctcaacgtttctttacagaaacaccatcgtcttcttcctttctttgtttccgccatttgttagagagagaaacttcataacctcttatcctcgaccaaaaccctttgcatgcaactggaaagttgaaaggaaccacccaatagttcggttccaacctctattctttctatagaccaccagatgaagagattgctttcttcaagagcccaccaaattctgtttcgaagggaaagaaggttttagggcgttcaagctttgagaagccgccccctagctttcctaaacgtttatagagagtgtgtgacggaggacattggtggttgtgacctagagggcgagagagagctagtgtaacattcggagcaggtaagctctctgttcttgggagtctttcccttgactgtgttccgccatactccgagagagtgttggttattgtatgtcatgatgcatgtggtattaaaatatgtgttctgcttttactaataacatgtatatgatgcatactatgattatatgttgtttgaatgatgagattctctgaccagtataatagactatgtatgaactttccttggagccagacgtagagcaaccccttgttgttaatggatacagaaacctgagagactgtgcccttaagtggatgatctttctcggcaatatatatacgtatgctataatggtgctgcattcctgatgttggtagcgcccaacggaatgacacctgtgttgcaacatatatgtgatgtattgtatgatatgcctatttgatgctatgtatcatggaaagtgaaccagggggaggagaggcctccaagaaccctgaatttactgagattgtatgtgatatgcgtctagaatataatgttttttcaagttaaaataatcatagaatcaatcataatttggcaataaaggtcttttaattatgaaaattctgatcattatatcatcaatcataatattactaatttatgaaaaatttatagcaggaaatcaagagaagaggtaaaagaaagaaagatcaagaagtcaatcttctctggattctcaagaggatagcacgagatatcgtctcagttgcaccagaaaataaagttaagacaatcttctatgtgatcttgcacaatcagcgctagaatccacgcgaattgcgtcagcgacatgggatttcaggatcttaaattatattgcacgaaattagaagatatgaggggtttttagagtctgactataaatatggactgagagagtagtagaaagggacagaggcctgtgcctctggacatctacatcgagaaatacagtagaacgcataggaggaagcttaaggaatgattgaaactaggtcaagaagattaaatcaagattgaaggagttttcttcttcttcttcttcttccttgagattcttgacccagttttatcttattttatgttattaaggttagacatgaatatttatggctaacttcctttattgtggttagagctaaaaccaatgtgaactcctctttaattggattgatattaatataaattgtgctaattgttttattttattttgttcttgaatgaattattccttattagacttgatcattctagtaaggttctaaggattagggtctacaataggaatgttggagctctaatttctgaaagcagtaaaataacaatttttacattacctaggaatagagatgtatgattacagagcaatagatctattagcttactacttaacttaagagaattgttaaggaattaagatttgtaattgggttaaagagttaaattattaaggaattaagatttaactaatttgtgtaaaaatacatcctctcagcaattagaataattaaaattagtaaccaattcaaataaaaaaggtaggaataaaaggtgaatatgctcttacattttattatttgtaacgatcgatatatttatcgaatgtataatatatttttaacttaaaattgaaaaaattggcgtattcaatcccaacaatgacgtcaaaaatatgatttatgaatgagatcaaattatacttctttcaatctgtgttcagaataagcatttttctcatatatatccattttcatgaatcgaatggtagaacagtagatgtacgagcactttcagcgaaaaatatgatttatgtctatttggatgcattatagcatgagttgttgcaatataagtggggtcaatctcaatacaaatctgactcttgcagtcatcattcaagtggacttttactatatgaaaattccatgttgtattttttaattagacatacttgataatatatatatatatatatatatatatatatatatatatnnnnnnnnatttttaaggtggaaaaaatctttgaactccgaaaatatttataaaatttatatttacctcatctttagaaaaaccaatgagagcttaaacttatgatctaccagtcagataatattaatcttataaacaaaattttatagctttagtacgtactaacatataggaattttgccaatattattcggatgctgtcggtcatcaatatacattcatgtactaaatatcataaaaaaaaatcatctggtgtcttattaaaccttttttttatggaaatattactaacattaataattaaataaaatataaaaataattataaacatttatcactttttatttataattactttcaatttctcctaactaattaagttttcattttgtaattatatttaaaatttataattataaagaaactttttgttatcattttctttatttaaagataaaaaattctgattcacaaacacgtgatagccatcaaaacactagcaacaatcgtagtatttgttctccatgtcccaacctctctctatataaagaaatctatatataattgtgtcgaaattcttcagaactttttctctagctactcaatgattgtatacacatgctattatagttaagaattaatatgtattcagctttcaattgcttttaattcaagtttatcccttggatcataacaattttttacttggtgcatataaaatttgtttttagagagtatcatttccttatgatagaggcccaactatgcataataaatagtcggagagtaagagcaggagggaaacttgtaaattaaacactccaagttataacaattaaaaaaaaacaattattattttcattttaaattacttcataactatgaataaattgttcatctgagtgaaactgagtttaattttcttaagtaagatttcagattcagacattatgaaagaaaaaaatgtgattagataaaaatactctactaaagacgttcaatcaaattttcaatgaagattaaagattaatgcttagcttcaatccaattttcaaagggctcactataaattattatttataaaaaaaaactaggctaatattcatcaaaaggatgttcgatttagtgtaatgaaatgaattgagaatttttttatgttgtaaccatgctagcaatcctttttctcagtgacaatcgaagtagttgtccaagtaatattttagtccttttgaaagattgtaactcacgttggtacaattgcatatagagttgggtatacgagttgtgtgatttatggaggataattttaacttgtgattctcccgaagatatgtggcccattaattgtaagtttttttcaactcaatatgtataacctatgaatttagcatgctaaaattggtctgtggggttcttttttctttttaatatgaatcacgtttgttatgctttttgctaactattatgtgtatatttgacatttgttcttaagagttaagatatttagttcacaagactttttgtaccaagtatgtatttgttatttggtatttggttggaacttttgttgttacccattttgcacttcatcagtatatttgttatattattaaagttagtcaattattaacaagtaaaagtaataactcaaaagaaaaatataaaaaaaagtgcataagtgaaccagattcacccgtatacttagctctgaaaatttcctgaatttgcttgaattattagtatttttcattgtttctctgttaaagaagggcataagtagtgatccattagtggccatatagttccagtgtctacgcttttctatgaatcccagctagtcctttaagtcactatacccaagggttttgtcctataaattttgatgcatttgcactctcaatttcgttggatgccatttggtatatatagatttttttgacttctacgtttaggacaagattcttttataaatggggtaatgacacgggcctaagaagttaaaaggagaggagaagaaaaaaggcgtatgatcatttcaatttagccattgacacatgttttttttttttttngctagtcctttaagtccctatacccaagggttttgtcctataaattttgatgcatttgcactctcaatttcgttgaatgccatttggtatatatagatttttttgacttctacgtttaggacaagattcttttgtaaatggggtaatgacacgggcctaagaagttaaaaggagaggagaagaaaacaggcgtatgatcatttcaatttagccattgacacatttttttttttttttgaggaaattacatttgacacattgttgctgtgaatattttgcaaatatatgtttagctatcgaagtggcataattgagttcttttgtgattttgagcatttgtttgattattgataatgaggaatgaagtgcatcaaagattttcctaacatctttcctctttcttcctttctcttctgacttctcttatcttccttcctgtttcttcgtcattttctactaatgatacattttattgttaacttaaaactaactctaataaaagtatgaaggaaaaaattacaaaaaactaaacgaagaacaaataataaaagtatattataccatactaggggaaagaggtcttccctacatctctgcatattttaaataaattaaaagaaaaggaaaaaaagatttaaaggttaaannnnnnnnnntgtttttttttttttttacatcttcctgttgtctatcagaacaactaatttgttatgaagattttaatgggttgataatggcattcttcttaccggaacatgcacggttgtatttgcactttttttttggtggctggttgtatttgcacttcttaatcatgtaatgaagttgcatattttgaacttaatttcaagaacattgataaattataataattttgtgctaattgatttacacgcacggtagatataacaagttattttgaggacaaaataagttaattcaaccttgtaaaggggttttttttaggatgatgcctgtgtgtgtcatcaatgtgtgcatttgtttatttgccgactggattgtgggaataatactggaccatatgtcttggcccatttccattttcagcaataggtatccactatccaggatcttcccggaaactaaatgtgttcaattaaatttgttagcttcagatcttgaataaacatgaacaaacatccccagaaatatatattaaaaaaataacccaaaaataagatcttgtaaaatctgagtatatcgttttggtaaaaaggaaaaaaaaatgttaaataagatattcaaactacaaaaaagtaaaaccaatggtcagtttatttaaatttatttttaaaaaatacttttttaataaaatgagtaatttttcagttttctaatatacttgccaaaactgtttttacttacaataagtaatttttttaagaaataaatcttgggtggatttgtttaaacttcaaaaaataactttaaaataaacactttttatataaattttttaataaataaaatattacttattttaagtaaaaatagtttagataatcacatcaaaaaatcatagaactgcttattttatttaaaaaaccaaaaatgaacttaaacaaactaacccaatctgtttttaaaataacgctttcaattttgttacctttttttttaaaaaaaaaaacatttttcaaatatttgataaaaatatcaataatcaagaagattaactaagagggttttgttaaccatttttctttaatcagatggtcactcttcagagtacatgcacaattggtccactttgcagttgcatttaacctccactactatgactgaggcacaacacagaaagatggtgatgaaagtttggatattaagatttattgttcatctcacccagtcaatgatttgttaataacaatttcacgaagtcataattcttttgcatataatctttgtgtttgatgaattgcctcaattgattggattagatcacagattaattactttaactcgtttcttggttctgatttcatatgcaattactgcagtgttaatattggttggagttacatagtatcgctgacaataatactaaataaaaacacaataaatgaagaaagaaattgagaaactaagcacaataaactcagtaataacagctgtagagactagagaaaatcttacaagcctcatttcatattttcattcattctcctgtcataactatggacaataacacggttcaagcactgttgctgcttccatcagttgatccaggcataagctctctcagcatggccactacctgcaacatgtttggccttcttgaaggcaagtcatcaacacactgcaaagtaatctctaaatatcttatcatctccttcacttctttggcttctgcttcatcagttccttgagtggccaaaagcaagtcattgtcaattacttccatttgcttcccttcgcagacctttatcttcgcccaccccaccaagttggtgtcaccaaagtcctctttatcagtcgggcgtttcccgctaagcagttccaacatcacaactccaaatgaatagacatctcccttggcagtgcacctgaaactttggtagtactctgggggaacatatccaggtgttcctgctagtgtgctcacactaagatgtgtgtcaagggcacttattagtcttgccatgccaaaatctgagaccctggactccatttcattgtcaagtagcacattgcttgatttcatgtctctgtgtatgatgtgagggatgcaattgtggtgcaggaaacaaagtcctttagcagcacctcttgcaatcttcttcctttcttcccatgtcaaaatgcgtcgatcacgcgtcttgattctcccatgaagcatctcttctaggcttccatactccatgtactcatacacaaggagcctctcttcccccactttgcagtaccccaacaaagggacaagatttttgtgcttgatcttccctaaggtttccatctctgccatgaattctcgatcgccctggcagctcagtcgaatgagcttctttatggcgacactggagccgtctttgagtgtggccttgaacacttcaccaaaaccaccacacccaatgaggctcgctgctgagaatccattagttgcttcaatcaattgtgagaacttgagcttcctcagctgcctctgaaatgttgcgacattaatgcttaggggctctttctctttgtcaattttccatgttgtagcagcatggcatgcttgtaagctattgagcatcttgacttcctcggcctccttcctccttgcgcgcattgcaattgcccacacaattaagatacacacagaagcaacagagatgagaattcccatgacaatgctatttgcccatgttgcagttgctgatttacggtctcctttgctaacatcatcacttggatatgttgtgggttggctgttgtcattcttgcaatcaggcaatggtacaccacaaagtcctggattgttcgcatactgggaagctggaagtgtactcagttgtcccctagatggaatctgccctgttaactcattgttagatagatcaatttgtactaagaatgagaggtttgaaaatgagtctgggatatgaccctgcagtctattgtgtgatgcatcaaacacacccaaatttttgagctggccaagtgatgaagggatttctccggatagctgattgtgagataattcaagaacctgtaaagccaccatatctccaaattcatctgggatttttccgcgaagctcattataggaaagatcaagatactccagtgtctggtacttggtgaacaggcttaggacaggaccagaatagagtcttgtgaagtcacaagtcctcaatgttgggacctgcaagagtctttcaggtcggataccagagaattctagcaaacctccaacccctttacatgagtttccaacatttcttacaaacaccaaagtgtttcctgaaaggatcccaaacaaggattttgctcctagctgcctgccaagtcttggagggatctctccagtgagcttgttgctgttcaagtccaaccacaccaaactgctgcaatttgctagctctgatgatatatccccagtcaagctgttgtttccaagctgcaggactgctaaccttgtcaagaggccaaacttgcggggtatttcaccactgagttcattgcttgtcagtgatatccattcaagattgctgcaattgaacaactctattggaattccacctgtgaggtgattattgttcagtatgagatccttgagattcttgcactggcccaactttggtggaatgcttccttccaagccattgaaccatgctattagctgctcaagattttcgagttctccaagctcatcagggattgtaccattgagatagttcagactaaaatcaagtgtcttcagctgtgagcactttgacagttcagcnnnnnnnnnngatcatatcttaaaccggattatctttaaaggaatggaaaaaaaaaaaaaaacaattcacagtcaaaagcatcgaaaacaaagacaaattataaagcccttgtttggatcagtacaaattttggtaaccgacaattgaggattctaaggaggagaaagggatatttacgaacttaacatctaacgttctcgtttcaatatgtttccgcttgttgaattttacctgaatttcactagtttgaaaataaagatctattaatcagattttttttttttttgaaagtcagatactatttatttnnnnnnnnnnttctagcaaacctccaacccctttacatgagtttccaacatttcttacaaacaccaaagtgtttcctgaaaggatcccaaacaaggattttgctcctagctgcctgccaagtcttggagggatctctccagtgagcttgttgctgttcaagtccaaccacaccaaactgctgcaatttgctagctctgatgatatatccccagtcaagctgttgtttccaagctgcaggactgctaaccttgtcaagaggccaaacttgcggggtatttcaccactgagttcattgcttgtcagtgatatccattcaagattgctgcaattgaacaactctattggaattccacctgtgaggtgattattgttcagtatgagatccttgagattcttgcactggcccaactttggtggaatgcttccttccaagccattgaaccatgctattagctgctcaagattttcgagttctccaagctcatcagggattgtaccattgagatagttcagactaaaatcaagtgtcttcagctgtgagcactttgacagttcagctgggatttctcctgtaatgagattgtctggcattctcagctgctcaagtgaggctgctcctggacataaatctctggggatagatccataaattttatttgagctgaaatccacaatcttcaactttttgcaggaagatagtgaagatggaaattgacctgtgatagcattatttcccagcctcagttcctgtaatgatccaaggttctgaaagattgcatctgctaactgccctgacatattgttgttagatatgtcaagaagttgcagccaactgcaagaagagaaactagatgggattgagcctgagatgttgttgaaagaaagtttgagctccaaaagggtagcgcatgcatttccaaattcagaagggatccagccagtgagttggttgtgcgaaagatccaaagtctgaagtttgtttagctgaccaaaagctttggggatatccccagaaaccatattgttggctaaattcaaatatttaaggctggtgcagtttgacaaagagagtggaattgagtctgataaacggtttccagatagatcaagttgcaacaaggaaatgcactccattttcaggccaaaaattggccctgacaggttgttggaagagaggtcaaggacctgcagtttatcagaattttgaaagaaattttcaggaatagggcctgtcaagttgttgtaagaaagattcacaacaagaagatttggacacttggagaacaggttctcagggacaggacctgtgactccaccaaaggatagatcaagctgtgtcaaactatatgggagattaagtaaagaggtagaatttacagaaaatgaattcaaagacaatttcagaacagataacatatctaaagaagacaaagggtcaagagatatagtcccagcaaggtcattattcccactaatatcaagctgagtaactcttccaagggtgcaagagactccataccagctgcatggattcctattcagcttccaccctgacaaaactccacttggatccttctgaaccatccttttgaacatgagaagagcctgtgcatcagtcttgatggaggaaactgctgcaccctcagtcacaggaaacaaaacagtgatcacaagaagtgtcacggtgagaagaggcaaaaactgaacatggttgttctccattgagaaaacaagccttgtgcaaagccagaacagaacacaggtctgggaagagagagaccagcaaagatgttgcagagagatatagattaatgtgtgtagagaggagagaggaaagacatactgagagtggtgagtatgatgagaatttgttgtggctaaacctttgggaaaaggtgctgctttttgtgttttataaaatttaaaggagggaacgtgagagggaataaggttgtgctgtgtgtggtgggtatgtactcgtaagtttgtagtataattgctctagtgcaaaaattttactttttttggatgatctttgtcaaagaaaatctacctaatcatcttagtaaaatcatttcttttaattcatattttttttatccatataacttaaatttgagacattatctaaaaggttcaaatttaatttcttttttatttataatgtagtatataaagtttttagttttattgatgatattttttgtcaaaataaatctatttaattattttaataaaatctcattttttattcaattttcttgtattcacaaaatataagtttgaaacattatttaaaagatataaactcaatttttatttatttattatgctgcagcgcaaaatttctaatttattgatggctaagttttattaaaaatctatataaccatcttaataaaatctcatctgttaatcatatttttttttctatcaaacaaatttcaatttaaaacactatttaaaacatgcaaactcagtttttcactcctaaaaacatatgatagtattaatatcttggtaaaataatctgtgtagagtagagaactgagagaatttagttaaagaattgatttgacttttggtcaacgatttgggacccacagacaaaggtctgcatctaaagatcggcgctataaaaaaaagaaaacctgagagcttggcctgtgcctgatccaagagtcactgtctgtcagagtgcgtgagaatgtttcccccatttacatagtactagtgtcgtgaaacataatattggcaccatgtgcaacatatctggttgttttctgatttcagccattgtttgtttctcccagtgcttactgatttggtaaataaagtattatattttaaagtttatttagacttctgtctcttttaattatattatgtgtaattttggctttcaagtttttttaacaaattaaatattttattttaaaattaagtttatttatttattttttgttaattttatgtaaaattattaaattataatttttactagaagttatagaaaattaaattaattaaattattttaaaccatttttcatttaaaacccatcaaccaaaacattaaattcaacagaaaagcctcaaattctacattctttaaactctaatcttgcataccaaaattttcaaatttcaattaaatttctaacttacaccttattttatattaattccaaattcatttataaacccccacatatttacacagaaaataagattttgagagttttaaatagaaaaaaaaatatggaatgaacaatttgcttgattttaaaaataaataaatttaattggtcaaagaaaaatttcgagaccaacattatacataatttaaattaaaaggatagaaaatacacttaaactatctttaatctttgataaacatagcaagattgataaataagcaaacaaaaaataaacataaactaacaggttctcactagtataatttttattgttattgatgttgatactgtctgtgttaatctctaccagtttccagttgcatttaaattttaaattatactctgtggactgtatttgtaattgaagtctatggatgagcttatcatcaacgtgattgtttaatttagaatatagtcttgaaaagaatgaaaaatgtattagtgagggccccacgtgttgaaatgtgaaggggaaaaaatgatgatagtgtgttatggttgaatgtttcctgtgaaaaaataaattctaggtagagtaaacaaatggagggccccccaccaatgaagcaacatcaattagctccgtgttaatggcatgggaggtgatgatgctcccttttgcgcctttctcattcattcttgctttgcaagcagttgcatatatatatatatatatatatatatatatatatatatatcactacattatttacaaatttgaacagtgactcggttcaattcaccctaatctttataaagttttaactttttatatagctgggttttgggaccatctcttactttgctacacactctaattagcacattctgcttagtgaatccctgttgatggttcttcacaccaaatcaagattgtgtctgcaagtggtgatttttttttccataggagagaaaattgaattcccattttatttaatgtttcttttatgagtcacttggagaagaatgcaaactagtatgtgagagaaaagacatttaattatgaaataattttacgatattattaaaagatttgacatgagttcgaatcccaaaatagattctttgcatacttaagaataagactgcctagaatactttttttccaagtattagaagatacttaatttttttttttaagatttgaaccaagttgatatttattgcttagatgaaatggattcctaaaaaataatacatttgcgatgtacaagaaggaaataaattccccctctatatataatataatctgtagtttgtagtagaataatgtttagcgatttaactaagtcctgaattgagtttatgaaaataagtcaggtagccgtaggaaacatgagtcaattggaagatcgaataatgaaaaaaatcgtgcacgcgcatttccgcaaattttgtatcctattcaactaaatatctttgccatatgaagtaaattcacagtcaaaatcaaagagaattgggtctaacagaaaatgttactctcacaaagtggcaaataaggttcgaatttttgttgaaaaagatatatatctatattaaacatctgatcatatcttaaaccggattatctttaaaggaatggaaaaaaaaaaaaaaacaattcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagtatgtaaattgatttttttaaagataatacatattatttatcgaaaacaatcttattcaaatcgaatagaattattatgagtaacagaattatctctaaatatttaacataactatatatttaaaacataaacttgagatcactaattaacttgaaataactttgcatcaattgatatttgtgcttaattataagtataattggtttagtttcagctaaaagaatataaggattacttagatataagcttatacattttggtccacttaagtgtgtgtaaagtttattttctaacctgtaaaccaattagtaattcacgtacttatccttgttcttcttttaaggaaaatgtttttatctttttcttttagtcattatgttattattacaaaatatttattgagtttgttaataattaatctctataaaaaatctgacggactatctttaataagatttagttcccaaccatatttttttatcaacatgcttgaatatgagatcttatttaaaaagattaagtttaattccattagcttgaatcaaccacttggttatttttgttcttttttttttttaattatgatagtcaatatctaactttttgtcaaaaaaagaagagagaaagaaaataaaataaaaaaacctttgtcaaaaagagggacctaagtttccgctttcctcaaattagctgaaatgggaaggccaaacacttgcaataaattgagaaaattagcaattccatcaaaagataatcgatacatcaaaggtccgataccaacttgaagcatctaattatagtcttcaaggacaacttgaagcatgtcacattcacagattgcacatgagatacttctatgttttcaattaatttaatatctcttgaatttaagaataatgcttccttaataagaccactgattttgaagctattagttaagagaaaagagggctaataggatctctgtctaattctccgagactttaaattggaggtagctaggattaccaaaactaaaattgataaaataataataataaaaaaaaactaaaatcaaccttccatgagttccattcaacttctctacttttttattgaaccaaggcgattcatcattcatataataaaaaaagctctaaaatataattcctagatttgaatacttgaaagtaacattgatataaattaaagcctaggtgttcctgctcaggtagcgtgtttcgaattctcatggttttggtctcattggagagctatccgcagtagtggtgtatctgaaaatactctgataagcatgaatgagtctttatgctagagattgaaacaacataattgcctcaattttgttcaggtttcttttatatagagacccaggaaagaaaacgttaactgtccaaggatatatatatatatatatatatatatatatatatatatatatatatnnnnnnnnnnnagaatgtgaatttaatcttaatttaactctacaaaatcagtgtaggaattctaattttttcaatacattttttcgcatccaacacttttaaatttgatgtgtagataatagaagagtgatccgtttaatagatttaatataaattttaatattattttaaaacatgagtctaactcaattttataaaattgatttttaaagtaagagatgttttcacctatatactttatcttgatattatctttagttgatgtgaaatttaatcttttttttccaatagatatattggctcaggttgtctgcagttccagttcatcctctgatttgttagtttgaacctccataaactaaatttagactaattgtactttaaaagcttcatgctctttggctaaggttgttggatttgttcaggttgtgagttgtgtgcggtgccacatgcttctcccagtaagtctttgttggaactattagttaatttagaattggaatatatccaattgcacaagggtcagaatctgagtagtcaagaggaacaatataatctactataactgtacaaaaaccaatttaaatagaacctgtatgataagtatgaatcagaaacagatgcaaagagatgaaaggatccgagcctaacaatgttgtctccttaagacaatttgttccctccaattgatgccaaaggttgatgaacaattgtctcccaggatagaacggatcaacgtctgaagattgatggcacttcaaatcaacaacccaaacgaacaaagacaatgcttgaggaaccacagagttatgtgatatgaaatgcactagtgtctaagcgagactatcagaaaagattaactatcaaaactttatcagttttccactttcttgcttcattccttcctattttctgactgtctctgtgtctatttatagacaacaaacaactctggtgaagagttgtcagtaaaccatcgcgactcttggcgatgaaccatcgtgactcttggcgataaaccatcgtaatcgttggttatcggagcggttgagagtagttatttttctaacctttcccaagagcggttataagtagttactattttgaattgttaaccgcctcttattcataactcatagagtttaaacaaaaactccaacaatcccccacatgaataagagatcaattcaacatgactaaatgcatatgaatatgtatgcaagtgtggttcctcggcgagaaacaattgcatcgagataggtaggggttacctttgaaccttctctagtgtaaacctatcgggtatactaggccaatcggtggtcgtgatgccttgaaccgtcaacctgtatggtgtataccgagaaaataggagtcacacaattgcttctctagcattgctcgtcctcattgttgtgtccattttggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttctgcaagtgttgtagagaatcggccttttttaagttctcattgaagcggccctcacttcacactcacataggtgatttcttgtgatatacctccacatatatcatctgaacacatcagattaagaaaccattaaaagccattatgcttaccctcatatgcactgtattgtcataggaatgagtatgagtttaaaaactccacagtgtttaacagtcgatcatgacttagttgtctttttgaacctagttcgtgggatctccactcatcaaggtagagttaccgcgatgatcaacaattgataggccttagacccattcctttcgacaaattttcaactaactctgtaggaattcctttagttaatgaatccgctatgttctctttagacctcacatagtctattgagatgattccattcgagagtagttgtctaacggtatcatgtctacgacgtatatgtctagactttccgttatacatgatgttcttagccctaccaatggcggcttggctatcacaatgtatgcctacagctggtactggttttggccaattgggaacatcttcaacaaaattacgaagccattctgcttcctcaccggctttatctaaagcgataaattctgcttccatagttgatcttgcaatgcaagtctgcttggacgatttccaagatacagcacccccaccaagggtgaacacatatccgcttgtagatttagtatcattagaaccggtgatccaatttgcatcacaatatccttcaataactgcaggatactgttcataatgcaaaccaaagttttgagtgtgctttaggtatcctaaaactcttatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatcgtattaacatgtatatctgagacatcggatttataaaccaagaatcgactagcactactattaagtgcataaccaatgaatacacaatccacggttttaggtccgatcttcaaccttttgggtttaggaaccgtgaccttagccaagcacccccacactttcaagtatttcaaggaaggttgctttcctttccatacttcgtatggtatgctctttgtcttcttgtgaggaactctattaataatatagtttgccgtcaaaatggcttccccccacaagttctgtggtaaaccggacgtgattaacatagcgttcatcatttcttttaatgtccgatttttcctttctgcaatcccatttgattgcggtgcataaggagcagtcatctgatgtataactccagattctatacagaattcctcgaaggggccatcatattctcccccacgatcgctccttatcgccttaattttcttgttaagttgattttcaacttcatttttatattgtctaaaagccacaagtgcttcatccttactattaagtaaatagacataacaatatctactgcaatcatcaagaaaagtaatacaatatttcttattacccctagatggtacagttttcatatcacatatatcagtatgtattaaatctaacaattcagttgatctatcaacagaagaaaaaggtaattttgaaaagtacagaaacactgattaatcacacagatcaaacagaaacactgattaatcacacagatcaaacagaaacactgattaatcacacagatcaaatagaaacactgattaatcacacagattaatcgttcaaagtacagagagtagacaacagtatataatacaataagatagaatatactgaactcagattcaaagcaaattgtcttaagattgttggaactattagttaatttagaattggaatatatccaattgcacaagggtcagaatctgaatagtcaagaggaacaatataatctactataactgtacaaaaaccaatttaaatagaacctgtatgataagtatgaatcagaaacagagatgcaaagagatgaaaggatccgagtccaacaatgttgtctccttaagacaatttgttccctccaattgatgccaaaggttgatgaacaattgtctcccaggatagaacggatcaacgtctgaagattgatggcacttcaaatcaacagcccaaacgaacaaagacaatgcttgaggaaccacagagttatgtgatatgaaatgcactagtgtctaagcgagactatcagaaaagattaactatcaaaactctatcagttttccacttttttgcttcattccttcctattttctgactgtctttgtgtctatttatagacaacaaacaaccctggtgaagagttgtcagtaaaccatcgcgactcttggcgatgaaccatcgtgactcttgacgataaaccatcgtaaccgttggttatcggagcggttgggagtagttatttttctaacctttcccaagagcggttataagtagttactattttgaattgttaaccgcctcttattcataactcatagagtttaaacaaaaactccaacagtcttgtatagtccaccaatagacatcaaattcacgttgatttttaaataattaatctttgagtcatttatataagtcttgtaaataaaataaaccgtgggttacttagtataaccgagcaaaagattctaaatgctgtaattgtttactttgtatgtaattaattaagatttaatattgcacattaatatgattcttcgtcaagaatttcagcatgtacatgagagcattgttctctatgtgtattttatctacactcttcttaatatacaaaccctaactcgagatctctagctaccctcctagatacacccaaatcatgattctagtacaggagaattgaagtatttttttagaaatggattcatggtttatattgacttgcatatagttaaaagtttatgcattgtttgaatgatcaataatggaattaatattgatatatcactttggctggctttaggaaacgagatattgaatgacttcacaagtattaaacagttttctacaacaaaaatgaatattgtgaagtaacaatgtaacattcacataacacaaatatctggtcattacgactagggaagagagagagagaagcttactttcgtattttgtgatagtatatcgatattgaaggattgcattttgaccaagagaagttgatgttacgggaaaactgcgtgataattatacttactattattagttttcaatatggtgacccattcgtaattatttcgaaggaccatactaagggatgacttttgtatgtagaaagtgaattattttcggggcacttccataaacttgaatgtaaaagcctgaaataccttgacgcttcgcaggtccttcaacagttccacgaacaaaatttctcattgctccacgagggtaataatgacatggacattcaatatgttttactttctttttttttttttttcattttttggtataacattaaataaaaaaaacttatatattgagttcatgagtttaataattcttttaagattgaagagagcaattaataaaaataaacactacctattattattaacaacatctttaagtattttgcaggctttcgtaattacaagaaactaccagtgtattttttttttttatatataattgataacctccatgtcatttttgaagtatagctaggaagagaatgagaaaaggtaatagatgtgataaataatatgatgagaaataaagaaagatgaaaagaaaaatgaggtggaattgagatgaggcacttctttagtaattttaaaagtatactaacccattttcagttccaaaaccgttttggctcaaaagagggacctaagtttccgctttcctcaaattaactcatatgggaaggccaaacacttaacttgcaattgagaaaattagcaattccatcaaaagataatcaacacattaatattgattaatcaacacatcaaaggtccgatacctacttgaagcatctaatatagtaattttaaaagtatactaacccattttggttacaaaaccgttttggctttgactaaaacactaaaactataatttttttataatataatttaagaatattattatttccctattttatgaaataccacaaaaatagataaaaaaaaataagtcaagtcttatcttaattatattggtgagaggaaatgttaatgatagtttgaaaaaaaaaactaacaagatatgggaatgtgggatgaaattttttctatgctcgaaggctctaaccaatgtgttcgaaggcttcaaacactatcatcgtttcagttaaaaatcctcattttcttagtgataagcgataaatttattgtatttttatatgtaatttgaaatatttacttgatattttagtatattttaagctttgttttgaatcaaattcgttatatttttaatttttaatatattttagataggattacgattttagaaggttttaatatgattttgagttttacataaaaacaggaaaattttataaggtataggcaatttaagttagaagagtatgtctcgcttaagtgaacaaatcacttaagtaaaaagtgtgttaggcagtgtctctataaactgaattaattcaaaactgagataattatggagatatagctcaaaaataaatgaagaaagtcacttggaagataattggaataattaaaacatattatatcagtttaagagataatttccttatatagattatattttgtaaattaagataatttgtctctattaaatatacatttgattctataaatagagagacataggcaacaacaaaaaacctctacacaccacctttcactaaaaaatcctcttatcttctctcttcttgtatttcatgagtaactagtttcttttttaattaggaaaggaaaaagattgaaccttatttgatttaattttctcacattaatatattgtttgagtttattattcaccttctatatgcacatctcatagatgattctagaaattgacatgcactctgacaagcctcgttgaaatccgaactaaatcagaaacttaattggggttatctctattaatagaataattttggttaagtctcactaattctcaaatgataattttgattgcttgtgttagtttgccaagggattgagaatcaagacaagtgattagggataaaatacatcactaatttggggatgaacgatataacgacatagaagtgtgagtaattgtagcaaataggatgattttgagtacaatcttaacatctcaacgttattgttccttctacaattattatcgcttcaacaaataacttattaacttttcttttagtttatgttgttgaatattcagcatattaatctctgtagaaaaatatatcattttattttctgttttgattagttttagttttaggcagtttaaaatatagaaaacaaaaaaatatctttattcgaaaggctttaatttgaatattcatcctgtactattcctttggaggatgatgacctgagcttcatttgagtattataattaggatttgggttacacttgaccgatgtaaatcctaacgtaatcaaaacgttaacacatagataataacaaaggtacaaagaaccttctcttttctagttagatgggctcacatgaagaaaatttggttgcttcttttttgttttcatttaatcatctaatatgaacaccaactatttgctctaaattaacttctttcttttaatttgttccatatgtttcttttattataaatttttcacatgaattatattcactcatcaattttaaagcttctattcaaagcaattacgaaaattttatcaaaaacgaatgaatatttctcaaagtgagagatttataatataataaatgtagaacaaaagagagaaggaaatcgagttaacttgaaggaagcaactggtgttcctattttttaaaatgaaaataaaagaagtaactaacaaatttgtcatgacttgcaccgtaattgttgtcattttaattttcaggctttgttgtagtttgtaacattattcattgtcgatttctcgataatttacacattaccacactttactcaattcttctttggaaaccaatactagaatttttggtgtgctttatcttcactaatatgctttagaaaacttttcagaaagtcatttatctcactcacctcatctcctttcttgcctaatagatcaattaagctgttttgttgtttattgatcaatcacgttttactatttttgtaagaaaaagtcgattcccatctgatctaacttctatttggttcttcatattggtatgacacagatgcaggtggtatgagctgcgctactaggtttgtcagggtaaaggttgggcttttgggtactactctattgcagtagcatttcctacgctttaatccagttgacaagtagacagtcataacaaaagcattgagagtaagcaaaagggcactagtgcaggtaattagtgcactacacatagttgatatttgttgtttcccggtacaatgttagctcttatagaatttgttagcatatcttcaggaagatacatagaatatggatcactccatcattgataaatttgttgattgtggcctttgttcccttgttacaaacagttgaacttgtgattatacaccccctcttcaaatgattgtttttgtggcaaattagtttgattcagaaagtgccagaaaaagcaaagcgagtgcagtagcaatttgtgggtttgttgcctctatttgacccaccaaggcatgacattgctgagaccataagacgtgcttttatgactgttgtcttcttctagacgctgctcttccatcgaatttcttcacggtaagataaacatattttctttaaaatagcagaattatttttcaggcttaacctctctatacatgaaaatactggcaggacatatttggcgtgagatctatcaagaacaaccatcgtgagctcatagaagttgtttatcttcaagtattgtaattcaggctcccattgctacacagtcaaggagctggacttacattgaactgggtttgttttcctaatattcttactcttgcatagaaacaacacattaatgattgtaggtattgtgttttatggattatttcttagatagccatgatcatagctgtgtatgtgaattggggctttgcaaggattgaatggagtcaggcaggtgtcatttggctctatagcatcatttaatttcttcataccattggatatattcaagttcatcatccaatatggattaacagacaaggcatggaaatataatcgagatcagggcaacatcttaatctctgccaaatttgttgctcaatctgactgcttttcagtgttgtgatgcaggttgctttcacttcaaagaaggatcatggaaaagagggagagagagagagagagagaagcataagggctgcagctcaacatagtttacatggtctgaatcctcttgaaatagacaaaatcttgaatgaagaaaacaactatagaaaactgtttgaacatgctaggaaatgtgctgaagttgcaaggtaatgtacattgtccaggatacctttatctttgattttcccccccttaattaaagccgaatccaatccagaatgtaatctatttggtttgcaggttatgggagcttcacagtttacacactaaagggccatatcaagtctgttgtgaaactccagggacttgacattgagacatttcagcagcaatacaccgttagagtgacttaagttctgcgcaaaagagaggtttagaagacaagataaaagcagcacttaatctttggaaattgtcattattatttttcacctcatgaatcatgatgacaatgaactgtgatcttttgattccttttagaatttgtcttcaatattttgttatatccttcttcaatatttttccccggcgagagagataagacttttttgtttttttgtgaattataagactttagttactgcaaataaataaataccaaatctcagttttcttgactacgcttcatcaaaatgcgacttcctgaattaagtacccattagtttgctggacttgacgtgagattactcaaacaatgaagcagaatttagtttatccctctacccccatcttattagatattgagttgcagaaataatatgttttaaaccggtcatttcatttcttcatgctttatacatatttcacacaaacttgaaacatgtcccaaaaattactattcaacgtaattacatttcatttttaattttattttatgaaaaaatacatttatatatacatgctaagaccatgtatgggggctgatggcttgaattggtgaccttgaattggatgttgtgtacatatgatgagaaacaaaaggtgattcagatgtatttggatgacttttttaatttaagaatgcaaatataaagtccatattatgggtaaacattttgaaaattgtgataacatatacccataaactcatctttatatatgtgtgcctttattattttcattcttattaagaggtttggagtttttctataattatatgtaattagaactgtaattacagggaattgtcattcaatttacaaacattattataaaaaaattaaatgatgatctaattttaaacaaaaaactttaaacattgttaaaattgtctaaatattaaaaaatagtattgacattgttattattgtcatatcactaatttcattattcaaaacgaaaatgtttgaaaattttattaaatgaaagatatttaaacatagaaataatattaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttaatttattttgagaaaaaactaaaagtaagatcatttactcaataaaatctaattgacttaaatataaaatatgattgtccaaatttaaaataaagataatttaatattaaatatttaaatgtataatattgctatgattatttttattttatattatatttttcaacatgttaaaataaagacaaataaaacccgacatccccgggttaggaaaaactagtatagtacattagggatttgcaatgttttttttttaaatatatatatactttttacataatgtttgagatcaccaatataaaaaatgactttctatattagttacaacacaagctaatgcaaaaaatgatttttttttatatcaattgtgactaaaatctatgcagaatacctctatattaattaattatctttaaactagtgtgaaaaaaaaatttatattaattttgaaatcgatatagaaattattgattttctatatcaattgatcatatatctaactattcacaaaattatttagaatataaaaaaaattgatgttaaaagcctttaaatttttgtactagagttgagtaaaaaagatattggaggtgacaagcttataaaatcataggtcaaatatgtattgagcaagtctcaaagacttgtcagttattaacgggataaataattcaagttgcctatgagtatgcttcaactttaggcaattgtgtcaacataaggtaagcgtcattgctaaaacggaagagtcgagactgtcacatattcatacagaggttacttctagttgccttccactctctaccaaattaatcttaattggaagtttcttgttgagcatagtcactttttttaggaaactaatttacacatctatacctatatgttgctgtgtaaattggagcaattcttccttctaagctttcaaacagttcatgaataaacaaattcaatactttattttcataattcacttttactttctcttttatgtgattgcatagaaaatttggcatggaagttggagaagcttgattgattgagttggttccaatgtgccaccaagcttaattaacatgcttgattaactttgtggaactgtagatatacacggtcacaacaagtattgcaatgcgattatatatttacctgatttatttcaaatctattcaaagtacttagtatattttctcattgagaggggtcccaaagggggtggggcttttgatgcaaaatatgttaaggagtaagagcaagaccaagttgtcgtccatggcacgccggggaccgactgacatatcacttcccactaatgggtttttttctttctcatcattgattgtgacccaaaagtcatattctcttttttttttttttttttggtntttttttttctttctcatcattgattgtgacccaaaagccatattctcttttgttttgtctctccaatcccaatattttctctctaatgtcattttgtgaatctttgcaatgaaaatgtgaccatgaatggccttttcaaatgataaaaagataattcccttggcgtgtaagacttaagtcccttgttggatagtgtttgcgctctttatggcttttttccatacatatcacattataagtttgtcatactcaatcatggtataatatatctttgatcttggacatgataaaaatcatctcatgtatacttgcttttattttgttttatctacttcaattattgattatattctcacgttgacttcccttttcatctgtttgaaatttttctcacctagaaaatagattgatataaacaaaagttaaaaactactttggcaaatatgtctttgtatggagaaattataggatggtccagaagaatcatcacgtatttatgattttggtcaatttcttgactattggtttaaattttttgttgcattgaaaatcctacgaacattgatcataagcatggattttggatttatattttttaatttatttgttttgtgagtgtgtgtgattgtcagcaattgttaactaccagggtatggtatcaatgtctgtatgtcatcatttttaggaatataacagaactaaaaagcctcgtgtttttgaattggcaaccttctcttattacaaaaaggtaacaaagatcaccagaaaaaaaaaagggtaacaatttttttgtttcctttagtattactgtgaaataaacatccttttgtctccaattgatgcctaaacatgtgaagagatagcgataacccaaattattatagttgggtccaattattatttagtgtctcacaaatataattctaactttttaccaaaaataaaataaaataaaatataactcgtaagaagtggataaaagaactctatttatataaataagattgatcatttctaaatattcaatcagactgctaatttcaaagcatcttgtataataactgaagatttcttaaatgctaatgaaattggattcatcgatcacagtcaaaaggtattatttgaataaaaattggtgatcacattaaaactatctaactttatgtgtatagattaatttcttttagttcagaacaatcctcctgttttcccgctacaaggctcacatgtaactattgtaagtgacataattgagtttaatttttaagtttcgtaagtgtaaatttttttatggtatcagctaattaaaaatcataatagatatcaattttaaggcgactattattataaaagtcggtaccttatcatattaaatatctttatacttcaatgcaactatctcgttataatagtttgtttgactattgaccaaaagacaaagggagtaggttcaagatatatgaaatgtaatttacaacagtttaagaacatattgtaaattggttcacaggggaatccagagtacagagaaaataagatctgcctatgtgaacaaaaagctaaatcatatctagaatagggattagggacacttgaaattcaaaacgggattctatcttataacaaaagttaaggggctctataccacattattgcaatatgatttcagaatttctacgagcaaattgggggaattttctttcgacaaaaataaaaggggagctgctttagctaaattaagagaaaaacaaaataaaaatagtctctattttcttggcttgcaacaattaccacaatataaaagttggttcattgggaaggcaatatgatggccttttcatatatttgataccccacttggttactaagtgacgaagaagaatcatttatttactttacttaacgtaaagctcatactttttgtcaaatcgttttctccttcaccatgctttaaacaaatattactttggtcatgcagcataaaagaggcaattggtggatatgccactcagaaacataaatatactattcataaaaaaaaaaaaaaattgtgacaagttgacagaaactatttgagtggtgacaggaatcattaattagaatttgattacacattgacttcctgctacaaattcctagagttggagccaattcaaaggaaattcatcaacatctttgttgagtttttctctctgttattgttgtcctggagatttcagactcacataatcctatttatttatataactaatttgagatagattataacgaaacgaataaaaaattgtatgtggcttgtatttcagaaaatggtttgaacccaaaattaagcatttgttaacttaaatttcaataagggcattcaaagatcaacgttcttatccacggaaaaaaaattgtcaagttgagatttattactaatagatttaaatgaagttatttctatgaccgagtaagttatgcagcattcacactaaaaaagatagattttaatttcttttttttttcttgtcaataattttggtatggtgttagaatgtacatgctgaacaaatataaaaaaacatattaggacatataaaaaaattcgtacaagctgaaattcttaaatcgttaccccttttcttttatttcaagaactagagacacgggtcaaaggaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttaaaagaacgtgttatgtaagttctacttttatttacggaaatattttgtcacatatttcttccaaacacaaaaatcttctgacataaaatgagttgttttgtttaaattcccagttattactcaagtttatatttggctgtagggaatcttatgacactagtgcttgtgatcttacaacttaataaaaaataaataaattaaaaatcactttgtttttatatcattattacatatgaattatcaaacttcaaaacaaatacttgcataaccaaaacaacaataccctttaatataatgatataacttctttttttaatttttcaaatgtgtcctttatagaaagcaattttaacaactaacgcgttcatcaacaagagttagaactaggaattgtcacttggtaaagactttactttagcattacacaccagaattctttttaatggataaaacgaatatttatactatgaaatgagtttagaagtgtttactcaattcatgccaaaatttattgttttatatttgtataagtgttgaaaacagtaaggttaggttacttcaataaaaaaaagcattttcttattcaaaacatcttttagctggtatagctagacatgcatgtatttgctgactagaatatatttctacaatataaaccattatagaatatacctaactaggtcagtataatcatattaaatggtcattttcagagaagacattcattagtacaagctacttcaaataaatttcagtgactacagaaatcaaagattaaatcccatggttccaaaaacttcctcaagtgcaagcctgtgcagttatagagacagcatgacaccaattcatgaatggagtctaggcttctctaggttccaggtacacactatataacctaccttatgacagcaaaagaagaaaaaaaaaataacaaacccttttctcttttcctaacagaaataatatgaactttaccaacacgttcaacccccatctactcacacttgatggacctgtatatgtgacgaacaaagagcagggaggcacggaaacctacactaccaagcatgaggaaaaagccatagcagatgcaggccatgtaaccgaagaagaacgaagtttgcataaaaccagacatatctgatcgtgcatagtagtaatacaagcaatagccgtagatgaacaagccagttgatccaccacaaaggaaagacctacggaaaacacaagccaacagcaatgtcatccagttgaaagctaagtgctcagggtatattaaaggcttaaattccctctatcttcaaaagattcataacatcattgttaagaaaataataatagtattggctaaaaaaaacacattccagcagaaaaaggaaaaatgttaaggcaataaatggcatgatattgtactaaacccttaatattggactaagaaagcactttgtttacaaagttgtgccaatgtcattcacttaagttttcttctttgccgaatttgaacaaaaatgtttttatataggtttaggcataggccatgcctggcattgcccatgtgctcagatggcccaaacctttatagtaggcccaaattagtttaggtttgatcctaggcccaaaaatttggctttggtccaaaacctagccaggcaatgaatgcaacagatactcgagaatgccatccaaaagaaaaatagtaacaaacaatattttgtagttgcatctccatatgatgagattgatattaaggcaattatagaaaaaacattattctttataaatgatacactagtcctagaaaagctaaatattctaaggtacatcccttccattacaccatcaacaaaaatcttaccaatgccgccgactagtccttaaataggtgggaaaactaattttactatgattgcctggacacttatctgcttgtttgagtagagacagaatatgactagtaggaagtctatttggacacaataaagtctaatacataagtactttccatctattcaatcaaacaagaaacactattttattctacaaaaactctggtataagtcaactgagttaatatacatgattcatagtcattttacagaaaattgacagatcaagtatcaacatcaacatcaacaacacctttaacatcaagtatctatggtaaaaactcaaaaatcccaaattaaattgtagccagttgatgaattgaactagttattcagatagggtaatggaaaggcagaaaagagagaacaaggacaaggagaggggaaaaaaagaaaggaaactggcaacttaactcaaagacataactgagttcaagatccaagtagatgaccttatataaagagtccacaatttacaaaattacatgcagaataactaacattaaaaaaataaaataaaatccaaagtttaaaccttaatggtaaaatctaaagttatgttcatatgctgatgaatgtcatcacatgtcttccactccttgttgcgaacttgggatacccatatcaccattgttaattaactcaatatttttttgaagagaaccaatgaggaagaagggatgaggatatgagatggaaggaaatgacccgctcccctcccaaacaccattgagagaaccaatcacataaacttcctaattcaccctcaaggccttctaatctcagcaaaactcttatagatatacattactaagattacatgcattaaaattgtaacatgacaaagtattgtggcatcttaaatattccttttttctggaaccaacactgtcatgaacatacatttgactaagtgggacaaaggccactaaaactatgtaacttaaatctaaatattagaatatatgaagaaaaaaaatccaataatatattgattgtatattagagtaatttagtgtatcttagattatcaattacgattagtttccacaattccttattatctctttggattggtatccttatttcattatatttaaatatttaattattagtttccttattttagtagggattatgatctaatgttagtataaataagtataattgctttatattttgtaacaaatcatatcaagtctatatcaatttcagagtatccagtctcaattatctccttttcctacaacactactaaaaggctttaaccctataatttcaacttggtattagattggtannnnnnnnnnaaaaagagagagagagagagagagagagagagagagagagagagagagagagagagagaatgccctacatttgttcaaccagaaaacatattttctattttgttaatccaaaatgccattaaaagcctgtttcacaagttatgtcaatagattatgatttaagattccaactaagctcttacctcaaaatgaatattaaggtattagcaatataagcgatcatttccctggagaaaaataaataaaggatcaaaacacaattacatttgactacaaaatataaatacagaaaatgaggagatttcatatggcaaatctaaggtgtgaccttactgcagcaacaatgcatatttttttgtttagaggtttcatatgattgactgttttagcttaattagagtcatattttttgttttcttatgtctttatagagatagtnnnnnnnnnnagggattatgatctaatgttagtataaataagtataattgctttatattttgtaacaaatcatatcaagtctatatcaatttcagagtatccagtctcaattatctccttttcctacaacactactaaaaggctttaaccctataatttcaacttggtattagattggtactgtcctcctccatgacctatctcaccactattagattggagaaaagaggaaaggaaaatgaacaacaacttttagataatagtaattataatttaatattatacttctaattttaaatattttattcaaaaaatataagtgtgaatatagtaaagaatttttttgatactttgtggacaaagtagtgaagatagagaagttatttctcgctttctaattaatagcaaaaatataaatatgccaacaactactttttaaaacttccccctcttttcctagccattgagtcattgaccatatcctttaaaccaaggacaatatgaaaactaactgaattactaatataagagtagataatgtatttctagtgaaaatcacattacacaaactcaaacaactatagaaggtagcaataacataagttacatacctccaccaccattcatgatcctcagcagcaagttggaagtacgtcaaagccacagtgatgaaagcagtgacaatcaacagaataatgaagacaatgaagagtatgctgtagatggtataaattctgtggccccatacactagcaaaaatgtagtacagctctatgtagatggcactaaaaggaagaaatcctgccattgccatctggggaatggtactcctgtaccaaggcagaggtggaatctctcggggatattttgtagtgcggacaggtgcttggaactcagttttgctattcttacctgcaataccacccaacacaagcaatggtgaagttaccaatgtccatattaggactatcaccacaattgtgccaaatggcagggcagcagttgcactataagcaatggcaacagtgttaaggaaacagaacatgaggaatagggggccacaaaagaggcatcctgtcaacaataagttcctaacctgcccacaagaaaacaaatgtagaaatcatttaatttcatttcataaaaattatataaattaatacagtcaaaccatgaacaccaatcaatggaaggagtccatatgtacccaattagtcccttcaagttgaatatagaaggaagtagcagtgtagccagcgatgccagatgtgagagcatatatgaccaccagtgcagtaaataaagcacctcggttataaggataaaacacaccaaccagtgcaagcataaaaatgaagatcgtactgcacgagcataaagaaataaagaatggcattcattacaatatagagagaaaaaaaaatcaacacagggagaaagagcaattagaagattcttacagtgtgaataactgagtaccagaaccaagggctgctgaaaagaaagacttgtgctttggaaaccggaaaacatcaccatgaatgtacttccatcctgtctcctcttgatcatcagcagcttcctcatcttgggcatacctggagaaaattacagacaaaaacaataaacaaggggtgataataagattaataaaataatgttataggcaacaagatgactaactgatgatagatgagcaagaaagtcatacttcataaagtcattcttcaatacacgcatgagaatggttgccagaaaaccagtcaaaagaagaactgttacacaggagtttatgattgagaaccagtgaatctccaagtgatgtggcaaagaagaagactgagagtatttatccattctcttctcaaaaggtgtatctgtttccttccattttgcagtgtacatgaactcaacatcaacatctttatcctcagtcaggtccaccacagaatgaggatccattcgggcactgatttcaatcactcgatctttgttgtacagaatatcgaactgaatgtgcttgtaaagaaaatacctatactcactagggtcagttttcccttccttgtcaaccgtcccaataaatccccagatcggcaaatcatcataatacatctggaaataatagtccttcttaactgcttctcggaactgagcaacttgctcctttgtgagcttcctcttgcatacaaccttagagtctttctccttcttgaaactaagttcgtaaggagcactaacaaggcgatcgccattcaacacctcaccgagggcttcagtcttttctttctcatgacctgccattcagatgtactcattttacaatgacatatcaagaacccataaaagtataaaaaaggacgaaggaatatccactaaacagagctacaaattgacatttccacgactagagatttcattaaaacaaaaacacaatagcaacccagtattctgtcccttcctacaactgaaacaccaaaactaaactcaaaacctcacatgctaaaactacatcacgagttatcacactcttgtattaataactagagaaagagagagagagagagataaacaactttgactaaatcaaataacaaagcttcaattatggaagtaataaataaattcagatagttagttacctgttacacagaatggcaggtcaaagtatcgatacgtttcactgaaaccaaccaattaaacaaataaatgagaaaatcagaaagacgacaacctcgtacaacactgacgttgcaatccgagataataaaaacacgaaactgaaaacaagatcagattttgacgacgacccagaatctaaaaagggtaaaattaagtgttagagaatcatgggtgtggttgggaaatgggatctcaaggagacgaacctggggttgtgaaagggaccaactttgttggcgtaaagaggaacggattctccatccttgtaacggtgatcggaagcgtcggatctaacgtgggttccctgaaaagagatcagaatcgcgagaaccaaagccaaagtgcttctacccattgccgctgcactctcgttcgttcttcgcattcagatcagatggataaagaacaagaaacacacaaagacaataagcaagcaatttattcagtacaaatttctgaaggaaatgacacagtttattttttaaaaaataaaaaacgaagttttgtcttttttctttttcttttcccattttataaatctatttttctctattttttatatttgagtgtatgcatggtgacccattatatgttactatagtctctactgttttacttggcattagcctccatcattcattaaaaaaagaatactgctatttatttaagggaattttcaagataacaaattacttgttaatataactaattaaatttaaacaagatattaagtttttaaatagttgtatctataaataatttgtgcatacaaaattatttatatatttacataattcattcataattaaacactaaaaaaatatgaatcttgatgtagtttcccttaaaattggctttggtctcactgtcaccatgattctaacactcaagtcacaattttttttttgaagaagactcaagtcaccataagagacagttgaagggtgggaaaattggagacacaaaaatttgcttccatgtcttactgtttttatgttgggtttgtcccacactagtggtggtgattttgttggtaaaagtaaaactgcatgatacgccccaatccaatattatgtgcaggaaattgctattcacaccacaaatttcactaaaaactcctttttgtagtgaatcatttattaagaaaaatgaatatatataattcacagccatatgctttaaaaaattattcccaaaggacctttttgacataaatacatttctgttgtataaaatatacaacagaaacttatttttgttgtgtaaggggtgcaaaaatacacaacaaaaatactccattgtatatcatatatctatatatatatatatatataaggaattgtgatttcactttcattttactttttatagcaaaggattttcgcttaagtaggagtaaaacaaagtatatgtaatacaattttagcaagaaataagaagattttgactctggaagtaaatttgagagagaaagtcataccacatgtaagtttaagtatgtaggatcaatcacataagacagatggttaaattaataagaatgtcatatataatacaaacagaatagttaaatggagagaaacatggagaattatttgtgctcctagaatgactaccaaactcaaatgcattgtatttctataacatttgtcggtacaacttaaaacttcaagtaataacacccatttaaaaatacgtttattgttaataaaatacagtctcgtggtctattctatatctatttgttctaatttacaatgttggtgatatagaggcaccatttattgcacaacaaacattaatcactaaagattcttcaccctcaagattagcgaaaagatagcgtgcttggtgagtcaatcctcacaataatatcttcttcttcagcaccagaatcatcacttgaattatctccatgatgatgctgtcttcgttctgtgctttgtgaaggtggatttgtaacatgtcttgtgacctcatggaccttcttggcagttgcagctccttctgatttgactgaaacaagaggacggccttgatgtgacccaatggttggataggacaagctatgaagtggtctaccataattggttaacaaacttctactccggggagggatgtccaccttgaaactgagaattaattaatggaaaataaaataaagattaacatttctggtgcaagccaaataacataataggaatttaagtttgttagtgagaataatttctcccaatgtctttttggtctccctccttcccttttcaaaattgaagttgatcatttgtaggctctaagtttgatttatttgcagagattgattgctagaaattttaaaaaataagccaaagctcttttctaataggaaaaacatccaaggatgttgatcaagctctaatcctactcttctttgcaactgtacatgccacaaaactggaagtcaaaaagaaaacaagatgcacactgaaaagttaatagaaagcacattaccataaccttgtattgaacaagcttcaaatggaattcttaaataacaatgtagatatctgattgtataaaaagctttaattaaattgaaaaacatccaacaatcaagcatagtctcccaaaaattttttgtccttacagatgcagtagtgtcttataataatgtgcctttcctttacttttaacctaaattaatgaactgtaaaaatttagaatgtttgaagcagttaatcaaacagtaacaaggtagagacctgatgaggttcctcctgttgtaaatattaaaagaattgacacaaataatgaaatactattcaagttaaacaactcttaaggactgaaacaaatgcaaaagttcccataccattcagaaggcctactcgtatgtctttcaaattcataggatctaggttactatcattttcaggtgcaccatgagggtgaacactttcaccttcaatgctatttaagcaggagatatatctcttcactgtggaccagtcagcagacccaagctcctcatcatctccaggttcaccaaaagcctccaatgccttgttcaacatttcgtactttgtgaagtcaaggatccgtctctgttattacatgagcaaaacacaatggccagaccaaatataagtcagaaagaagagaaacgggtgatatagagatattttcatttggaatcaatttacaaacatttatacaatgtagaagctttcctttgtttctcacaatctatacttattcgtgtataaatttatacaaacccaaatgtttatatagcagttatgaagcctaggtactccaaaaatggcagagtaatggcacacccattaggagatcatattttcttgcaatgaaacttggctgcattgctgtttttttcaagcctccttggctctctaatttctattagttgctctttttatttttactttctgagttattgaacaacaattctaaatacatcttcagtgctatatacaacagtgaattatatggatataagatatttttcagggtattttcttagatttaagagagagagagagaccaacaattaggataaaagctgaagacagtagggaattacttaaaatatgagatatcaaagcattatgtctctcaaaacgacaacataagttgaacatagaatatcagaaaaaccctgaccttagcagctgacaatttattcatgccaaggtagtgtaaaatgaattgtgtggttgaaccatttattataaatgttaaaaacacagttccaccagttaagaaaacaaactacacatataattgagtcagtttataaagacaactaagatatcaaggatttcagggttgcaatgactttacataattttagcaaaattgctgacatgctcttgataaggataatcatagcttttgggattttagccttagtcaatcccacaaaactagcttgcaagttaaaagactgcccaagctttataatctctctttaagtcatatctctagtcaatgtgggactaaatcatcacccttgattgcagcccctgaacagaccgcaattcaggtgggctagggtgacctttaagggaacattccaacacataaaaacaactgctaatttctttcacattttccactagcaagtattcattttttttcttctacaaatcctattgtattggaagatgaatatatctcattattcccaattcataaaccattattcctattccattatcagttatattttatgactaccatcatttgccttttagctttggttagttagtttcattgcttggttaaaggagtttaccatattgccctttctctttttaagttcccttaaaaataaaagctcttccttttatcagaaaaaatctaaacagcagctatctcacttgtaaacaatgataaggtacaatgcccatgaataattatatctataaagagggctataaatatgcatcattagtccatgaatacttgccttaactgataacgagagtgccaaggcaactgcgcctcacaatcctgaccagatgagaataatagcttctttccaattcaaaccatatccaaaatatcttagaaagggaaataatgctccaactacaatgcaccgagacacttgaacacatgcatacagaagcaagaggtggatccatgatgttcctaaaacagacgcaatacgttgcagtcactctttttatactttacaaacatgagtacttaaacaacataaaaaggcaagcgatactggcaagagcttctagaaaacgtaagcttatcaaagcatcgaaattaagttatcgctgcttctttgagaagagcatgatcatcagagttatttctttccaactttcataggcctctctcattgtataaggtttgttactagagagaaaccaagaactaaaacgcaaattattatcaatttcaatccttagattaaaatccttatacgctgagaagatttctgcagttgcattatgcaagacaacacggatatatgattaaaagttaacaatttgaagaaattctatcatttttattttgaatctgcatggacttgccaatcccccccctccccctcccaataatcgtagatacaaactatgaaatacagctttctccagcataattaaaattcgtcagcacaataatacaagattgcaatgaagtcccataatcccattcattaacattattttcatttacttgctttcaatatacttcatggtacagattttccccattaaacaaaaactaagaatataatccatggcatagtgcaaaaaataagagaatatatgaagtgattcttcaagtcatactaccatgatagaaaatattgttgtcaccaagtactccttcagctataactccactgcaaaaagatatacgaaaatattaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaattgttcaccaaacctttaaacaaactttttggttgataaaaaaaataaaaaatagttgaaatgacacactcatgtagtaagtaacataggtttattaaaacacggtttgaaaaggaaactctagatatataaatggtattcaactcgatttcattttgttattcaaaaaacacctacatttgagctactacctttagaccataaaataacttttgttaattgtgtgaggcatctccatgattagaaatataaaacagaaaaaaaaaaaacacaannnnnnnnnnnnnnnnnnnnnnnnnnnnnnnnnnnnnnnnnnnnntatcaagtgtaacactggaaattaaaaaaataaaataaaatctcccatagaatgaatttagtttatatgcacaaggacaagtgaaaaaggcataccaaaactgatgtaagctttgttgactttcacccttaaaagctgttcttgcaaatgcagaatagaacctgtagaaagatttcaataactagatttccaaaatgggtaatagacatttttttactaaaggtcaatttacattcccaaagatatcactgtcaagacaacagagacacctgaaccctcctgagccggcatcctacttgtataagtattcataatacaagtataatctctaaatttactaaaagatgaattcaagtttgaagggtaattacagtgaaataagcaatgtagctaacagcaaatgtttgaccaatcttaatcactgtatcattaaaaataaacgcaagccacaaaacagatgcaatcccaaaagcaagacccattcctacactggaccgagcaaacagtcacatgagcaaagataattttcgccactagtgcaacaaagaagtaggtgaaacctacgctccaagtgaaacttgtgttagaaatttgattatagcaacccaattgaaggtctctccaagttccatccgatagaaaagagtataaaccacaatagcagtcctggacaagaatgaggcttaagttttgtcaaaaataaaatacatttaaaaaaccatcacatgcagaaatagtcattgtacacgttcaaggctttgagccacttcttacaacctagattcatttggcaaaacagaaattcacttgaagagtagatgttagttaaagaagagcaaagggtactaaaaatacccatcattcatcaaggattccccttcaattatcgtgcttagctttttgctggcaccaagatctttcaacaaagccacaacagcaacaggatcagttgcactcagaagtcctccaagcagttttccaactccagttgtaaggaaaagtaagctgtattgtgacaaatgagctataatcgtataacacaaacaatgaaatctaaacacatcggttcacgtaccttcaaaacaactcctagacaaacagtagaaagtgcaacaccaggaccagctagtaaggtcatttgtgcaagacaccgctgcattagtccaaaatgcatattgtgatggaacatcaggcatcttataaataacagtcagtgacttatatttttataaacaaacatcaagtctgctccctgtttagcagtgtttaatgctagctatgtctgatcttgttgatttaatttctacatctttcattagggaatactggtaattgtatgaaataaaaatatttagtctcatgttgtgcattaaagatttcaaaataattgatatttgacttagaattgttagtttctggcacagttttcaagttggtctcctttagtttacatgacttcttggttagattttgtagggcatttggattattttgttcaagtttcacactattgatgatgcttaattgtgaacatgttggctactggggctttgtggaatttaaaaagcaaataaacaaacacaacaacatacatctagaaaagtcaccaaagcaagcataaattactaataagtaggcaagagtttataaactagataggaactatcataacagaaaagcaccatcactttataactcaaatttagtcgcagttatacataaacttctactcaaacagcaacaaaaacagtactttcgaaaagaagaagaaaaacggcgacaatgatagcacgcgactaatcagaaatatataataactagtatggttatccgtgcatcgatgcacgggttgttattttttcatataatttatatttaataataattaaattaaaaatatgagtttataatcaatttaaaatttaatataataaaaattaatttaatcagtatgtttattaatttaagaattataaaagttggatgtaatttttttaatatttttatcatcaatattattacttaaatttgtatgctaattgtttcatagcaagtctttttaatgtctttttcataattggaaaggacatgtaaggagaagaagagaaattaaaagaaaaaatagaaattttaaaaaagaattgaaatgatttgataacatggatcataaaaattgaggtttaaaataattattgactaaaaaatgttagtaaatcatgattaattatggctaatttaattaaaaataaattttaccaaaattattgacacttaattaaaattttaaaatgtttaattaaattatagctaaaaaaggagggaatatgactaatttaataaaaaataagtggtgtattaataatgggtgaaattttagcggaaagatggcagaagtaacaatttatatatatatatatatattatagattattatgatccttttaaaaaaattattataaatacaaactacaaagagaagcaaagataaaagtgtaaaatccgaaacctttaatatttttttttgctgagtatttaaagccttcaactgcacacattaaaatcaactacaaattcaagaattcactaaagaaaaataattaacatgctactttttagataactaaataaatataaatatttttctacaaaacaaacatgacattttttcaactcaaaacaaatgtcatgaatacaaatgttataaattaaataactattgctttgctattttgaattactttgtttttctcttatttttaaatattttttaacttattaaatccctcataatttcatgcattaaacttgctacgttccattggaggacgcacccaaagaatacacaatctcactttcctttgcatgatactgtccctggaagataaagagtaatggcacacatcattaatttcgaatgtgtgtgtcatcataatgacaacaactttattaggttggagaatcatatggtgaaatataaagttatacctcatgtcatattccatcagtcgtgacaacaaataaggttatccgatgcttattttgtgagttgtgatgctaccatttttccattcgtcaatatacaaattgggtctcttaaaattggaaaggacacatgattattaccacaaaataataaacttgaagattacgaagaaatgacaaataatgtaataatgaaagagcaaaacttcctctatctttaaagagcctcttgatattttttttcaatttataattaatgtaaaatgagaatgaagagttgcacatttagagagtactggaaagaatttaagattcattcaatataaataaataaaaaaatagggagtgtgataattaattgtttcaatgtcactttaaggtttcaacaagaagtattatttacatttattgaggagtgaaatgttttcattagcatgttatttgtttaatttttatacaagaagtattatttacatttattgaggagtgaaatgttatcattagcttgttatttgtttaatttttagattcaactaattatcaaacttgatagttaatttataattgtaccttcaatatggatgagaaaataaagatgatggaagtaagaacttttatatatatatatatatatatataaattcatcgattaaattttcaatgatcgttttattgacaaatttttatcagttgaaaatttcaattttttttgtaatgtttataatcgaatattttaatgaccagtgatcaagttaaatcttgagtggtatctcacctaaattttgtatataaaaataagcatctagtaagctatattaaataggaaattagggacacccatgaattaacaaacaataatgaatctcagcatgaccatgacttattcaaagccaggtactatccagattccttttaggttcccagaccacgtcctttaatatttctagatcataaaagcaaccgtgtccggactcgttgattgtggtatggcatagaccctcctccacatgaacatgaagcatagcagacccattcaaatgtgcccaaacagagcactagagtttagtttaggctatgccttacatttttgtcttcattggcttaagtagttaagttaaccatcttttcctttacatagaaaaaattaaaagttttggtcactttggaatgggtcggcgcttttcaataagttgtatagaatttcaatttctaccactacaagattaaaatcctcgatacgcgcactctcctactcggtttacgcggtgtgtacacattcttatttaaactaacgtcggcactcctcagccttcattttctctctctatctctctctctttcagtgcccaccaccattttcaatcaccatttttaacaacatggcttcacaaacttcagcaccgagattgattcctgaaaggggtcaagttctaaagagggtcctcaaaatggtgttttcttgtttcatgtgtgctggttcttcttcttacaattcacatcatcccaaaaccacttcttcttctgtgtttccagcaccttcgcgtatctgaatctgttcttaattatattggcatttgacaactcgtcaaattggatactgggtttggccgcaccacaacattgttcttcacctccgagataaatatgggtgtcgaaaagcaactggattagttaattaatctcatatagttttcgaaaagcaagcttgtgttgtaacaattttgtttcctgtattcaaaagtgagccctttattatcactttgatcctgggcttgcaaatttttttttgtagtttcgaatgtggaaatcttccttagagtttggttggaaattttaaatattcttaatattaatgttataattgggccatacggaaattttttgtatctatctcaatcgttatagacttttactaattatattaatatttcttgtttgaagaacagccaaaaagtaaaaattattaatctaaattaaattcaacggctgcacccgcacgtgcacgtgtgtggtgattatttggtaggctagcaaccaacgtcattatgccaaagaatagaatcttgtcttgaagctgtgtcactgcttacagacatcgtgctagttactatagaatggaccaatgattgttagttttagttccagtgttcaaacataatttgaaattgctataatgtaacagtagtacactagtactccagtcttatttggatctcaaatactatccaatatgaccgtctcaaacatttttattggagtttgcctacaatatttctttaatgaatttttacgagagattaaaggtctgaaataaatataacaatgatgagaaattgatataaatatgaaatataaagtaaataaatcaataaaaataatataaaaatatagatataattatatttaactcaatatacagtatacttatattttattttttaaaataattatcgtatttgtaaattatattaaattgtattatatagtatcatactcaatatttgtattcatgcagtgcaacataaattatatttagtaaaattagttgaaaaattaatttaaaactgaaaagttaatcagaacataaaaagttacctaataattaaaaaattatattattgaatcataaatgtttgacaaaattatatgttaaaatagctaaaaaatataaaattgtataaaaaataaaaatagtaaaatttttaccttaaatagaaaatattaaaattgaaatctaataaatatttaagtgcaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatcttcaaactattacataataaaaataaataggtgttgtcaattgtgtgaggcatctccaggatttgaaatataaaagaaaataaaatacagcatatcttaatttcttgtcttcacctttcaaaaacaaatttatgtcttcaaactattacataataagagtttataataaagattcatctctaattatgatttatgactcatgttgcggttctaattttataaggaaattgactgcagcataaatcataattcactgcactcaaacaaactcattgatttagattgactgcagttggttattgtcttagccattggatcaaactaataattaaaatcttgcctcatcagtatttttatgattaaaagaaaacacgagacttgctttacaaatttaaaatggaagatacgaaaagcagctgacactgaggtgaggtgaggcgaggtaactattacttaattgtattttctatataaattacatttatatttatatgagacaatttttgttccaattagataaaattattttagtcttatttattttaaacagaattagctttcaactcatattatatatttttatgagtttaatatttatatattgatgcagtcataaattatcataaaatcataaataattgtttgaattattttaaaataattattgtaaaaaattaataaatttatcatatatgataagttgtaattggatgatagtgtataaccttttttttgtttcttatttaaataagttttaagggtaaattttatttataaaaaataataaaaattatctaatttgtaacataaactcttatataataagaaattatgatgaaattcatgttgaattgttttttttcttcttcttcacaattctgcaagttggttggaaggctgtctggttcttgtagacacaagccacgtggtatgctgcttctttcttgggctgaataagggcctcgtgacatcaacctcttaccgcgtgtaacaaagcccgcaacgcgtgagaatgcatcggtccaaaaaattttgcattttcttcttttgaatatcacaataaatatattgaccttgtatataacattttataaaattattttagtctacactgtcttattattcctccttctccaacgaccttcaaatgtaaacccacctaaactaattcttcgttcacatacaataacttgacagtgtcagatttccctaacttgttatttcttatggctatgttcatgttcccttctaacatctaagtattcaaattttttcaatccattatattcgtttatagactatccatcttaattatagcaaatttatttatcatatatatataaattaaaatatagtatgaaaaacttaattttgcattgtcagtacaatataattaaattctttatatatatttgaacataaattatatgcttttttgttcaataaataaaatgaaaacatgctgttcagatatctaaataaactaatatgttttttattaaataaattaaaacataacgtggtttcagatagagtgaaggataaataaaaacatgtggttcagatatcaacattgtattcatgtgtttttgtgagaaaaaacatttcggtcttgttagggctttttcagtcttagcacattgtgttcaaaatgaaacagaggaacagtgaaagatcgacccaatctgaacccttatcaaataaccaggtctataaacaaaacgaacattgaaaccccaatttctttaagtggccttctgacgtcaagctaggtatgacgtttctgtcgtcactcattcgtcattaaaacatttttgcttggttttagaatatctttctggttaaattggagacattactaattattaaaataagtaaatataaaagtgatcgaatctaatttctaccgtaatctatatagtaataaaacaacattttcctaacctatttcttgcttctccttgcttcgcaggttcggttccttacctgcttcttgcttctccttgcttcgcaggttcggttctgcttctctttgcttcggtctcactttttccagcttcggtccactaccacacctctcagccaattccaaatctctgttgggaccctccctcagctttgttctctgcagctctcaacaactctctgaagctatcatcatttcctctcaataactctctcacgaaaacacccaatcccacacttgcttccttctccatcttctgctaacaactctctgaagctatcatcatttcctctcaacaactctctcacgaaaacacccaaccccacacttgcttccttctccatcttctgctatgttttgatttttccttgatcttgctctttctccatcttctcctctctttttgttttttacattgaagctaatggaggctgaaaagccatagctttctcatcg

SEQ ID NO: 2 - DNA, 2515428 bp, Glycine tomentella (residues 1-1,257,714 of 2,515,428)
  misc_feature (2518)..(2998): n is a, c, g, or t
  misc_feature (36286)..(36599): n is a, c, g, or t
  misc_feature (36872)..(36881): n is a, c, g, or t
  misc_feature (65098)..(65189): n is a, c, g, or t
  misc_feature (91979)..(92044): n is a, c, g, or t
  misc_feature (103399)..(103465): n is a, c, g, or t
  misc_feature (108489)..(108498): n is a, c, g, or t
  misc_feature (109073)..(109082): n is a, c, g, or t
  misc_feature (110439)..(110448): n is a, c, g, or t
  misc_feature (114969)..(115015): n is a, c, g, or t
  misc_feature (117523)..(117532): n is a, c, g, or t
  misc_feature (119983)..(120104): n is a, c, g, or t
  misc_feature (147407)..(147539): n is a, c, g, or t
  misc_feature (148147)..(148147): n is a, c, g, or t
  misc_feature (148448)..(148543): n is a, c, g, or t
  misc_feature (151690)..(151746): n is a, c, g, or t
  misc_feature (152026)..(152272): n is a, c, g, or t
  misc_feature (155219)..(155271): n is a, c, g, or t
  misc_feature (160392)..(160454): n is a, c, g, or t
  misc_feature (171648)..(171859): n is a, c, g, or t
  misc_feature (177208)..(177279): n is a, c, g, or t
  misc_feature (178199)..(178208): n is a, c, g, or t
  misc_feature (191490)..(191619): n is a, c, g, or t
  misc_feature (194974)..(194974): n is a, c, g, or t
  misc_feature (196069)..(196069): n is a, c, g, or t
  misc_feature (196368)..(196600): n is a, c, g, or t
  misc_feature (208015)..(208015): n is a, c, g, or t
  misc_feature (212728)..(212812): n is a, c, g, or t
  misc_feature (213179)..(213270): n is a, c, g, or t
  misc_feature (233294)..(233303): n is a, c, g, or t
  misc_feature (252827)..(252827): n is a, c, g, or t
  misc_feature (259658)..(259791): n is a, c, g, or t
  misc_feature (262066)..(262133): n is a, c, g, or t
  misc_feature (262439)..(262704): n is a, c, g, or t
  misc_feature (269209)..(269218): n is a, c, g, or t
  misc_feature (270030)..(270039): n is a, c, g, or t
  misc_feature (270849)..(270858): n is a, c, g, or t
  misc_feature (271823)..(271844): n is a, c, g, or t
  misc_feature (277888)..(277935): n is a, c, g, or t
  misc_feature (278275)..(278284): n is a, c, g, or t
  misc_feature (278614)..(278630): n is a, c, g, or t
  misc_feature (283365)..(283365): n is a, c, g, or t
  misc_feature (292154)..(292154): n is a, c, g, or t
  misc_feature (294898)..(295033): n is a, c, g, or t
  misc_feature (303145)..(303509): n is a, c, g, or t
  misc_feature (327149)..(327149): n is a, c, g, or t
  misc_feature (345182)..(345191): n is a, c, g, or t
  misc_feature (345689)..(345698): n is a, c, g, or t
  misc_feature (347234)..(347243): n is a, c, g, or t
  misc_feature (354646)..(354974): n is a, c, g, or t
  misc_feature (355279)..(355288): n is a, c, g, or t
  misc_feature (366049)..(366049): n is a, c, g, or t
  misc_feature (387264)..(396263): n is a, c, g, or t
  misc_feature (401298)..(401307): n is a, c, g, or t
  misc_feature (404653)..(404702): n is a, c, g, or t
  misc_feature (411793)..(411845): n is a, c, g, or t
  misc_feature (414129)..(414129): n is a, c, g, or t
  misc_feature (424879)..(425053): n is a, c, g, or t
  misc_feature (436381)..(436381): n is a, c, g, or t
  misc_feature (438890)..(439012): n is a, c, g, or t
  misc_feature (445443)..(445813): n is a, c, g, or t
  misc_feature (446434)..(446520): n is a, c, g, or t
  misc_feature (448528)..(448528): n is a, c, g, or t
  misc_feature (449746)..(449755): n is a, c, g, or t
  misc_feature (451579)..(451618): n is a, c, g, or t
  misc_feature (451827)..(453537): n is a, c, g, or t
  misc_feature (453971)..(454045): n is a, c, g, or t
  misc_feature (454682)..(454729): n is a, c, g, or t
  misc_feature (454995)..(455028): n is a, c, g, or t
  misc_feature (458579)..(458801): n is a, c, g, or t
  misc_feature (471895)..(471896): n is a, c, g, or t
  misc_feature (473644)..(473695): n is a, c, g, or t
  misc_feature (475540)..(475549): n is a, c, g, or t
  misc_feature (476056)..(476297): n is a, c, g, or t
  misc_feature (476716)..(481095): n is a, c, g, or t
  misc_feature (483544)..(483583): n is a, c, g, or t
  misc_feature (494682)..(497556): n is a, c, g, or t
  misc_feature (500976)..(501680): n is a, c, g, or t
  misc_feature (509293)..(509775): n is a, c, g, or t
  misc_feature (510125)..(510134): n is a, c, g, or t
  misc_feature (511429)..(511438): n is a, c, g, or t
  misc_feature (512071)..(512080): n is a, c, g, or t
  misc_feature (520829)..(520829): n is a, c, g, or t
  misc_feature (535872)..(535872): n is a, c, g, or t
  misc_feature (548634)..(548716): n is a, c, g, or t
  misc_feature (550234)..(550445): n is a, c, g, or t
  misc_feature (556363)..(556825): n is a, c, g, or t
  misc_feature (561399)..(561399): n is a, c, g, or t
  misc_feature (563228)..(563396): n is a, c, g, or t
  misc_feature (569719)..(569972): n is a, c, g, or t
  misc_feature (571088)..(571199): n is a, c, g, or t
  misc_feature (571558)..(571610): n is a, c, g, or t
  misc_feature (574171)..(574171): n is a, c, g, or t
  misc_feature (582944)..(582946): n is a, c, g, or t
  misc_feature (584002)..(584056): n is a, c, g, or t
  misc_feature (595096)..(595105): n is a, c, g, or t
  misc_feature (598699)..(598791): n is a, c, g, or t
  misc_feature (599080)..(599089): n is a, c, g, or t
  misc_feature (601036)..(601036): n is a, c, g, or t
  misc_feature (603263)..(603301): n is a, c, g, or t
  misc_feature (605068)..(605725): n is a, c, g, or t
  misc_feature (612683)..(612791): n is a, c, g, or t
  misc_feature (613113)..(613122): n is a, c, g, or t
  misc_feature (624207)..(624794): n is a, c, g, or t
  misc_feature (627447)..(636305): n is a, c, g, or t
  misc_feature (637524)..(637692): n is a, c, g, or t
  misc_feature (643932)..(644116): n is a, c, g, or t
  misc_feature (646255)..(646264): n is a, c, g, or t
  misc_feature (655076)..(655353): n is a, c, g, or t
  misc_feature (655764)..(655773): n is a, c, g, or t
  misc_feature (664924)..(665368): n is a, c, g, or t
  misc_feature (665811)..(665897): n is a, c, g, or t
  misc_feature (684898)..(684955): n is a, c, g, or t
  misc_feature (686088)..(686097): n is a, c, g, or t
  misc_feature (686785)..(686794): n is a, c, g, or t
  misc_feature (687013)..(687452): n is a, c, g, or t
  misc_feature (696202)..(696211): n is a, c, g, or t
  misc_feature (697137)..(697146): n is a, c, g, or t
  misc_feature (697505)..(697530): n is a, c, g, or t
  misc_feature (698828)..(699334): n is a, c, g, or t
  misc_feature (700134)..(700134): n is a, c, g, or t
  misc_feature (701663)..(701779): n is a, c, g, or t
  misc_feature (705994)..(706003): n is a, c, g, or t
  misc_feature (706275)..(706284): n is a, c, g, or t
  misc_feature (706554)..(706740): n is a, c, g, or t
  misc_feature (739616)..(739625): n is a, c, g, or t
  misc_feature (739984)..(739993): n is a, c, g, or t
  misc_feature (740772)..(740781): n is a, c, g, or t
  misc_feature (747267)..(747725): n is a, c, g, or t
  misc_feature (748024)..(748033): n is a, c, g, or t
  misc_feature (751823)..(751832): n is a, c, g, or t
  misc_feature (752158)..(752167): n is a, c, g, or t
  misc_feature (754755)..(755332): n is a, c, g, or t
  misc_feature (761790)..(761799): n is a, c, g, or t
  misc_feature (770075)..(773141): n is a, c, g, or t
  misc_feature (781173)..(781238): n is a, c, g, or t
  misc_feature (788556)..(788556): n is a, c, g, or t
  misc_feature (798961)..(799024): n is a, c, g, or t
  misc_feature (799264)..(799264): n is a, c, g, or t
  misc_feature (803059)..(803645): n is a, c, g, or t
  misc_feature (806342)..(806500): n is a, c, g, or t
  misc_feature (807057)..(807057): n is a, c, g, or t
  misc_feature (809594)..(810292): n is a, c, g, or t
  misc_feature (810583)..(810645): n is a, c, g, or t
  misc_feature (819075)..(819099): n is a, c, g, or t
  misc_feature (819525)..(819534): n is a, c, g, or t
  misc_feature (823746)..(823746): n is a, c, g, or t
  misc_feature (831993)..(831993): n is a, c, g, or t
  misc_feature (839444)..(840159): n is a, c, g, or t
  misc_feature (860764)..(860764): n is a, c, g, or t
  misc_feature (874264)..(874670): n is a, c, g, or t
  misc_feature (874982)..(874991): n is a, c, g, or t
  misc_feature (875486)..(875495): n is a, c, g, or t
  misc_feature (880231)..(880231): n is a, c, g, or t
  misc_feature (892030)..(892205): n is a, c, g, or t
  misc_feature (900420)..(900439): n is a, c, g, or t
  misc_feature (905126)..(905135): n is a, c, g, or t
  misc_feature (917837)..(917857): n is a, c, g, or t
  misc_feature (918415)..(918483): n is a, c, g, or t
  misc_feature (919195)..(919698): n is a, c, g, or t
  misc_feature (929819)..(931166): n is a, c, g, or t
  misc_feature (936309)..(936309): n is a, c, g, or t
  misc_feature (937617)..(937679): n is a, c, g, or t
  misc_feature (938166)..(938202): n is a, c, g, or t
  misc_feature (948999)..(948999): n is a, c, g, or t
  misc_feature (955232)..(955301): n is a, c, g, or t
  misc_feature (957017)..(957452): n is a, c, g, or t
  misc_feature (957755)..(957764): n is a, c, g, or t
  misc_feature (963372)..(964799): n is a, c, g, or t
  misc_feature (975972)..(975972): n is a, c, g, or t
  misc_feature (980684)..(980776): n is a, c, g, or t
  misc_feature (984316)..(984467): n is a, c, g, or t
  misc_feature (984667)..(985013): n is a, c, g, or t
  misc_feature (985138)..(985404): n is a, c, g, or t
  misc_feature (985808)..(985808): n is a, c, g, or t
  misc_feature (1017314)..(1017402): n is a, c, g, or t
  misc_feature (1021845)..(1021845): n is a, c, g, or t
  misc_feature (1037120)..(1037214): n is a, c, g, or t
  misc_feature (1041307)..(1042192): n is a, c, g, or t
  misc_feature (1043052)..(1043061): n is a, c, g, or t
  misc_feature (1061729)..(1062991): n is a, c, g, or t
  misc_feature (1064770)..(1065153): n is a, c, g, or t
  misc_feature (1065481)..(1065490): n is a, c, g, or t
  misc_feature (1068350)..(1068358): n is a, c, g, or t
  misc_feature (1070628)..(1070664): n is a, c, g, or t
  misc_feature (1073221)..(1073383): n is a, c, g, or t
  misc_feature (1073735)..(1073744): n is a, c, g, or t
  misc_feature (1082661)..(1082682): n is a, c, g, or t
  misc_feature (1083652)..(1083936): n is a, c, g, or t
  misc_feature (1084301)..(1084344): n is a, c, g, or t
  misc_feature (1084663)..(1084672): n is a, c, g, or t
  misc_feature (1087587)..(1087596): n is a, c, g, or t
  misc_feature (1088480)..(1088489): n is a, c, g, or t
  misc_feature (1100633)..(1100693): n is a, c, g, or t
  misc_feature (1103210)..(1103222): n is a, c, g, or t
  misc_feature (1103976)..(1104499): n is a, c, g, or t
  misc_feature (1108036)..(1108083): n is a, c, g, or t
  misc_feature (1108391)..(1108391): n is a, c, g, or t
  misc_feature (1121455)..(1121455): n is a, c, g, or t
  misc_feature (1131796)..(1131956): n is a, c, g, or t
  misc_feature (1139540)..(1139850): n is a, c, g, or t
  misc_feature (1141715)..(1141715): n is a, c, g, or t
  misc_feature (1153053)..(1153141): n is a, c, g, or t
  misc_feature (1158773)..(1158797): n is a, c, g, or t
  misc_feature (1159432)..(1159557): n is a, c, g, or t
  misc_feature (1162619)..(1162739): n is a, c, g, or t
  misc_feature (1163190)..(1163199): n is a, c, g, or t
  misc_feature (1166327)..(1166327): n is a, c, g, or t
  misc_feature (1171052)..(1171076): n is a, c, g, or t
  misc_feature (1171386)..(1171412): n is a, c, g, or t
  misc_feature (1188088)..(1188121): n is a, c, g, or t
  misc_feature (1188873)..(1188917): n is a, c, g, or t
  misc_feature (1190220)..(1194815): n is a, c, g, or t
  misc_feature (1195112)..(1195121): n is a, c, g, or t
  misc_feature (1210221)..(1210724): n is a, c, g, or t
  misc_feature (1221116)..(1221723): n is a, c, g, or t
  misc_feature (1246582)..(1246600): n is a, c, g, or t
  misc_feature (1247090)..(1247160): n is a, c, g, or t
  misc_feature (1252322)..(1252399): n is a, c, g, or t
  misc_feature (1255587)..(1255722): n is a, c, g, or t
  misc_feature (1256438)..(1256447): n is a, c, g, or t
  misc_feature (1264054)..(1264141): n is a, c, g, or t
  misc_feature (1264542)..(1264551): n is a, c, g, or t
  misc_feature (1265445)..(1265445): n is a, c, g, or t
  misc_feature (1270155)..(1270164): n is a, c, g, or t
  misc_feature (1270726)..(1270735): n is a, c, g, or t
  misc_feature (1276069)..(1276088): n is a, c, g, or t
  misc_feature (1285115)..(1285115): n is a, c, g, or t
  misc_feature (1292752)..(1292761): n is a, c, g, or t
  misc_feature (1293343)..(1293352): n is a, c, g, or t
  misc_feature (1296972)..(1296981): n is a, c, g, or t
  misc_feature (1297588)..(1297597): n is a, c, g, or t
  misc_feature (1301879)..(1301888): n is a, c, g, or t
  misc_feature (1302658)..(1302667): n is a, c, g, or t
  misc_feature (1315014)..(1315160): n is a, c, g, or t
  misc_feature (1318709)..(1318990): n is a, c, g, or t
  misc_feature (1319334)..(1319757): n is a, c, g, or t
  misc_feature (1321767)..(1321837): n is a, c, g, or t
  misc_feature (1324303)..(1324656): n is a, c, g, or t
  misc_feature (1327754)..(1327769): n is a, c, g, or t
  misc_feature (1348460)..(1348627): n is a, c, g, or t
  misc_feature (1353754)..(1354201): n is a, c, g, or t
  misc_feature (1354501)..(1354543): n is a, c, g, or t
  misc_feature (1361377)..(1370010): n is a, c, g, or t
  misc_feature (1373811)..(1374519): n is a, c, g, or t
  misc_feature (1404036)..(1404553): n is a, c, g, or t
  misc_feature (1408650)..(1408745): n is a, c, g, or t
  misc_feature (1413613)..(1413642): n is a, c, g, or t
  misc_feature (1418003)..(1418003): n is a, c, g, or t
  misc_feature (1422061)..(1422070): n is a, c, g, or t
  misc_feature (1435965)..(1435974): n is a, c, g, or t
  misc_feature (1436939)..(1436939): n is a, c, g, or t
  misc_feature (1442212)..(1442221): n is a, c, g, or t
  misc_feature (1466149)..(1466756): n is a, c, g, or t
  misc_feature (1488168)..(1488729): n is a, c, g, or t
  misc_feature (1489174)..(1489183): n is a, c, g, or t
  misc_feature (1494640)..(1494771): n is a, c, g, or t
  misc_feature (1495169)..(1495178): n is a, c, g, or t
  misc_feature (1496562)..(1497374): n is a, c, g, or t
  misc_feature (1501256)..(1501256): n is a, c, g, or t
  misc_feature (1519233)..(1519331): n is a, c, g, or t
  misc_feature (1530876)..(1531672): n is a, c, g, or t
  misc_feature (1539501)..(1539510): n is a, c, g, or t
  misc_feature (1550168)..(1550188): n is a, c, g, or t
  misc_feature (1559883)..(1559892): n is a, c, g, or t
  misc_feature (1560261)..(1560270): n is a, c, g, or t
  misc_feature (1560602)..(1560695): n is a, c, g, or t
  misc_feature (1568183)..(1568192): n is a, c, g, or t
  misc_feature (1575847)..(1575847): n is a, c, g, or t
  misc_feature (1580103)..(1580103): n is a, c, g, or t
  misc_feature (1581680)..(1581790): n is a, c, g, or t
  misc_feature (1582461)..(1582543): n is a, c, g, or t
  misc_feature (1598249)..(1598481): n is a, c, g, or t
  misc_feature (1615304)..(1615306): n is a, c, g, or t
  misc_feature (1620936)..(1620976): n is a, c, g, or t
  misc_feature (1622376)..(1622440): n is a, c, g, or t
  misc_feature (1623858)..(1626107): n is a, c, g, or t
  misc_feature (1639782)..(1639810): n is a, c, g, or t
  misc_feature (1657914)..(1657978): n is a, c, g, or t
  misc_feature (1658123)..(1658961): n is a, c, g, or t
  misc_feature (1662215)..(1662290): n is a, c, g, or t
  misc_feature (1662660)..(1662669): n is a, c, g, or t
  misc_feature (1666740)..(1666813): n is a, c, g, or t
  misc_feature (1671811)..(1672574): n is a, c, g, or t
  misc_feature (1673048)..(1673065): n is a, c, g, or t
  misc_feature (1674791)..(1674800): n is a, c, g, or t
  misc_feature (1675163)..(1675172): n is a, c, g, or t
  misc_feature (1678279)..(1678404): n is a, c, g, or t
  misc_feature (1678859)..(1678899): n is a, c, g, or t
  misc_feature (1684450)..(1685029): n is a, c, g, or t
  misc_feature (1690393)..(1691192): n is a, c, g, or t
  misc_feature (1698905)..(1698905): n is a, c, g, or t
  misc_feature (1713749)..(1713758): n is a, c, g, or t
  misc_feature (1714429)..(1714438): n is a, c, g, or t
  misc_feature (1721212)..(1721719): n is a, c, g, or t
  misc_feature (1722067)..(1722269): n is a, c, g, or t
  misc_feature (1733874)..(1733908): n is a, c, g, or t
  misc_feature (1743304)..(1743899): n is a, c, g, or t
  misc_feature (1744231)..(1744265): n is a, c, g, or t
  misc_feature (1748110)..(1748890): n is a, c, g, or t
  misc_feature (1759134)..(1759143): n is a, c, g, or t
  misc_feature (1762830)..(1762889): n is a, c, g, or t
  misc_feature (1771366)..(1771373): n is a, c, g, or t
  misc_feature (1775112)..(1775509): n is a, c, g, or t
  misc_feature (1782687)..(1783942): n is a, c, g, or t
  misc_feature (1792376)..(1792451): n is a, c, g, or t
  misc_feature (1802175)..(1802222): n is a, c, g, or t
  misc_feature (1803101)..(1803115): n is a, c, g, or t
  misc_feature (1804607)..(1804627): n is a, c, g, or t
  misc_feature (1807679)..(1807679): n is a, c, g, or t
  misc_feature (1815540)..(1816276): n is a, c, g, or t
  misc_feature (1816730)..(1816739): n is a, c, g, or t
  misc_feature (1831257)..(1831321): n is a, c, g, or t
  misc_feature (1840114)..(1840183): n is a, c, g, or t
  misc_feature (1841183)..(1841192): n is a, c, g, or t
  misc_feature (1853078)..(1853247): n is a, c, g, or t
  misc_feature (1866798)..(1866807): n is a, c, g, or t
  misc_feature (1867100)..(1867109): n is a, c, g, or t
  misc_feature (1867744)..(1867800): n is a, c, g, or t
  misc_feature (1868124)..(1868163): n is a, c, g, or t
  misc_feature (1872772)..(1872781): n is a, c, g, or t
  misc_feature (1876847)..(1877364): n is a, c, g, or t
  misc_feature (1880122)..(1880122): n is a, c, g, or t
  misc_feature (1885134)..(1888261): n is a, c, g, or t
  misc_feature (1908210)..(1908210): n is a, c, g, or t
  misc_feature (1917391)..(1917806): n is a, c, g, or t
  misc_feature (1938336)..(1943444): n is a, c, g, or t
  misc_feature (1943733)..(1943742): n is a, c, g, or t
  misc_feature (1965086)..(1965095): n is a, c, g, or t
  misc_feature (1965460)..(1965469): n is a, c, g, or t
  misc_feature (1972085)..(1972791): n is a, c, g, or t
  misc_feature (1973111)..(1973122): n is a, c, g, or t
  misc_feature (1974857)..(1974935): n is a, c, g, or t
  misc_feature (1975220)..(1976196): n is a, c, g, or t
  misc_feature (1977813)..(1977865): n is a, c, g, or t
  misc_feature (1978144)..(1978215): n is a, c, g, or t
  misc_feature (1988350)..(1988667): n is a, c, g, or t
  misc_feature (1992044)..(1992053): n is a, c, g, or t
  misc_feature (1992564)..(1992575): n is a, c, g, or t
  misc_feature (1993922)..(1993931): n is a, c, g, or t
  misc_feature (1998316)..(2001666): n is a, c, g, or t
  misc_feature (2007006)..(2007034): n is a, c, g, or t
  misc_feature (2022891)..(2022963): n is a, c, g, or t
  misc_feature (2023545)..(2023545): n is a, c, g, or t
  misc_feature (2030200)..(2030333): n is a, c, g, or t
  misc_feature (2033148)..(2033157): n is a, c, g, or t
  misc_feature (2033672)..(2034130): n is a, c, g, or t
  misc_feature (2040204)..(2040649): n is a, c, g, or t
  misc_feature (2040932)..(2040941): n is a, c, g, or t
  misc_feature (2043444)..(2043444): n is a, c, g, or t
  misc_feature (2044607)..(2044616): n is a, c, g, or t
  misc_feature (2044965)..(2044965): n is a, c, g, or t
  misc_feature (2045720)..(2046417): n is a, c, g, or t
  misc_feature (2048728)..(2048737): n is a, c, g, or t
  misc_feature (2054225)..(2054315): n is a, c, g, or t
  misc_feature (2055747)..(2056110): n is a, c, g, or t
  misc_feature (2060336)..(2062932): n is a, c, g, or t
  misc_feature (2064549)..(2068059): n is a, c, g, or t
  misc_feature (2071944)..(2074388): n is a, c, g, or t
  misc_feature (2077276)..(2077285): n is a, c, g, or t
  misc_feature (2077776)..(2077785): n is a, c, g, or t
  misc_feature (2079822)..(2079963): n is a, c, g, or t
  misc_feature (2099994)..(2100087): n is a, c, g, or t
  misc_feature (2101621)..(2101621): n is a, c, g, or t
  misc_feature (2111187)..(2111214): n is a, c, g, or t
  misc_feature (2128572)..(2129569): n is a, c, g, or t
  misc_feature (2129891)..(2129900): n is a, c, g, or t
  misc_feature (2136592)..(2136865): n is a, c, g, or t
  misc_feature (2137405)..(2137414): n is a, c, g, or t
  misc_feature (2142352)..(2142967): n is a, c, g, or t
  misc_feature (2152571)..(2152611): n is a, c, g, or t
  misc_feature (2162035)..(2162044): n is a, c, g, or t
  misc_feature (2162420)..(2162429): n is a, c, g, or t
  misc_feature (2168678)..(2168687): n is a, c, g, or t
  misc_feature (2168965)..(2168974): n is a, c, g, or t
  misc_feature (2170448)..(2170528): n is a, c, g, or t
  misc_feature (2172418)..(2172450): n is a, c, g, or t
  misc_feature (2175858)..(2176004): n is a, c, g, or t
  misc_feature (2176822)..(2178287): n is a, c, g, or t
  misc_feature (2183532)..(2183533): n is a, c, g, or t
  misc_feature (2192827)..(2192836): n is a, c, g, or t
  misc_feature (2193136)..(2193193): n is a, c, g, or t
  misc_feature (2226691)..(2226701): n is a, c, g, or t
  misc_feature (2228677)..(2228844): n is a, c, g, or t
  misc_feature (2230490)..(2230490): n is a, c, g, or t
  misc_feature (2236754)..(2236902): n is a, c, g, or t
  misc_feature (2237173)..(2237182): n is a, c, g, or t
  misc_feature (2242420)..(2242420): n is a, c, g, or t
  misc_feature (2244111)..(2245118): n is a, c, g, or t
  misc_feature (2258246)..(2258284): n is a, c, g, or t
  misc_feature (2262189)..(2262198): n is a, c, g, or t
  misc_feature (2262472)..(2262481): n is a, c, g, or t
  misc_feature (2266513)..(2266701): n is a, c, g, or t
  misc_feature (2272669)..(2272678): n is a, c, g, or t
  misc_feature (2298575)..(2298993): n is a, c, g, or t
  misc_feature (2299347)..(2299359): n is a, c, g, or t
  misc_feature (2307329)..(2307440): n is a, c, g, or t
  misc_feature (2307847)..(2307856): n is a, c, g, or t
  misc_feature (2308269)..(2308278): n is a, c, g, or t
  misc_feature (2323624)..(2324477): n is a, c, g, or t
  misc_feature (2335007)..(2335040): n is a, c, g, or t
  misc_feature (2350282)..(2350318): n is a, c, g, or t
  misc_feature (2369126)..(2369670): n is a, c, g, or t
  misc_feature (2381400)..(2381716): n is a, c, g, or t
  misc_feature (2392901)..(2392930): n is a, c, g, or t
  misc_feature (2402695)..(2402695): n is a, c, g, or t
  misc_feature (2411490)..(2411775): n is a, c, g, or t
  misc_feature (2431281)..(2435739): n is a, c, g, or t
  misc_feature (2445436)..(2449828): n is a, c, g, or t
  misc_feature (2452416)..(2455423): n is a, c, g, or t
  misc_feature (2461739)..(2461937): n is a, c, g, or t
  misc_feature (2466912)..(2466921): n is a, c, g, or t
  misc_feature (2473868)..(2473868): n is a, c, g, or t
  misc_feature (2476490)..(2476490): n is a, c, g, or t
  misc_feature (2486351)..(2489785): n is a, c, g, or t
  misc_feature (2490307)..(2490316): n is a, c, g, or t
  misc_feature (2494031)..(2494157): n is a, c, g, or t
  misc_feature (2496343)..(2497092): n is a, c, g, or t
  misc_feature (2504781)..(2504819): n is a, c, g, or t
  misc_feature (2513626)..(2513666): n is a, c, g, or t
  misc_feature (2514241)..(2514535): n is a, c, g, or t
  misc_feature (2515079)..(2515133): n is a, c, g, or t
agtttttcaatcagttgtacttcaatttctacctccggaagctcgcagcattatgcagcagcaacaacaactggtcgaagaacaacaccaacaacatgatcaaccacatgatgcacagcaacaaaacaatgatgaaccagcaaatgaccaacaaggagaggatgacaatgactatgttgattattgacttccaaacagtttatcagttatcaaatgtttaacattgcggtattatgttatttatatttggaacttattttcgtttgtttaaacatttgactttgaatgtatgaattcagttttttattttataatatgctttattttggtaatcatgttatttaatatcaataaataaataatctacggaaattactaactcaatgagcggtaggtaagttttcgacggaataggccgtcggaagtttccgacggaattggccgtcggaagtttccgacggaattggccgtcggaaatttccgacggaaatggccgtcggaaatttcccacggaattggccgtcggaaatttcccacggaattggccgtcggaaagtttccgacggaattggccgtcggaaatttcccacggaattggccgtcggaaattttccacggaataggccgtgggaaatttccgacggaattggccgtcggaaatttcccacggaataggccgtcggaaatttccgacagaataggccgtcggaaatttcccacggaaatggccgtcggaaatttccgacggaataggccgtcggcaaacgccgtcggaaatttccgacggccaaaaaatccgtcggaaatatttgcaacgaccgtttttccgacggatttttttccgtcggaaatccgtcggaaatctcgaatttccgacggatttttgatatttccgacggatttcggccgtcggaaatagcttttttttttgtagtgtttgcttccttaaaaggatttgtttccaccaaactagatccccgctggtcggtgcttaacatcttgaagcaatttgtggatgacagttcaaatctagtttatgcgaatgctggatttgttatcaaatttacttttttttttcttctttcatttcagataagcagctgtaaagacgttatttacgtataaatctgttaagaaatagaatttcatgcattatatataatttacttgaaggaatagggaccacgagaaatagaacaactaactaatatttagttaaaacatattaaaaaggctttcaatattattattttaaaaaataagcaatcttaagaatgattgtactaaaattgctttgagggaaattaattataaatactagttactaaccatcatttcccaaatgtaaataagagattaatttctttttcctttagatagttgacttagaaaagtcattaaattccatcggagaataactcacttgtactgttcaaaatttcataccaacatatgcacatgataacccccttgatatgtggggaatattgaagagggataaaagtaataaatattacttcgttagcttatgaaagacattaccaactcagctaagtaataaattcaaataggctattaaatattaatcattcattttaagtatataattaaaattggtagaaaaaaattatgaataaataaaatagaaaaaagacagtagttttttcctagtcgtttgagtaaaagtgaagcaataatttatgttgctaagttcgtaagaagaagtcagagggatgctaacaattgacaacaatcatatttatattctacttcatctttacctttttttcttttttctcgttttacacccaaaaacgtggttatcaattttcatcaattgattcggatttgtggaatggcacagtagagaagagatgctagttgaataggatccttcggtgtaatatgtggctgtggatctagctttttgtccactttggattatcagagtggtgataatgattttgcctcagacttgaggataagaatgaattaaatttgtgataaatctttacgacattcccttcacttcgaataggacgtattcacgatcggtggctttttattccgacggtacaaatttgtggttagataatcagaataattaatagttttattagtattcaatcagtataatttttatattatattattaatgtaatacattctcttattaacgtaaactcacaataattagattctttgtaaaagcataaaattgttataactagtaagatggttatttttgtaacattttttttataaattatattttaaaataatttttaattagttgataatataaaattttattccattaatgaataaaaattaactccaatgttggaaactatgtcgtaacagttatactctaacagaaattaatcgatagaatgctaataaatgttacatttttattgcaaagttttcaagttagtgcttcttaaattgttattaacacaaacttttcttctttattctcgtagcaatttaagttaatttcgtgttaattgatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaatttttgttaaaaataaatttttactatattttatttattttttaatcaaattcggattagacaaaatattttttctttattgaattagaggattaagataaaaaatatttaatatttgattatgtttttagcatgattaccttgtaaaataagatatgtgtggaaaataaaatattaaataattttaaggtagtgtatgccaaattcaccttatgtattaaataatttagttaattattttaggtgcagacgtaagatgtgcaaagtgtacatctccttagtgcttcagtacaaatttaatttggttttttattttaaatttagagcaaaatacatattatatctataaaataattatttatcatccagcgcatgaaacaattaattcataattaatataaatataaaaattacgaagtgtgaggataataacaagttcctggaaggccattagtccattatgccattacagagtccagataacagccttttacgacttctcgttatgatcgtatctattgttcggcccgtgttttcaaaacaaggacagaactcgcggaaagagcccacaagaatgactttgcatacatcaccttgatcactcgtttgatagtggatactattaatacactaatttttactattagagtactataattttgcatattattttaaaaatttattagtttaaggtatttttattatgaaattttgtcattaaatttttttgtcatgtgcgttgcacttctttaggtacaaagacacaacatataaataaaatttggcgaactaattttgcttttgcaataaaatgtcataggtaaacattataaaaatcttaatcattggattaatagccacgtgattgagaatttgagattgtttgctggatgtccaaatttttatcgtatatctaattttaaaccatttgattaaaagacataaactgttattatatgttgattgttgttagtaatcatttgtatctctatgtttaactattaaataaacttatatccaattaaataattatgtttgtgattgtgtgatcatgctcttagatattacttatgttggtactattatatcccgtagaatattattattgtgcctattaattaatctctaatgcatgttcatcaatcatcattcatttagatattacttgtgttggtattattatatccggtagaatattggtattattttacctattcatccttaatgtctatccatgatatatttagatgcatgtgctggccgggccattgcttgaccaaaaataatgtagatgtgtctcgcatcagctccaattccaattggttgtgatttgatttttctgaggaaaagaaatcgaataattgtagttttaaaaaaaatccatgtctaaccctcgaatttggtatttattttcattttaattcctgaatttaataaaaaatactaatcatctatgaatttatattccacttattacactgaatactcaataaaaaaaatgtcatttatcacattaattgaacccctaatatgtctttgttaaatttactaaaaaatacgtgacacaagtttcagagactaaaggcaacaacatgttaaaatgagcaccaacttgagatgttgatggtcacattgctcttaaagatatatccatgttacgcgtaaatcatccaagattttacaggatcttctagactacaaaattgggaaattagaattggcaagcaaaaaacttaaagaaacccagaaagagatgtagaaaatagactcattggtgtgggaaaaaagaagctggaagttaagagagccgttttaatggttaaaatttgtcagactatttctggtgtaacaaaattgacataatatgtaacgtgaattaaccttcaccaaaaaaaacttaactaacttaatcaaacattaattaatatatttaaacaagtaataaatacaattaaaatatgacattaatgtcttcaaaaatggaaattatcccaggtttaaaatgagtcagaaattctcgtatttctatacaagctttcaattcagaatatttattgtaatggttatttaattttaatttttgttatatatgataaattattatgaattttctagatgttggataaacttaatatattaattttaaaagaataatttaatatatatgataaactatcatcattgtcatcatgacttccattatgatcgttattataaccaccgtcatcatcatcaatatgactttcaccactgtggtgacgatagttaacgatcatggtggtggttgcggtggcaaccattatagttatggtgaaaacgatcatgacggtgatggtaattgtggtgacgatcatgacagtcatggtggaaattgttatgacggtggtggttgtcatggtgataatcgatttgagatattttaggatgtcatagattaaatctttaaatatttgattttctatttgataaatcttataaagaattaatgattaaatgaaattttaattagaatttaaaatattttaatcttaatcttttactttaatctaataattgagattaatcattctcattttactattcttatgtgatacgttttatatatgtgtgtgttttattataaatacaataccaacttagttttagttaattcctttataatttaagtttcagtttgtagttcctatcttgttaaaagagtaaccatgcaagtctataattctgcgttcattacgtgttgatacgttacaacttacaattagctgaaaattcacatgtatagctactgtgaatttataaagtaaggcatcagaaaaaaaaaaaaacaatagggcaattttctaatacatgatataaaatatattaagtaatgaatattacataattatatacagtataaacttttaaatgttcggccctttttctagtgggctccaaactagggcagcagccagcagggccgggcctaacctaagtaatatcttcactgatagtatatatagttcaaacatttaaagtgtccaacgttctattatgcgtagtatatttaagaagctactagtatataaactcaaatatccatttaggtaaactaccattaccatgtagaagtatagtagcttttacaaataaatgatcctgaacattaaatggagaggagaagaccacccacctttcccacttcacagaacgacaactgtgccagcattcattatagagagagacgtagtactacagtacttgagatcgatcataataaacactcaaacccaaggaagcaaaactaaactaaccaatgaagttgaagcagcagaaaatgagagtagtagtaggctcagtgtggctgtgcctctttctgttggctgtcggggagtcggagggagcggatttggcggcgaagtgcaacctgctggttcagaaagtgctgccgtgcctaaacttcgcgacggggcaggcggcggttccgaccaaggactgctgcgaggcgacgtcggagataaagaagagcgacccggagtgcctgtgcttcgcgatccaacagactcacaagggtagtccgcaggtgaaaaacatgggcatacaagagggtaggctgcttcagctgccttctgcttgtaacttgaagaatgccagcaccaccaactgtcctagtatgttcatcccaccataactcactactcctctttaactttaataattaccagctaatatatctttattaatccaaaaatgttaatcactaaccttagaatattggttaaaaaacttaaaaagaaaatgttttttatttttattcataattgtttttacagtcttataatttttacaataaatattttttaaattttttttaactaaccatatccttattaatgagtacttcattcacttgccaaatactagctcacactccaaatctaaattactgatcataaaaagaaccgagtcacttaataattagcacatgtccaactttattggagaatttattgtatgatccaagtaaccatgatttcatcaattaacctatttcaccagctgatattatgtatttgaattttgttatttttataaattgaaaaacttaattgcataccaattgaaatcgatagaaaccattatcacggtagttcagattacatatatagtaattgatctcctattctgaccttcaaacgaaaaaagacacttaaaagatgaagtttgagtttgacttaaaaacaaatattaaaaaatcctaaaaatattattaattactatttttacattaatgtgattgactaaccggaagaaatattataaataaatttagaaatcaattgtacattcaccaaaaagaaaatacacatgtctacttttctaaaaaatataaaatttaatttttccaaacattatgttgtaatttttttattgttaaaataaaagaacttatgattaagtttttatcttcaaataatgaaaatgggacacatttgatttgatggcagagcttctgggtctatctccaaactcccctgacgctgctatcttcagaaatgcttcgttgaaaaccaattcagcttcaacagtgggaacaacaccaccagtctcagacgacatccacaagggctctaatggaaacatgcttagacctgttctcgttgcagacctaatagctgttgtttgggccattctcctcgtcgtgattccaatcggttctgtcaacatttattcgtgatgggtgcgttcaattaatgactcatgcagtaacagataggcaccactttaaatgaaagtagccgtggtagttgttttgctagtgatggatggatggattttaattagtttgcaggttgcagcatatatagaattaattgatttgcgtctgcaacatgttgttatgttgtctagaatatttcgaccctcttcatgttgtctttattaattaataattatcttaatttgtatggacttcttttccacatgctagactatatatctgatagattattaaaaaagtagtggttcattattaagattttgtttggataaaagttactaagtacagagcttttctacttaaaaatataaaaaaatttcaatagaaaaactattaaaaatatttctaattttatatccaaatagacttcaaaagtatgttttaatttgttttagattgtacatttcgaactgccttatgttatgcttatcgtcggtcacttactcgttagtttttatatctatagtaaatttctattatgttgtctatctaatatctaatacttatctattttactatatgaatatatttactattatctatctatatctactcctccatgtaattattcccaccatccagctattaaagacagataggagtaactcctgcactatttaacgcgtactggataagctttgtcatttagtaactattgttttgtgggatcatgggatgaacttttggtgatagattttattttttctaacattaaaagtatattagaataatagactacagcatttgtaaaatattaattgctacgtggaatagacttttgatgttaggttttcttcttctaacatatggagtatattagaataatattttatttattaatatctcatacaaacatttacataaatttacaattatattttaattttttttataaaagtaattttatgaaaaataattattttaaatgcaattaatattttttctatgaaagtgtgtattatattaaaataatatattttaaggagatataaaaaattatttctatcaattaaaaattttcagttacaaaattataaaataactaaattaacaagttttattattccaccaataaagaagtttattaaagtattgatttcaaatcaaattaattataatgtcaaacaaactttatttataacatttataagtctcaaaaatattttaaataataaaaatttatactgtcatgaaaaattatttcagtataatcttgttaaaaataattattatgaaagtcaataactttcaatacattacaatattcaattaaatgataatgtaaagaatctttactctagcgcatttttttaagttattaaaaaattaaatattctgtataaaataaaaaacgtaaactccactttttaaaagtgatcaattatgtctctttacatagactaatcctaatagatacttcatattaaatagcataattatcccaaaaaaattatccaatcttatttcctaattcagctcccctcagcattatactaacacaccaataggatagataataataggggtgtcctcggtccgtatggatggattgttcataaaaaaagtcacccaaaccaaaattataattttgatttagttttcatttaaaataaaattcaaattaaaccaaaccaatattttacaatttggttcaatttgattttttactaaaatattatttcattaaaatttatatacgttattttcatcttttaaattaaactacattaaaaaattactgataaaaatttatgaaacttattaatatataaaatcttctataataaaaatctatcaaattttcatccattttaaatcaaacaaagatcatctaaaaaagaaaatgatatacataacaaatagtaatataaataataattaaattgttgcgatttgatttgatttaaaaaaatataaataacaatccaaatcaaattgattagcctgaggaaaaaactattcaatcaaattcaaaaagaatcaatttggttcaattttttatttttattttgaatcgatttgatatgaaccacccctaaataataggaaatactaataactataatttactaattaaaaaaagtaaataatttattctaccaccaaacagaccttagtgtaataatctgcaaatattaccgtacgagatattgagactaaactcattatgtgaacccatacacaagacccaatatattatcgcttttgaccttaataacaatatgccccacaatattggtgaacagtgactttatttgaacttgacgaaattaacaatgtgccctaatcaatgttaacattcaacaaaccaggattttatacaatatgaattaggcaagttgacattaaaatttaaaatccaatgaatggtaaacacgctagttaacaacttaacccaaataattaaattatgacgagcacataaataaatttttggctaaactagccagcttgttcccattacttttggtctacatgacttagtttagacggcatacacgaaaattgcattcaaaatcaagcgaagaataccaagctaaccagaaaatccacaaaacttgaagcacggaccacgaagaaaacaaaaggaaccaaaaagaaaaaaaagaaaaaagttacaataggaaactttcttcaacattcaagtagattcacgaaatggtttgcttgaaaacttagcgggggtgccttttatacagcaccatctgatggcagtgtgctctgaatatttgaaggcataaggatgttgaatccatctgcagcagtagaaacaatcattccaggaatctgcgcgtgccaatgtagttccttcaggtctttttgtccctgttttaattcaaggcaaaataaacgaatgaacacaattaatcagggagtcttattctaacattcagataaatagagcggaggagcatttggatatacctggtgaataaacaatagttggggaggcaaatcttcaggagcattaacttgttctttggttttagctttaaattcagcctcctcttcctcatccttttctaaagaaaggtcccatatactgtggagaaaggtacaaaacttgtcaaatctcaaatacataaataacaaataaaaaaggagcagtggtgctatgaagctcatgcgcatgtagattctggggaagggttagccaaaaaaaaaaaaatcccgacaaggctacaactagcgatgcaaagagttaattataaaataacagcagtcctttacgctcatgtgaatcctttttcactatttggatcagaagatgccataaagttcagtgtcatgtagtaatgtaaagatcgaccttttaccactaaatctctcttaacagtataaaagcaaaaaataattcagcagataatgctatcaaaaccctttacttacgtaagctgattatcagatgaagaaactgccaatgaagaggcttcatgaggactccactcaatggatgtgattgagtgcttgtgatattcgaaatgcgctaccacagaatctccttcctgcccacttgtcatatcagctttaataacaagtaaattaataagcaggaaaaaatagacaatgtgaagttactttctaaatcataataatgcaataatactataatagttcttcaccataatgcatctagaagttccttcatacatggatttataggcacttgatttgcacatgaatggtaaaagaaagatgtgataatgaaacaagggaaaagaaagtcatcagacagctttacaaattcaatgtaatatgcctactgggacaacaggaaaaaagaatgataaaaaaattgaagctggatatgacataatttgaaacaccattgacagaacatcacatgcacacagtaacctccctgttataaatgaagcatgtttactattgttttattctttacgaagtcaacttataccttgagcagtctgagatcacgaatagaaatagtcccatcatcactccctgaggccaacatacaactagccaacctgctcagtataatatagaacaaagtgatgaagagatctataatagcagttgatggaacaccatagaattaatgtattaatacctgttccatgacattacattcacatcagcattatgtgccttaaaagatgcagctggtgacttccccaaacgggtatcccatattgcaatgtttccatccacagaacaagaagcaaaaacgtcaggttctatagggctccactgcagggattaattgaacattaaaaatctaattagatttataaataaggataaactagtaaaattagagtgtaaggaacaaaatatactatactgaaactacaagaagagcaactactgctttgcatatgagtaaacatacttgcagatcttcaacactagcggtatgtccagcaaatggagcattatcaacattccacgttccagcagatgtaggctcccacagataaatgcaattattgcaatccccttcaaaaatgaagatcattgtcaagctttatatatctgtgataactaagtatggagacatgccaggggaagacatagctaagaataaaaaactatgtaccccaatacctagaggctcctcgctatgcgaaggtaagggggaggaatattatacgcagccttacccttgcatatacaaagaagctgttttcggattcgaactcattacaacaggtcaccaaggcacaactttaccgctatgccaaggctcgccctcagggggaagacatagctaaactgaaaaaaatataactaaagattaccagatgcaagccttccagtaacaagaggactccagtctatagcataaccttcatctttgtgtttaaatttatacaatgggtcctgattaaaaattgcagcaactccttggacaccttctgtttcagtctcagctagagcatttaggtgagagttgaggtcccagacctacaaattgattctcaagtatcagactgtatagtgtatactaaatagaaggcatggcttaaaacagtatttaactttgattgaaatagaagatggagaaaaatacactccacattgtttaaccttaactgctgctaattatttaagaatttaaagaaatttaaatgttacaatgcttagaaccaggtaaccacatctgtatctaagagtaaactatacctgagctacaatttatcatatctaatcctaatagttactcatttgaagtttatctgaagtattgtcgcccaaactgttacagagccaaagaaagaggcctgcagtcctaattaatttattcaacaaacactaaacaaacttaaccttatttgaaaaaaaaataataataatttatgaagtcaagccaaagttttacgaatccatttgtttcaaatttaaagtctgcaatgtgtaagagtcctggcacagctgtagagttgtgccttggtgacttgttggtcatgagttcgaattcagaaacaggctctttctatatgcaagggtaaggctgcgtacaatattcctcccccttaccttcgcatagcgaggagcctctagacaatgaggtacatagttttttttagtaatgtgtaagagcataataataaccaatacagtaaaagcttgccaccacaatcatgtatttaaatattttccaccccattttatggacactttgatcttacagattctgtcatccgctaacctccagtcacatacagtaaaaaataaatagatttttgtctttttttgttatataaaatcataatctcccaatcctagtaaaaataaatagatttttgtcttttttgtcaaattagaaaactaaatcaaatggttgaaaagtctgacctgtacatgaccagtatcggcccaagctgcacatatatggggattttgtggcatagagcgtatacggttgacacatccttggtgagcaaccttccgcaactgtagatgcaaaaagaatcaaaatgttagtaacatcaaatttgaagcagtcaagaaatgaaacaataaaaacttaaatgaagaggaagttgcctgcaaactgggaccctgagcaccaccttcttcttcatcctcactatcatcgtcactgtcactatcctcaccatccatttcagtgtcatcagttccaagtttaggcaccggctcacgtctctttccagtaatatttgatactttaaaaattccaatagaattccaagaaggtttctctgcctgtggcacatgcacatgcattgccataacatgactttgttgatcaaaagaagtagaatggagaaaaacaaaggaagcaaagcaagtggacaacataactatgagctgctgggtgttaacttttcttgagataattaccagttataataaataaaaaaaggaaagaaatttatattcaagactcaaaatccctttaaagggaactttctctagtgaatatttgtctacaaagcctaatattcgttaccatttttctcatgaaaccactaaccacctccgatttgattaatgaaacatcctcaaacaaatatatatatatatatatatatatatatatatatatatatatatgaaacaacactgacctgagtccctgccacgaaatatactgtgtggggaaattcttttcgaaccaagcccaaagagtcacgtaaaatatcaaagctgtcaaaagccccaaaatgtatttataataacttgaagattactgatactaagcagaaataaagcaagttcccaataaaggtggctaagattctccactgaattgcaatgccaatgccaaaggaacttcacataacaacatatgatcctatcattattaataataacaataccagctaaaacaaacaggtttgtttatcaaaaaagctcaaagttttgctctctttcctctttctgtggagccaaatagaaaaacagaaaacaaatgaaaagaacaaaaaaggccatgaatgaaaatacctcaaacatggccatccaatgtgaaaggcatgaagagaattgtaagcagaaggatcacactgaagctcttcaccttcctccaacttatccacacccggttgccacaccttcgctgggatttctggcgccaaagatgaagaagacccaccctctttcttcgagccctgaatttttttttgcccacaaatttaaacaaaattttatataaaaaaaatgagaggtgccaacaaaagaccataatgaagtgaggttattataatagaaaacattgaaaagggtacgagattgaaccttcttcttgctcttggctttctgacggtgttttatgccgcgagtcatcttcgagttgggaaaactgagggaagccgaataagtcaatggattataaaggaatcgcataacaacttcttaggtcaaatttttaaaaaccagcatgacgagtccaaatcatatttcataaggtgtaatgttggtctacaaaaaaaataaggattaaaactatttttttatgggatactaaggagagcatactagtaatatgggggactagaaatagcaactccctcgataatttcccccttatatcatcaagagcaacaatgcaaccctaacagcttctgtactatccagaaatatctccaactaacaaaatttagggaatacattttgtttctcaccccgaaaaaatatatagcctcttgttttctttacttcaataaacagatcaatatattttttgtttgcaaatacggataaactattgtttttggtcaaaacacaatccgatttaggccgaaccatgatcaactcataattcgtaggtctttcttttctacacatctttttataatatttccaaaatacccttccccctttccctctcactagcaccccttcccttctcacaggaaacacctccttacctctccctttccattttctctctctctcaatatttcctctttcatctccttttctttccttcacaacccttctatgtcaccagcacaattgtcttttttttccttcacaaatcttacaattttttttgtaatatataaagaagaactatattacaaaatatagtctctatgatgtaattattgttaatatattataaaaactagtttctgtaataaaatcattttgtatatgttatgaaactaatttttgtaatatagttatttttatctagaatgagcttcttgagatgtagaagtttgaggggttttttgaataaccaaggaagctaattcttctatcctttgtttaaactcatccgaagttatttttatataaaattaactacattagaaaaattagtttccttaacacatgtatcacaaattttctatgatacatcccaaaaattcatttaaaaaaatatatttctagtgcaaaaaggggcaaacatgtgaagagtaaaagagaaaaggttacaaatagaatcccatagtttgtttatgccaatgacacacggctagagcaatgtagaaaaatttgggcttagcccataaatcagatcaaaataaagaacaggctaggaagctagcccataaggagcagctttacttgtatttatcacacctcacacacaaccactggttggtgtagtgctatgctatgccaacacaaattttataatttgaccttacttttctcagtccaactccaacacgcaaccaaagcagaagaaacccacaccctctctctatgaatatccccaacttcccgcacacactctccacaactaactaacctccttcaaaacacaaacctcgaaccctaagcactagcatgggttcgtgcagcgcgaaaccctaaccgctttcaaaaactggttctgaaaccgttttgagcaggagtattttaaaaaacggttcaacctggaattctttcataaccggttctgaaccgtactggttttgaaccgagtaaccattggcgcaaaagacatacctgctgtagctattagtcgcagagacgcacgctgtctgggtggagccaccaccgaatggggttttaggggttaatgttggtcgatgtcgtggtacggcttaactagtgtttcaaataaggttttttttaactattattgtaatgtttatttttaaaagattaaggtgtaaatattttttagttcttataattgacaaaagaacctaaataatacattttaaataaaaaattatcaatttagggccatttttaaactatttaccaatctgggacagtgggtcgcgtctaaaattgggcatgactggtcccgccttaatttgggcgtgaccaaggggggtcacgctcagcgtgactaaattcgtcactaaatcggttagcgatcgatttagtgacaaatttttttgtttttctatttttttgtttgcgaccaaaattttgtcgcaaaaactgttagtgaccaaattaacgacggaatatttggttttttattttttatttaatattatttatttttatttttatttaatatgaaagtatttttagattgatcttcatgatagatatgatctgttttacttttaataatattttttatttaatatatttttataattttatatgattttatgtaatatattctggatatatataactaatgtttagtataatattttttatttaataaaatttttcaattttctttcggaatttgcaaaaattaaaaatttttattttttgatacttcctcattttttataaatttttttaaacatttttttaatatagaaagtattttaaatggaatattatatgttgatatttctcattttttatattgagactacctccattaaacacattattatcatccctctcatcatctctttcatcctctcataatttgataattctctttttgttccagtcaaaagcacctagtcaactaactcgttattgaaactacaccgaaactcaggctttctatcaatcggtgactcaattgtgtaaaattagtgtagtcaaaacatatacattcaaccgagaaagggaattagaaaggatcgtccatcttgcatggtgaatgatcaattgtgcgagtaagttggtcaccatctttatctctctgggtaagcgcaatgcaattctttacatttcaatttgattaactttgtctcacgcagttccactcctatttttagagttctgcaatatttcaccgctgtgcacattggaattaatggggtgttacaattccgattattgtgtggtgagtgcactttgggatgagtggaacaagtggtaaaacgtgaaatgagtgcgaaaaagttagaaatgaatgtactctgggataaaaaatccaaaatatattaaacaaaaccatataaaaatttagaatatcgaaaaaagttacaacttttgatagaaatgtccgatcgaggtgtacaatatgtcgaaatgctcgaaattaatagaagtaactagaaaaataaaaaatattagccaattaactgacaaaataattaaaaaattagaaaacaataatttttttgggatttcgaagatttaatcgcaactttgaggcacttaaaggtctcttttgggaaaaatttgcgaccacaagcaataagactaatgtcctcactgatcacaaaactaatttaaaaagttgaacaaaattatgctgtaaaattgacgatgcatataactttgaacaatcataatttttcgtagcaatgtccgatggatacatatttcatgtcaaaatgctcgaaattaagagacgtaattggacaattaaaaaatagcatgcaattaactaattaaatgaataaaaaattagaaaacaagaaattttttgaaggttcaaatattaaatcgtaattttgaggcacttagaggcctcttttgagaaaaaattttggccaagacttgcccaggccttctcctctcaatttcaagcgcgtggccaccggtttcgtctcaatcggacattctagtcaaaagttatgaccgtccgaagtttatatacgcatcgattcacctgtgcatgacacgtggcagaagtaggtcacgcctagaactgggcatgaccagttgccccatattgataaatagtttcaaaactgtcccatttttgtaattttttatttttttttgtatttttttggtttttttgcccttataatttaatatttttaacttttttttaaataattttatttctgtaaattatatttttttatcttaaaatactttaaataatgaaatgttatttaaagttttataagaataaaatataaaacaaacaaaattgaaaataaaaaaaataaaaataatttacaaggataaaatttaaaaataattaaaaatgtatttaaacttaaaattaataataaataaatattttaatatataattaaaatttatgataagatatatttttaaatatataaattatttattcattcataattctattagaaatttttaattcaatttaaaggtacaggtgattaagataaaaaaaataaaatatttaaaaaaaataaaatctttaaaaaataatatagttaacatgaaaaaataaactttgaaaattaaatttaaattgaaactaattaacatgaaaataatcttatcttttgaaaaatataatgtaagcatatgtgtatttttgttgtttgtatgttatgggttattttatgttggacattatattttgtaatcatctttaaaaaaaattaaatcctcttaatatccttcatcacatcacaaaaaaaaattattttattttcttttcaatctttatcgttttctttaaagaagattctcttaattttctactcttatcatttcattatccatccttgtggaaaattcattgttcaaaaatctaattgattttgtttgggaagagatttcatgcatatgcgttaaaggattggtgggacagaagaaaatcttttttcttgattttttttataacaaatgttaattattaatttttgttaataaaaactattcaaattcatgaccttttcattttctttctctcttcaaccaccaagtcaaccttataattctcattcttcccttgaactcaaatatcttcctctccttctgtatccttaggaaaatccaacgttgaaacctaacaaggtaatgaaagctttggcttttttgtatttgattactttagtttgatatgaaatttgcttgagaaggaaccataattgtgttaaaggattggtggaatagaacaaaactcctcccttagacttaaatgtcttctttccttttcctctccttaggaaaaatccagatagaagctttagtttttttgtagtatttgactactttggtttgatatgattttttcttgagatgaatgtattgatgtcataactgtattttttaggaaataacttaataagttgatattatatttacaaatgaaaataatccatgattgatattggtcattgaatttttaatcttcgctcatgagattaaggataatttataaacactatttttgcttaatcccattaagacgccttctaataagaacaaaatcacgaccgaactattgagcaccaaaataaataataactcaaatatattaactcctaataacatcaacgaacttgaggtcgcgacactagcgttgaaccgaaagtttaagccacttttgccctcagtatcaattgggggaacatctttcaatatttcaaaagttttatattacttagaagtcgagattaaatgttgtataactattacatataaagctcccctataattatatttttccgcataaacagtctctcattacatctattaccacaattttgacattaactttcccttttccttggccgataattgggatttatattttatagtatccatgattgaatccaagtggagaagatgttttataagagaaaaatatcctcttcatttattggaggagtccattaggaggaagacatacacacaggctttgtggaatccatcaatatgatatagagaagaactagatcattttataacactttttatttttttactattcataattattattccaattttaagtccgttgatatcatttgagttatcggaggagtccattagaaaagagacatacacataagctttgtggaatccatcaatatgatctagagaagaactagatcattttataacactttttttctatccaatccatcatagtacattttaataaagacagaattgtaacaacatcatcaaacaccaaaatatataatatttgataactcagatgatatcaacggacttaaaattagaataatacttacgaatagtaaaaaataatgaaaaataaagagaattaggtttctattgaaacttttggaaaacttcgtaaataaataaaaaatattaaaaaaactacttgatattaacgtgtcaacctaccttgtgcgtcctacctctaccctaacatgtcacaatccacatgtcaatgatgtcatgctaggcgaatttcaagtaaatacatgtaactcagttcattaaaaatgatgggctgagcaaaaaattcaattcatttttgttacatttttttaattctacagtaaaattagtgtcaaatataagcaaacaacaaaggtgttcatcatatttttcacaacataaaacacaggtttattacccccatttaaaattctctaaccgtaagtccatcttctccttctatagaggttttttaaccaagaaatcaaaaagatcacactaatagtaggattttggtatcatctgaaaatcaattatttttccaaaattaaagtgggatgaatagttattaaagaaacgagtgaaagctgggaaaccataattacaacaactccttgccacaatgtcactcattgcatgccacttatgagaaatgagtggaaaatggcatcgattagctttggagggccttttccgtaaacctaacaaaatcatcattcgcattcagactaatcatcccgtgtgcgtgcaagaaaggagccactggggatgcaccacgctttgtaccacaaaaactctcaaggacacataacataacacattgcattatcatatctcacacttctcactcctccccttttggcttttgcaatgtcaatgtaaaattaatggctgttggtaagcagtaattaatgcgaatatttttttatggtctagggacgttttaatgaagaggttaaaaaataatttatttgatatttcaagaaagtaaaaattctttacaccatcaactaattataaaatatcaccttttttaaaaaaagtttaaatttcattctaattattttaaaagtcacatgataaaagaagaaaatttatattgataacaattaaactctaaaaaatagtgtgtacttgatcctcgaccttatctgcctgtgcataaaaaaaatagtgtgcattttttaagaatgtcaagtgttaaaataaataaataaaaatctcagattaaataacatagataaattaaacaatacataagagatttgtacttatactttatacttataaatgaaaaaaagtcctttcaaaagaataaatggtgaaaggaaaaaaatctttttaactttttaacaatatgcaatttgtaaccaaaatgtagttaaagtgtcgcaaggaaaataaattgttagtccaattgttattatatttaatatttttaagcagatttgagctgtaaattaaaaaaaaagtaattagaaggagaagatttcattaaaatgaacaattattcagattttttataaacttgataaatatttcatatcaatgctaaaaagaaaaaaagtggcgcacgggtgggtgagtaaaagtccgtcctgtgtggtaggcaacgtggaaaatgaagagcgggtaaacaaggagagagagagagagagaggtttttacacaaaggagaattgagttgggttgggggcatggaagaagaagaagggcttgccatgctcatcactcaccttcaccatttctctcactctctttctcctccttttacccttcaccctccagtctctcatcaaatccccaggtcccctcctttctcctagatttacttccaatgcattttttttcctaaaaaaatgtttttaattctccacctgttttgtttggactcaggatgctgtttttctctctacactttactttttgttttcttttatgtttttgtgaacctcatttgttcataaaccataacaaggttgatcctatttttgttaaccagttggttggttggttggttagttagtttgtttctgctctgaaatgtgcaatcattaacaacatgcttcctgaaaacataacctagatgttagattttctgttggttgtcttgttttgtgtgtgtgtgttgttacatgattcattatctgtaattagagcataaattgtgaaacttacgaagatgacttggcccttggtttcccatgtgcttgattttgttctttttgtcatagagaaagttaactggtacaatttgatgatttttgcacattgttgcttgtgttctgaacttgggaagtctcattgttctcagggtagtttgagtaggtttacatcaaattttggcataaaaaaataaaagaggtggatttgattcagacacagattaaaaaaatatgatgatttagaaacatgttgagaaacacgcaagtaagaacaatacaaccattttctattgaggttagaggcaatttctttgctttaacaacacaggcaagttatcatcactaggtccactctcaaagctgtcagggtgtgcatgcctgtatcttaatcacggtgtaaaatgttgataatacttgatcgtaagctttctgaagaatgcttgttaagaagggatggatcaccttggtccttttgtataaaatacggtttcttttgcacgacaagagataggaacagtgctttaatgggcttaacatcaaattgtcaaatttggctagaagcaatccttgcaaagattacagtctgacatggccatttattatttcctcatttactggctactaaaaatcccttacttctaagggtatgattgggagttgggttttggagggaaaggtaaggaaagcaaaattttcatttcttaaaaaacattcacttatttgatagtttttgaaaataaatgaaataaaatgacaaattaacattaatttaacgtcctgatctttgatttatttttatacattttatataactctcttaattttttttttaaaaaaattgcccatccttccttttccctccaaaacctcactcccaaacacaccctaaattgttggttttactatctcatcttatatattcatatttgaacatttatgctttaagtgtctgttctaactgtgtgactaccattattggataaacaacatatggtctggattttgtgcattttgtctttgtcctagtgttatacaaaggaaaagctttcttatcaacttagcaccttggattactgatgtattcaatttgatgatataactgtatatcctcttgatccttgaaatatgcagtagggtcagtcttattttggaataaaatatcaatttgtgcattaatgttatggtctgattttgagcttttttccaatgaattgtgctggtctttttatgcatctttgttctactacagtactactaaattaaatgaagtatatgaatatatttgaacatccttttcgcagattgactttctttgacattgatgattactccgtagatgacttctgtggccttgtaatggcagctggaaagtctggaagttccaggatgatggaacctctaaagcatccatctaagaagtctcgaagagataggagccgtggaaaatcatctggaaggtcctccagggatgaagctatggaacaacaaatttggaaaaatttgcctgaggatctatttgagcctgtgattgcacgacttcccattgccacatttttccgcttccgctctgtatgccagcaatggaattccttgctgacttctcaaagtttttctctgcattgtgctcaagtcccacaagcaaacccatggttttacactataactcatgaacatgcaaattctggagccatgtatgacccttctatgaagaagtggtaccatcccactatatcaacactgcccgcagagttgatagttttaccagtggcttctgcagggggtctagtttgttttcttgacatttatcatcaaaatttctatgtttgtaacccattgactcaatccttaaaggagttaccagctcaatcagttagggttgggtctcgtgctgcgataggaatgacagtaaatgggaactcaactggtgctggctacaagatcctattggtgggttgtgatggagattatgaaatttatgactcagtaacaaagtcttggagccatccagaaaacatggattcagatattaagctgccactgtcactcaattttaggtcacacgctgtttctattgacagcaccctgtacttcttgcattcagatcccaaagggattgttttgtatgatatggaaactggggtttggacacagtacataatcccagcgccattgcatctgactgaccacatgctggccgagtgtgatggccggctattgcttgtggggctgctcacaaagaatgcagccacatgtatatgcatatgggagctgcagaagatgactttcttgtggaaggaggttgacagaatgccaaacgtctggtgcttggacttttacgggaagcacgttagaatgacttgcttgggaaacaaaggcttgctcatgttatccttgagatcaagacaaatgaatcgattggttacttacaacatagcaagtagggaatgggtgaaggttccttggtgtctggtgccacatggaagaaaacggcaatggatagcacatggtactgcattttatccatgcctcactgcaatggcctgatgtagcttgtataatacagcaatgacctgagaatatttccctcaaaacatgaggttctttgcaatttgctggtaattgatgctgatgtaggaataataatgttcattgctggttaacaaagcagatggaaaatgatatgggtttgtagtacttcatgtatttttcatgctctgaaacatgcaccttgatcacttgctttcaagacttttccctgtatatgaaagttgtgaaggtttaattccagctagtatcattcatgttttcaagctggaaggtccaaactggggttggctctaccaactagaattgaagccttgtgaatcaggggagaggcatataaagaacctaaaacgttctcaacctggccttgcagtctggtgtcacttggctgcctcatgctgaatccttgttgctcttgcagtcctgcattacatatatatataacatcatgtttctaaagatatttgtgacttcaaaaggtgtgttcttccacatttgagctgttgagactgctgtctgctaagtgcaaactgtggcttttctcaggttgcttacagcgtcacacgggaaagaagctgggatttcaattttgatggctcctcccaactactcaatgtagtacccttcaagtgaaggtcattattattttacggcttatgattgttgtttctattttgagacagtgaagaaccaaccactatacagtattttgcgtttgaccgcagaatagagatttcgatacagtaactttgtttcgcttgtcaaaacataaaagatgaagaagagtgatttctttcaacgtttcaggttgccaacttgttctggctcgaaaatacaaaagctatcttttgagggtataataaagaaaaatgatacatataaataaaaaaatatttcttataaaaaaaaaacaaaccttatatggagcaaagttaaacatttattttgagtttataagtggtttatgatgaaaaaaaaagaaaaactcaatctttaacttagcattaggggatgcaacatttcataaagtttataatgctttaagtggtttacatttttttttaattcaaattgagttgatgacaagtattctgtttgtattataaagtaaataatctttagtgctttgggataactgcgtcagactgtatggaaactcccgtttcaaagtctgcaggacaacggatagctctcaaaggaatcatggagtttttcatttcacattatcttttgaaagttgaaaccctttcaaattgacttctctaaggtgaattaaatttatattatttattttactctaaatgttgaaccacattataattcatcactcaatcggagaactcctgtcatgagtcatgacactggggattaataaaacagtctttgtggttcaaaacctctttagtcctcgcttctcaccatgggcagctttggctttttgcatgcattataatattcaccccaacgtaagtaattggtagaattaaagacaagacaaacaaaagttatatttttaattaaaaatccttaaaagttcatcaaaacatgaacaggaaccgggtcttgtacaagtacagtacatgtggagaagtattagcattttctacgaggaggctaagaaagagatgatgacacaatccaaaataaagctccatttaagccatgcctccactcgttgctgtcctgattatctggaagagagctgtccatgaaaagagaacacataagtcaatggaactagaaagcaccggctatgaaaatgcaaatggtggaagaaaggtaaatacaatctaacacactccttagcacatatatcacctttagctcaagcgacaccaattccttccagggattgcttaacctggatcgaattccactaaagcatacccttccctaccagctctactaaaatcctttagacacccgcatacacataaataaacaagcaaaagtatttttgttatgaatgcaagaccccaccattttgattcaacgagtattgcaatccaaattattttcatattttttttggcagaggccatcagaaaatatttcctcttcaattccgggtttcaaccataaattagctattcacgtgctttggctataaaggcgtatggatgttgttgttaaccaccaacactttatggaatacaagacatatcacataagaagcaatgtaacgattgcttgcttgcttattttcttctgaaatgatatagttgataagttgcaaacatttattggcatccgacttttcgagtatgcttaaatatatacagtcaacaacaaatgtttaaacccacgacaggaatagagacaaacatcacggtcatttagtttgagaaaacgattatgtttttatattatgttttccttttcagttacaaaaaaatctgaccgtgttttgtatttacaaaagtttgtttatcaaacacttaaacacaaaaaacaataaaaaaaagttaattttactggttcttctacaaagttttaaaaatagaaaataaaccaaaaacaatgtggcgtttttgtaattaaaacaacaacatcaaagccttatctgactacactagatgagattcgttacatgaatcacatgaagtcacatgttttttataattgaaaatgaaaacaaaatagtagaaaacattttgccaccaaaagaaacgaataagatgatgtagaaatgtttctcttacatgatccaatgacaacaaagacgaagaaaccgagcagcactgggccaacagggtagtcttttccctttttagtggttgtgtctggcacaaatcctcttttggtgatgttcttctcaaacttctccaccttcctgtccgcaaggcgccttgatgtcgtctacacaaaaccacaatttccacatttcaatttcaattagcattgcaaaaatcaaacaaacaaaaccaatcaacaagagttgcatagcataacacagggacggcacaattggatttggatggcaccagatccgatccataagctaacgaaacatttcacaatcagaactaataaccataaaattcagaagttaattcgacgtataaataactataacaacaaaacccctacgtcaacaacattattatcaggaatcaattaataatttgagtatttgacctaattttcacaacatcctgattctaattgcagaaatccaaagagatttaagcaatagagtgaattccaattctaaaccaaatcaaattctaatgtcattctcgaaaatttcaaacacgacaaatcagatatcacggataagaaaaataaaaaataaaaaccaaagtcggcaacacaaaaacaagacggagaaagagaaactgtagataaaaaacgagagtgtgaaagtcaacgaagcagtggcgttagagaatgaatgagtgaattaccatttctgttaaggaatagggatcgccggaaaacggtgatggaagaaaccagagatcgccggaaaatgaaagacggtatttatcttcttccggcaatgccctcttcaaccttatttgtgaatgcgtgatccgagtgaaacacggtttctcgttgtttctcccttttactattagtatttattttatatttaacaaacctatttttgttcaactacaattaatttagtggatccccgataatagcgtcacggcttcttaccgattggccaatgccatgtcactgggacacgcggcgtaaggttattcgaacagctttaatacactgcgtgaacaagtcttcgagatggctccaattaggcgtgttaggttaatcattttttttacgaaattataataattgattcacctaaaatgaacagaagaagtttacgtacgtaatttaccttagaacggtgttttgttactatcagaaagggaaatgataagcatcagcaaaccattgttgtataacttgatttaaaaaaattgtggaacattttcacatcatttaggtatgttcaggattacgttaacttgatagtacatttgataatttaaattaaactcaaatgataaatgtttattttgtataataaatatttttaatatataaattattatattataataaattaatagcttgaaatttaaatacataaattatattttagatttataatgaataatttaaattatactataattttttaaattatttacattttaaaaaatatatatcaaattttaatttaaaaataagaaagattgaatgatatagacaattaggatattcttaaccatgtactattttcaatatattttctttcaattatataaaaatgaacaatgatcctgtataatatacaaagtaaaatactaatttataatatagaagtaaatacacaatttaatttacgtaagctatataatatttttacacaaataactaagaaaacttgattatttatttgttttactatttcagttaacaaaaaacacatgttacccatttaatcatcacttatctaaaatattaatttattattttttaaaagtaatattaagccttttttcgttttacatcttttaaactggaaaacaaaaaaattcttctacgaacaacccaaacataaagatgccttttatcaactcgacctttatcctctccattcaccgatttctttgtttaactagtaaaaaatctgctatgatcataaatgcctaatgttcaaattgatctatgtcagtcaccaaattgagtggcaacctatctcacatgattatcaatctttctattcttcatcaattgtaaaatactttgtactatgatcccttgatgagaacaaagtaaaattaaaacattaattcatccatgcatcaaatatgaaatattacatggcctcaaaatgaacatcaagatatatacaattttctcactcttttattcatttatattttttttatatcaaatctctcctttatcaaaaatcagaaaccttacccaatgaccatagaatttagtgggtaacatatgttcaatctatgggaaaagatctgaatttgatatgagagcatacatttttggaaatggataatgagttttaagtgtgattaagtcctattgatgagtcccataattggttcaacggattaaaacttgttggaataccttaaaatatcattggaaaacctaatgtcttaattatggtgacactaaaaccaaaaaaaaaaaaaaaacttatatgaaatattttggtgaacaaggccgcaaagtcgcgttgaataaggatttcctaggctagaataaatgccacgaaaccaattcaggccacagtagtgcttactagagggatatctcaagcccatatttttttaagacatttggtggagttttgggcttactagactgtactcaattttataagcctgcttgttattaacttaaaaaaagtacgacatcatgttggaaaaaaatatacacactcatttataatataagaatattttgttttgtcatctaataataaattatactagtaataaacttgttgtttttaaaataattattttaaaaattatattaaaaaatctaattaatttatgatataaaataattatactagtaatttaataagaaatgtattaatattatgttggttcaaatagaatttgattcaaattttttaaataagattttatttttttagattataggtattttctatggaagataattatgtttaagttggataagactattaagaatgacaaaatttgttcttcgagtttttaagacaattgcatatttaagatttgaattcaactttaggttaaattggaacaatctcaagctagttgatgtatgtgtttgatgattttcaaataagattttaagtttgaatgttttaaatgaaataaatgtaattatgagaataattttaccaaaaatatcaggcaaaaatctctaataaaaaataatcattaagaaaataattcatcacacctaagtggtggtaaaaagaaaaaaaaaattcaagaaggaaagttggagctcttcaaatatcccggcaggtcggctgttgttctgttaatggaagcaggtcattgtctaaaaacaagcaaaaaaacaaaaaacttgttcgatttatttaactaccccgcatcggaccccaaaaaataaaactatataccacttggtaattgtttatgctttctacttttgacactcacaacaagttttaattctgacttgtcaattaccactatagtctttcattcacattaagcacatgtttgatttggtttagattaaaacatgttatttttcttcttctttaaactctctccaaaaagtgtaaaaaataagtaattactttttcaaaacaaactaaaccaaataagtaccaataataaaactatattgcatatacagtataccactcatgcttcttcttagtttaccccttagttttatggaatatttgattatttactatcttttactagaggcattaggcaacaatgattgcaacgaagaatcttctctggcttgcagaaacattttgctttccattttacctaaaagaaaaggcttcgtaaacatttcttcaataaaaatacattacaaataagataatttgaagatttaggactttatgtaaaaaaaaaattaaaaaaaaaccgaccatacaagtttatataattttatttatacagaatgtgaataatatttttattttgagatatgtgaataatattttattgttgatgctttaaactttttgtgatatatcatatggttttcaaaaaacttggtggcacctttctgagataaagcacgttgaagtggtttcttacttaatttgatctcaccttgcctcttccaaattagcaccctgcatgtccctactcatcatcttgcgggtcttggaagcataaacatcaacacgtcctttttaaaaatgtttaaaaccaacattcaactaatccagtcccactaatgtgaacacgtcatactattttttaaacactgttccaaacaataatttgtaccattagtatgatatggttaataagttaattacaatattaaaagttatcatcgcacaagacatatgtgacgaaaataaagatggagggagaaacaaaataactttaattttatacctaggttgcttgtcatgctaatattaattgttttaaccctctttgtcctcatgggattgacatgtagtttgtttggtttagtggccgccgtactccatccttatatattagttgaataaatggattagttcaatccacattgatgtacatttaaataaattagaataggatagttttttgtaaggttcatgtctaacttacctagctcgtgggttaatagactgttctgtaagttgaaagattaaaaaattcgagaccaatattttttttctattcaattatttaatgtgtttaatttcctttgctcaaggcctcaagcaagataggtgcttgaagttgtttgcttcagttgaccaagatgggtgccttgtgtacgcacctgataaagttaatagaaaaggaaaactggtgacgatagaaagtggttattggttggagatgcttatgttttgaacttttgataagtgggatattgttgtgggtagaggtgattggacaagttttgctatttgatgcaaaaatagtggtgtctatttttcctcaaaagtgcccaaaccatgcatggttagcttacatttatgataagttaatcttataattaaaatgataaaaaaaattatttactacaagtattctacagaaaaaacaaaaatacatgaaatgttaaacattattaacttactgtaatactgtatagtataatttagagtcgccagtttcttcagaatttgtttaattccaatcgctattaatagcattgaggcattgccaaattgccttccacttctcgtggcgcacaaacaaggattacgcatattgttcagggccggatccagaaaaaaaaaaaaataagggaggtaataatggtggggattaggaggcggcgcttccaaaatttttttttgaagaaaattaaagaaacaaattattataacaaaagtgtgaaaaatgtataatttaaaagataaaaaattaacaaaattagaatgtgattggtgctcaaaagtaaaagtgtagtcactgcattcataaaagttacaaacatacatatccacactcactcttttcttatttttcatcctttcttatttttcatctttttttattattttttttctatgtttttcatttttttctcttatacaaagtttaaattatttttttattttactttattttattattataaaaaaaattctattcttgagaatttaaagggggacattgcctccaatttaacacctgcgtccgcccatgattcaggtgaccctacattatttgatattgattatgcatgttttagttattattcttcgttagtaattaatttaatcatgttttattacattaatgatattttattaccattttctttactgtcattgtacgatataattccaactggatcataattcgtcatggtaggttgcgtgtcttcttatgaattttctgattatttttctttgaattttttagagtatttatctcatttcataagtgacagattaatttcttaaacataaacagatattaaaatgatgatatttttcacaagttgagctcaagatcgcgtgttcaagaatccaagtcacttccatcagatgtatctataggtcctattttgataataacaagatttattttgataataacaagatttaattaaagatgtttgttaatttatgtttatttatcacggggtatttttaatccctttacctgtcccattgcacttgacatgtacaccggtacacgtatgtatatttaattattaattaatatacacaaaagaagatcctgttggggaaatgggaatgcccatgtttaaaaacaacgtcacgttgcacattcaatgaatgtgtgtttaatatcatgttacaaaaattgattataaattcaaaattgatttatgatatactttttacatgtttaattttatgttaaaaaaatccaaaaaaagttataagttgaagtaacttaatttaaatagtttcgattagatccaaaaatttgtattaaattttactctaactaaattttataataacaaaaatatttaaacataaatcacgtcattttaaaatcaattttaaaattagtttcattcaaaatcaattttaacactcatccaaacacacattaaacaatttatgtcatgttacttgagggcagtaccacgaatgaactagtagagattattttcatttttttctttttttacagatttttttaattgtaaaaaattatacaatcaattaataaaaaaatattatataacttttaagacaaataatattgaaattaaaaaattcgatatacataatactcctacgaatatgaagtataacaatttgtaattaaatgacttttgcattcattattttttcttgagataaagaaaaattataattcaatcattattcataattataacaagtttttttgccttcattatctgctcatacgaatgaggtataacaattttatcggggactgtacttttattttaatccatctatatgtatatgatcatgtacaattcacttggtcaaagtactcgttttatagtttccgtaccagctatttcttacaaaatattatatctgaggcaagaaaataatttatataaatttatgaactatttaaacaataacaattctggtccaaattccgcctttcattattttattcaattatgtgtttatctaacgtaaaaagcatttttgagtactatgagaagtggaaatacaggtgtaaaacgggttaactcaactaaaaaagggttgggattgggctgaacccgttgtttttttagagtgaaagttttaacgtaattcatctgtgacggattgtgggttgagttcactcgccaatttattttttcaaataaaataaattatttaattattttatttatcttaaaaaacttacaaatttcataatcaaatgtaattttaaaaaagataaatgttataaaattagtaaatcaaataaatatttaagagattatcataaaaaaatgtaagtgttaaatgtaatttcactttaacaaataaaaaaaagatgatggattgaaaatttcaatccaatcctttagacgagttatgtagttgatgtatcgagttaaatctgttttgacatccataaatagaaagatgtgattattgtttactatatataaacatgttttaacattttaaatgcatttataaactttgacagtgcattagatatttgttagttttttttatcattatgatattagtgtaaattatctttcaattttgttgatgattaatatttatcaaaaaatttgattaattatctttattgaggtatttcctttaaagtctcaatcaagttttttttttcagctacaaaatttgaagacctaattgtttaaagaattcaagtttattatcactttgactgatgacatgttaatagatatttgttagtttctactatctcttttacacctattatattttcttagacgctataaaataagctgaggtgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagacgctataaaatacgctgaggttgaatcattgatatatttgttgaggagaaattgatctaattcaaagttgttgatgtttataatgataaatcatataaaaaagagattaagttacaagaataatattttcattactaaatatatcatacaacctaattttactcactagtctatataataatgtcaagttgaatataatcaacatattgcggaatgtgtaaacatttcctcacttgtaaaatacatacacaaattttgtttaagagnnnnnnnnnntttatacaatagtatatttattcagtatctcactttttaagagaaattcaaaatatataatagaagttattttttttaattgtttagcttatttatgtcgattgattgatttttgtacgcggaattggtatagtatttaacatataaaattagttttgaagttgaacctttgtctacatcatgctgagaaagctctgatgatgtgttgtttttaatatttatttcaataagcatttaataagtcatcaaaccacgcaaaacatgagaactcgagctgctctttactaaatgatacaataaacaagctaggtactaaaattgtttatatataaattaaatagaagaactaactatttatatgcatctataattaattaaatagaataatttaattcatcgattaaactgaccaaactataataacgaatattatttaatatttgaatactactactatttactttatttttaaattcattgattggatattgcaaaaagtaacttccaagagatacttgcgagccatgaatcatctggttattaaccacccccttcttcacacgatattttaaacaatattggagtacttatatgaatattggagtacttatatgaatgatttcttcacacgatattttaacaatattggagtacttatatgaatgatttaatctttaacacaagcctgacagacaatactaagcggaaattttattttatgattattatgatgagtatggttaatcgatggcttcaagaaaccagttaaaaaattaaaaattaaaaattaagaacaaataaaaaacaataaacaatataattttacacattttaatattttttaatttcttaataaatgttctaataaatatttcttatatgacaacattcatttggaatagggcaagaaagttgtgattggtacaaaatacagattttgtgagtttacactggatatcctcttagaaagaacttttaatttcagaggacacaaaaaaagaagtgagtagtgatgacctaatcattttatggccactctctttctctttgattaagtgtcttctattcttgtctttctctttccatctaaattaccactttgcattctttgatgctccccaaatacttataaaattatgtttttgttcaatttcttaaatagttactatgaagaccacttttattttatatatcgaataacattatcgtagttggagattccctgccttatttcattcaattattacataaatcaggtttttagttttaatttttacaataaacaaacctttttttaattttttttttttggatctgaatacacgttaaagccatatttgggggcctaataaatacccttacatatggaatgctcaaaaagttaaaactaggacactacaatattaggaaaggggagaaaaaaagaaaagagagagaacaagttctaatgggtaaagtgacaaatgacctaaattctctcacaatgttcccattcttgtgttggatcaattaaatattggcagaggagagtggtaaacagtgatgttcttatagtatagtgtctgaattcagcgtaaagttagatatgtggctaggtgcaactaaactaaaactataaactaaacagtagacagattcgagggggaaagaagaagaagagaaataacacctcgagaggttctaatcatgcgtggtgcctctatctatctatatacctacgtcttttgactctgggtcctccctcccatggcaattttgataaagtactacggggtatcaaatgccattgtgagcaaaagaagcttacgccttcttcttgaaattttggttccatgcaggggcacttttgccaacacaaaagtacagctaaacaaacacacgcacgcagagttaacgacttagcgtgaagaagttgtctactggcatggacggatagggatgtgaacacaaagcaaacaaaagttataaaaggctgtgatttctgctcagtgggactatgccttttctgccctctattttgttattattgttattacacttgtgttcaaaatatacaataataaatttattttttataataagcttgttaaaatatattaatgtttattgctatattcttttgacaagtattgttttttgagtggatagtttggaaagagataatggcctataataatatattttaaaaacatttgtgctatgctaccgtattattcttatcatctttgctttgccaaattctcctactacctgagctcgatgaacaacaactcattgctttaaagctcttgtcagcttcattctccatgtttaagtgaccttttctttacagtgtgcagctaacttctaagaaataaaaataaaaatctctcgaacacactcacgtgcttgtgttgttcttgtttggttctagggccatgaagtgcgagctagtagagcttctttgcagagtgatagtgaaaatcgaatcttttgtaggtttagttttggcccttcctttttgttctgcgccttggttggtagctgctgctagctgacaagataataaggagtatcaatttctgtttagaattagaaacccagaatcttgtgattcttttattctttaaagggtatttgaatttttcttatctgcctctagtttcagtgttcattttgcatttctgaattttaagctattggggtggataagacagcatcttatcaaggtcacatctcttattattatttttaataaagatgtcttttttatttttccttccccttcaacctacttgtttttaggaattgggtttgtgttggtggtggtgttgttcatcaaaatcttgaattttcttcaaccacaagcctaaaaaacaaatcttttagtgaataggtgtgtgttagccttgtggggattctgtggatttgacagcggttctctcctctcctctctctctctgcctctgtctctgtctctgtctctctctctctctctctcacacacacacacaagcctacctggaatcagctagagttgacacccacaacctgtttgaactgtttctttttaacttgtgttggttactgttgtggatgagtttgctccatgtagttgggtttggtctaaaagtggggcatctacttttggtgctatgttgctgggttgtgtctgtcgtttaccttaactggtttattagcagtggaattatggaaaccaagatgatgggtggtggtggtggtgctggcaagatgtggcacaaaaaatggtgggagaagatatcagggcagggttgcaaaatccaccaacagtactaccagtatattggctctaagaaagttaagagagcgttatggaggaagattttgctgacatgggtcgtgggttggttcatagtatctttgtggatcttctgctacatgagcttgcaaggtactgagaagaggaaagaaactcttgcaagcatgtgtgatgaaagggctaggatgctgcaggatcagtttaatgtcagtatgaaccatatccaagccatgtccattctgatctccacctttcaccatgctaagagcccctcagccatcgatcaggtactagtctttactttgttattgcaaatcaggacctaattcctcaccttttgcttttagtctttgtttatgttaccttaatttctgtacacataggtttctgagttgtttcattgtcattaattttagtgtctaatagcattattcccccccctctcgtggaaaatttattcggattttagtattatatgttttgctaacaaggttactgaacttgagcatgacctgatttccttgtttccccaccttcttgttggatagaaaagatcctactttcttctatccttcaatctttagtctcatctctacaaattaatctaacttccaaaacttgcagaaaacttttgcaaagtacacagaaagaacagcttttgagaggcctcttacaggtggtgttgcgtatgcggtaagggtgctccattctgaaagggaacaatttgaaaagcagcaaggttggactatcaagaggatggatactctagagcagaacccagttcataaggacgactatgccccagaggcattggagccatcccccgttcaggaagaatatgctcctgtcatctttgcacaagatacaattgcacatgtgatttctgttaatgtgctttctggaaaggtaggtttctgatacttgcaaaattttatttgtggagctagtctgagccatatattattaattatgaaaattgtgaaaatgctatacaataaactttgatgtcttgatcataattttaattcatccattctaagctctttattcctggtagtatggttttgactggtcttttagtggtcattaatttgttttgggagaatatttatgaagaaaaaactatctatgctaccattttgttgtttttgtacccttgtgcttcctttctcttgcttgtcctgatgggactgctcctgatggagaatagtacacgtgaatagactctaattttgtgaatatcacaaacctgaattgagacacgttgttcttgtttgatatctgaaatctatggcaatttatttggaattatgattgtcacagttattcacttgttcatcaacaggaagaccgtgaaaatgtgctgcgtgcaagagaatctggcaaaggggttttaacggcacccttcaggctgctcaaaacaaataggctaggggttatcctgacatttgctgtctacaagagagatcttccatcaaatgcaaccccaaatgaaaggattcaagcaaccgacgggtgtgcctaaatttttgattttttttgcatctgtcattcattaatttttttggtaattttttatgattttttatcattcatataatttagcttattcccttttggtcatctaaagctttgaagtaactagtctactaaataattaattgatgcattcaaatttttggagagaatattatgaactctattaatgtagaaggatgaacaattattggttcttccctgtgataattagaagttttggaagttacaaatctacttttaaattcaataaaactgatggtaaaaagaaaaagaaattatgaacacagttaaagagagtagcaaattttatgtcttcactactgcttgctgggcaggtatctagggggagtctttgatgttgagtcattagtggagaaattacttcagcaacttgctagcaagcaaagtgtaattgttaatgtgtatgatactacaaatcatactcatccaattgccatgtatggctcaaatgaatcaggggatgttttctttcacatcagcactcttaactttggagacccttttaggaagcatgagatgcactgcaggtaagagtaatgctacagaagaaatctaatatctccgtcctccttaatgctcagtgtagtttgtaagaataacagtgtgccaccttgaaataggtggaggatatgacttaatacttcatgatttagtggttttgctgctagcaatacctagtctagagttgttttatctggagttgtcatacttttttagggccattgaatctaactatttttattttaatatatattacaattaaaatgtacaaattgtcaaaagacttgaagtattcatgaaaattaagcttgatggtaatgcaggttcaagaagaagccaccatggccatgggtagcaataactacttcaattggtatccttgttattgcactccttgttggacatattttccatgccactgtgaatcgaattgccgaagtagaagatgattatcgtaaggagatggaacttaaaaaacaagctgaggcggctgatgttgcaaaatcccaggtatgtaacttttattttattttatttattttttgaacttgtttttgcttaactcatactgatcatgtgggctttatccattgtaaccacagtttcttgctactgtttcccatgaaatcagaacaccaatgaatggtgttttaggtgagttgtcttctgtctatggtttagtcgattatccaatttttaatttttaactatatacattccacaaaaaagaagagcttcttcagccatgaccctgctctaaattggattttcagggatgttgcatatgcttatggacacagatctagatgttacccaacaggaatatgtcaggacagcacaggaaagtggaaaagctctggtgtcacttataaatgaggttttggatcaggctaagattgaatttggtaagctagagcttgaggctgtgctctttgacatacgggcaattttggatgatgtattgtcgctattttctgagaagtctcaaggaaaaggagtagaggtaatatatctctcgtctactgtgcctttttatcatgatggaattttcaaaatgtgcatagtctaactatagttaatggcttttcataatatttttttgggaactgcagttggcagtttatgtgtcagatcaggttcctgaactactaataggtgatccaggaagatttcgacaaataattactaatctcatgggtaactccattaaggtaagtttatggtagagagaagaacattatgtataattcaagttatttagtctgatatccttcatataagttacttagagaagttcccttgtcctacatccttgccttataggcatgctacggtcatcatagtctcatgaaaaaaatattctatttactatcctgacacatcggtaaagttgtgccttgatgacttgttggttatgggttcgaatccggaaacagtctctttgtatatgcaagggtaagactgctacaatatcccccccctcctccccttaccttcgcatagcgaggagcctctgggtaatggggtacgtagtttttagttttttactgttctagccaagcatgactactaatagagcaaaattgatgtgtatttcttgaaaatattattaaaactgattctgtaattgtttggcagttcacggacaaaggacatatttttgtcacaatccatcttgttgaggaggttgtccattcaatagaggttgacaaagaatccaactcagaaaataccttgagtggctcccctgttgctgatagtcgccggagctgggaaggattcaaggctttcagtcaagagggacctcttggttccttttcaaccccctccaatgatcttgtcaatttgattgtatctgttgaagatacaggtgaaggtattcctcttgaatctcagccactcatctacaccccattcatgcaggtaggtccatccatctcccgaaagcatggaggaacaggcattggcctaagcattagcaagtgtttggtgggcctcatgaatggggaaattggatttgtgagcatacccaagactggatccacattcacttttactgctgtattcaccaatggacactgcagttcaaatgagtgcaaaattcagcaaatcaacaaccaacctcagtctgcatcttcagaattcgaggggatgactgcattaattattgacccaagatctgttagagcaaaagtgtctagatatcacatccaacggcttggcattcatgttgagatggtttcagatttaaatcaaggtttgtcaatcataagcaatgggaatatagttattaatatggttttgattgagcaggaggtttgggatagagatttagtcttgtcatctcactttgtcaataactcaaggagaatggaccagggggttcctccaaagctgttcattcttgttaattctagtagttcttttaaagctagtgtaaacttgggtgttcataatcctactgtcatcaccaaacctctgagagcgagtatgcttgctgcctcactacaacgagccatgggtgtccaaaacaagggagctcctcatagagagcttcaaagtttgtctcttcgccatcttcttcgtggcaggaaaattctaattgtagacgacaatagtgtgaaccgtgcagtagcagctggtgcattgaaaaagtatggagcagatgtggtttgtgttagctgtggaaaagatgccatctcttccttgaagccaccccatcagtttgatgcctgtttcatggatattcaaatgccagaaatggatgggtatgtatgcacctggagtactttctttcagaatctgataatttatcattttggagtaatatttggaatttctacaaacatagaaaacagtttttaattcttttattgatctaacagaataattgaaaatattttactgaacagtttacatcaaaggaaaactttttgcactgcaaagatttgtgaaacaaactttgtattcttagtcttccatgaactcaataccaactctacttatccttatctgggtatgccttcggcttcctcagggtatattaagcacacaaggtgtttggagtctaacttgctacagcaatactataaatataattcatttgacaattctacaacaacaatggctttgtctcattgaggttgaatacatggatcaaatgatgccattgagctttgataaaaactaaattctaagggatgttatttaccataaaatctctttcaataatttcctttaatgtccttttggtctcctatccttttcacaaggctaaaaaccatgcaatgtactctcgtcattgtgcctttaatgaccttttttacatgtgtccaagccatcttagtcgattttttgtcatgttcttgataggtgttataccaatatctcctagtatacaatcattctgtatcttgtactttcttgtgtagtcacacatccatcttcacatactcatttttgctactcccacttttttctcttgatgttctttcaacactcaacattcactaccataaaatatgacttggtgagtactttttagttgtaaataacctccaatgttttctccattttaattgcctggcttgtatcttgtgtttggcattttcattaatttcccataattttataatattaattctagatatttaaacttaaaaacttgtgggatgacattccaatttttacttccaagtcaatttttttcttatttcttgctaaaatggcaatgcatatattgttttactcccactgaatctaatgtttgtctccaaaactaaactttatagttaactttttcccttgattccttgatttaagttatatcatttgcaaaaagtatgcatttagtgataaacactttggctattttcgggtaatgacctagcgttggcacacaatccgtcgttaatgatccacgtttgggctttgaacaagttttatgttgattgcaagggactaatacaaacctcttcctttgtccagcctttggaaccagctatgagcccataagtggagtcaattcatttgaaaattctaattaaaaaaattatttgaagaatttgtttatctactttttatttctaaatcatgaattaacatgtgttacgattttgcaaataacaattcttttccaacagatttgaagctacaaaacgagttagggagttggaagatagtgtgaacagagaagtatctatggatgactttgagaatattacaaactggcatgtacccattttagccatgactgcagatgtgatacatgctacacacgaggaatgcctaaagtggggcatggatggatatgtttcaaaaccctttgaagctgaacagctgtatagagaagtctcacggtttttccagtcatcttgaaaataaaatacagtgctgatctaaaccagataaactgatcatggaagcatagctgtttgtactccaggacactctgaagtgggtaaataggttcagaagtctcctgagagtaagttccctatttaacagccaatgcatgttttagtatttcaccacctcaaagtttgggggttgttcactagagactgaagaatgttatctatctcatctgaaaggaaaaagaaaatggaacaaagggggacaatattgtagaagttcagaaatggttcattctacctttttgacctattttgttgtcttttatgctgtgtttgaaggtccccggtttaaaacattgtttttgtggcagggagtgtacataggagccaagtttgattggttgcaattgagttgtaattggttgttaaggataccaaaacccatattaattcttcttccatgtaaagtcagcctctcttctcatccgaaatgattgaggctgattagaagactagggtgtattataatacaggttctggagtttcatccttgtgtatgtaataatacaacttatagtgatctagcctagggacgctacattttatgtgtattgatgcatgtatcacaagggcgaattcaggtgaaaggaagaaaattagcttcttggcatcaaaggggaggaaggaagctagtccaccatcaatctttgtatatgactcacaataaagatggtgattgatgtatcacaccaagcttgcttcctttggttcttaacagtgctggaattcggtttggaaacatgtaactgatatattatactctagggtttgagtgatccaccatttttttggccgatttgtacatttccaatttctggatttcctttgactcattgctcttgccttgcacatctcatgaaattattcctttttattttttattatctcaacagtattttttcaaaaaaaccgaagttgccaaattttgatgtcaggagttacctaggttgattttaacgtgcactaacaaggtatcactgggtataacaggttaagtaatgtttttaacattttatttgtccgtcacattttgatagacaggactttatgctctacaaaattgttgtatggttcttcgtctaaattagtaacagacccgtcttgttcttcaattcatgaaggaggatctgaattctagtctcaaatatactaatataaaattattcctgatacatgcttttgcctaaaataaacttattcctgatacatgcttttgcctagtatatcaacttttggatatgactaaaaaataaaataaaaatagaaaaattaagaaaaaagattctaaagaaaatcaaatcaaattaaaataaagtttacttgagtcagatcaattgatcaagttataggacatgaaccgtgggtgcagagttttaacttgtcaccccgaattttctcacttttatagtaagacataatataaccctctacttacacaaaagagacaaaaagtatcaactgttatatttgttttttaagcttcatttggagtttttttttaacaggccataggaaagttaaaaaaatcaaagggaacataaaataaatcattgctaaaataataaaaacaaaaattaaaagtctgaaaatgattcaataaaattgaaaaaactaaaaacgttgaactgtataactctttaaagtacaaatgagaattgactagaaaaacactaggctaaaataaaacgaagtgtcaacgtacgttggaagttgcaacatctacacaatggatgcaacattctcaatacaggttcttttaaaacagcatgcaatgccatgctgccaatgcatagatatggctctttcatgagttcgaaaatcgataaactaatactaattggaaaatacaagtccgtcacatctcctggaagtaacttgagtacgtttcactgcaacagaactgatatttacattgactttttcccccaaatcaatgtgagttccagacacttgattctacaataattaacatagatgcatgcatcaagtcagatgcttttcctcctcgtagcaggagactgtgacaacgtaaaacacatagtaaaagttgcatcctttgtataaatatcattaattggtcattgtataccgtgtattctaactaagaaacaggtttctatgtttaagaaattccactaaatcaatcatatttaattcaactttgtatttattcatttcctaatgaattaaaatgtgtttgatttgatagtagaatatcatgatgagatcaatataaaagtaactatttattactttaaaaaattatagtgagtttaactcatcattttaccaaacatacactaacctgatggttcgtttagatagtgaacgtgaccttccttaccctgatggccttatcaacattggtaatggttaccagacctacaacattcattcacaatttgagcaatttgcttgtttaaaaggtgatgccaagccatagcaggtgtagcaataattggataataattataagggcacttgattgttgggtgtacaagacttacacatttcagatatcatatgtggggctcactagttccgtcaatttcacaataaatttttccaccggtttagtaaatacttattggtgtggatatgcatgtttattacctggagcaacatgtgacgtcaacattgtacacagggcacaatgaatcaatgatgaagggaactttgttccaacacactacaacagaaatgaaaaggaaatgcatcagcgttaacgatatattaattcttgaatatgctgaaattcaaaactagaaatacaaaatcatgtcgttgaagcttcacggccgttatttaggcagacaaataacatcccatacacttatctttcaatagggaatcttagttttacacattattaggttcttatccatcacaagggattttaacacacacatatatagtactattaaaagcatatttgtgttactgtgtatccgtttcaaacgaatgtaaatagcaaaaggacagaagaatttaacttgtctgagaagtagaaataaatgtaactaaccctcaacccatctgaaactaaaatctctataatttgaacttattacactatattctgtctatttgtattaaggttagattcaatttggttattacaaatgtgattttcaatgcaaatctaacggatatgattattaatttgttgtgtgttttcatacaattacaatagaatcttttgtttagaggaaatgcagttagcatatgtacacaaatagtctctttaaatagggttttcacttttcttttccacaattcatcaactaaaaaattgtatttcatcttgaattagaaaaatctattttttaatctcaacctcacttttttttttaatttcactaataatatttttttaaaaattttgaaccttttagactattttcgatcttaaagctacactaaatctctaatcaattgaataggaaataaatatttaaagttaaatatagaaaaagtaattgaagtacttaactataataatttaaatatcaacagaaaaaattcaaatgaaaatcattaagcaataaaattcacatattgatcataataaagggataaaaatataattaatttgttaatatttatatgatttgcaaagaaattttttgtaatcaaaaaatgtatgactaaaattcacatctgagtcgatatgtccgagtggttaaggagacagacttgaaatctgttgggcttcgcccgcgcaggttcgaaccctgctgtcgacgaacatttttatattttgattatttttactttgtgatttaatttaggcaaaatttagtaaatataacttaagatgcagaaaaaaatgattgatttacattattgactaaatattttatttgtaaataaaatttgtgtgagatctaataaatcactatttaatattaataatgttgaaaatattaatttataagatgatatattatcatttaattaataaaggaaattcaaaataaagattttaatatatcgaactcaaaacaaagaaaaactttattaaaaatctagaataaaattcggtcatttattaagattaatttcataatcagattaaaagaatcaaaatttgcgaatataacttggtgtttaagggggaacaaagacctaattacgatagtatttatattttggaaatttgactgttggtacctaaaagatacgcgagggtgtagaagtgtagtatatagagagggtgtgtgtgtgtgcgcggagatagagagagattgggagagggagagaagagagaatagagaatagagatggatccagacgcgttggcaaaggcattcgtggagcactactacagcaccttcgacaccaaccggaacggtttagcgaatctgtatcaggagggttccatgctgaccttcgaagggcagaagatccagggcgcttccagcatcgtcgctaagctcacttccctccctttccagcagtgccaccactccatctccaccgtcgactgccagccctccggcgtcaacgccggcatgcttgtctttgtcagcggcaacctccagctcgccggcgaacagcacactctcaagttcagccaggtactctccctctctctgttagggttttattcgcactccgatccgtgataattactcgattcacgtttcgatctgcctaatcctgtgtttcgctgtgacggcggtctttgacgttgacgcgcatgctggtttcaacgcgattgacatttctgtgcttattgcttttgaatttggatgctgattttgctcgtgtgtttgattgattaacgtgtcgatttgttcctctggaaaacctaaatttttaagtgttatggggttttcgattgttattaatgctattgacgttggaatctggaatctatcacggagagaaggaggaattacgaaggttttcaaatgaattggcaattgattggagagaatggccagtttgtgattgggaatctagggtagctgcagagtcaaggcttgtttagagtagagagtgagtggcaaaataattatccaaccttttatcataataatttcaatggactgtattgattggatcaaagttgttttttggattgtcatggattgtactacagcatatctgttggatatccaaaggcaacttggtttctttacgtttcattgtgccctcaaccacactattaactaggggaagtccttctttaagctctcaaattttggatgctttcaacatgcttcttgatctcaaccttcttcctcatgtgctcttaccaaccactgttcttgtctttttcattgatatcaatttgctagcaaagttattgcggttttctttatcagtgctttggtaggttattcataattcccctcttccaaattgcgacctggcctagtgacctgaatctgagttcaatttggtgacctgttgggtccttcaaaacagttttttattcaaatttgactcaaatcttcctgttcttctcacaaggtcccaatggaatttcacaagaattacactaggaattttaatgaattttcaatctctataagctgagtgcattcaactctgacctctatgtaagcaggtgagattatgatatgggtatcatgtcaaggtgcagcgccaagtctctctttaccaaaattgtttccctaaaaaaattaaaatcaatgatcattacctgaacaaacagctaggactttgcagttagtcacagatgttaacatcaaggagtttatgtggaagttaagctatgatcactaccagtaggaggcatgcaaaattgcagtgatcctcttcgttgagaactagttctctctttatatttaattcaaccatttttttttattgtgactactgagtttccagtaaattattttgttctatttatctcttaataaatttaaggagcttaatttttttgaaaaaacatagatggattgaataacttatctgtatggatgggatggttgggtatccatctatcaaatgaattgtgattgaattgggtttctattaatcatcttaggtcttctttgtaattaaagaaaataattaaatttgtggtaatagatgaagttgggtttcattacagagaagataaagtacttcatgtgattgcattaataattcaaattttcattttttttgtttgttctttatagtaaggttaatttttacgatgtactcattttaccttgaacttagaagtgattgcctcatgatagaggatctaaattcctgactctgaatggaaatgatgggttgtccaaatcctgtcatttcactcaaatgatggtgcctaaatggaagtggaattttatttacagtcttacctccttggcatatttttgttaacccttactacacatgtttacatgtgctcttatactggtaaattgtacattatatttttcctgtatatgcagaaatattgtttttggtgggcacttcatcttattttcttgctctattgtcttctcatgttactgtttctctaatttctgtccatcactaattttgtccactcttttttcagatgttccatttgataccaacgcctcagggaagctattatgtgttgaatgacatattccgtttgaactatgcatgaagacatatgacctgaaaggccatagatgaagtttgcctattgctagctgtttcagattgcacatttgaaattgaaaatgagttatttttggttggttgtgttgaacgcttaattgtgcctgttgtgtttagaattttctgttgtgactggttaaaaactcaccttcaaggataaattgttgaaagattaccgagtgttggagtttaaaaacttcaatatttttgtgatccgcgatattgaatccaagcatcatgatccagtttacctctacaaattagtttatgcttcttgtcttaatttttttcctttctatttggtgctgaacgaaggattgttttcttcgcctaagatcagtatgactaggcttggaaaagatattactgtagatgttattgttttataataaattgtggttaaaaattaaaatgggggctattggtttatgtattgaaaaatatattaatgtagagtgttacaggtgattgatataaataagagtaaattatacttgctatcttttgtgttttttccaaattgttatttgatacctcttcttttttgcatcctataaaaaatctcttaaatgaatcttcttttttctaatcactgtttaataatttaatagaaaatagatacatgttagtcatgtgacttttaatgaaaatttatgtctaaaaatattctcatctttttcaaaatcatacattttgggttttacaaactctcatattcttcaacaatacatcttcacttaccaccaccaacttcttttcctcctccttcctctttcactgcagcatatctctttcttctcatagtcgtcttcgtccatcaatatgacgttcgaacgcatccactctcgtcaaagaaatcaccattatcgtagccactgctaccaccatagttgtcgccgcaatcaccatatccacctctatcatctccttgtcctccgtcgtagcttcggccatcatcagtattgcgtctggtttcctggatactagcgtcgtagaggtccttgacacgtccgtcagagtcatattcaagggatgagtatcaggtacaatttgaggaaaaaaaaatactgctcaaatatttcaattaacgttaattaatgacgttaatagaatgagataaaagtaatgtataaaaaaataggaatatcgaatgcaatgtgagaaaaaacacaaatgcaagtaaaattccctctaaataaagattcattcctttctcctactcatacaaactcgtgcatttaaaaagttatttcctttttaggaggataagttattaaaaataaaatttaaatattatatatatatatatatatattcttttatgtcatttgacaattatcaattaacttatatagctagtcttatccaatacttttaattaaattagttaatttacaagttatcagctagcttataaattagttttatcaaacagtctaaaatgaaccgagtcagtatgcttaagtacaaaagagattaaaatgatatgtataggaactaaaatgaataattgttaaatataagaattagaaggtaaaatttgtgcaattataaaaactaaatgtgtgattaaatctcactaaagtaacaataataacaatttgttattcgaacctcaaacaaccctaatagcaaatttttattcgaaactcaaacaaccctgaagctaacctcattccaacatttcattcaatgatgctacattttcagataccttgtacagttgtaaagaaggtagcagccataagctatataaaatttgcgaagatatcaagagtgcacgcaaggagatgctaaagaaacttaatccattcaattcgaaaccccaccccacctgcattcaagaccatttcatattttacaaagtaacaatgttcatcgttattttcactatacaatctagactgtttcaaactaataagtcagcttgttctagacatctagatacaaagaccatcgaaatggttgtgccacaaactgatcattcaaaataatgaagactaccaaggctagcgttgctcctagggaaatggataaaaatcatcaataaataagtcatctcctacagaagttgataatgatgcctcctcactcgtacccgcaagttcagcctgcaagggaattgacaagttatgcattaacagcacaaagcaattgcattctaaaaggtaaaaatggtttatagctctgtatggttactattttgtctttatttttgattgagcacggaatgccccatcgaagcctcatgctaaacaatgtttaaattattcaactagtggcaaactaacacatgctaaagagatattggttgctctgcttaataaaatgcaaacactttactcttcggcttttagactaatttatttaccttagcttgacgatatttctcaagcatgcgatgatattgctcacgagcatctggtgagttgaccatggacagcacccttgaaacagcctctttaatttctacatcaactttctgttttcggaacaccttgagaatatcttcatcttcatcttcattttcgttgatgtccatctcttgtcggaaacctcgtaaaccagctccttttctcctccatcgtaggacaaccttgtccaagattccaactgcccatattaccttgtaatgcttcctaacctggtagcccctcacatgagcctgcccaaataaattagaaataaccaaggttgataataatgccgttgaagatcaaagtatgcacgtgcatgtgtagcttgcctataaccagctgttttttggtttaaaaaacaaatttattcactttcagagtatctttaagtgctagttatatataaattaagaataacatctatgtagctcttggaattcattttgttctagtcaaactataaagttaacatctattacctgtatcttcactactttttggcgcaacgctaagaaatctttgcgacctttccaacctcgatatttcttctgaatcgataaagcagctgaagcagctgaattatattcacgtgagttccgaaaggcaagttttgacatagcagaaatctctgaaatggtaccaatgccacctgcactagaagctgcttctcttgctcttcgttttctaaaagaatgtgagcgaaaagcagattgtatccgcgcagctgcctgagttacatttctgatagcagccaaggtatctttgagtgatgcctgatcctcactggcagtaagattttccttggagacactgttaacagtcatatctgcctgaagctcagcattacttttagataattcactctcttccagtgtaagcgatgacagatggcttgttacagctatctctgaaagataccctgccagtcccttgtgcccactgttggctgcaatagatgcagcagttttacccgttggatcttgtgcatttggatctgtcacagctccagcagatgctccagaagctataagtgaagcaaccattttttccctatatggaataacaaagcttcaggaaaataacatccaaaatactttaaaatggaacagataattataaaatggtttctgaagaaacaagacaactttcttgatacgatcatcagttccagcagatgactggatgaaccaatttcttttaattagaaataaaagtcagcagggggcgagccctgacacaacagtaaaattgtgccttggtgatggtcatggatttgaatctgaaaatagtctctttgcatatgcaagggtaaggctgggtacaatatcccttccctttaccttcgcatagtgaggagtttctgagccatggggtacgtagtcttttagtttttttttttagaaataaaagtcaacaactcggcatttgctttgaatgattaagcaatcatgctacatgtggttattataccctcagtgttgtcatcaatttctacttttgacttacagactaggcattcccgaaagccaattaacttaacctacagggattttaataatttcagaatttgaaaacacagtgtatttgatatcattttaaccgaacacatccttttcagtttttcttacatctatcctgcagtctgcatctccagaaatttaactttcagacttaaaaatctgaaacacttatctttttccttgcattttagtgctctatacctataataagagatcagatagtttattctcctttccttctccattttatctttccttgcttctgcattcccttctccaaatgaaaaaaaaaaattgcatacatattttaccaagcacattttgtctgtcaagtatgtatgctttccttatcttcattacctataagccttatatagcaatattaacatcattcaccaaaactaaataaatcagtaaacatagtagcaagctctctagagttctctattaccttccaaaacgtgcagcccaatgaagggcagtccacccattgatgtcacggaaatttatattgactccacaagtgagaatagggttcaaggcccactcaaaacctaacccagcaaccatgtgaataatcccttgctctttcttggacaaagagcagcctgtctcttcatctttttcctgagatctgcaagaaagccactgttgaagcttatcctttagaagctcttcaagaagccaatcaacagtaccagttgacgttccactgccaactagaagagcctctataatatggctccaagagtcatcatcagctttctgttttatgagaggaattccagattctatgttgtcattctttattgttgatgcagaaagaagcatttgctctaatctaacaagtaataacagctcttctggacttctagtggcttctgtttctgattgagtacatcgagtgcaactattggtcttatcacgatattcaaactctctgacctcactgcaggactcccggtttccagaagtaatgcacagagtaacctttccaggaaggtgggatggagcttcacaagagattacaccatcttgaattatctcaacaggaacttcaacatcaccaaacatacaagcccatgcagaatccgagggatgacagagaaaagacccaacaacaatgacctatgcatatggagctttaggaatcaaatttggacaaaatcaacactaaacatcattttttaagataagaaagatgaaaggaaaaaaaaaaaagagacaaaatttatgccccaacttgttaagtcttaaatgtccaaagacataagcttgagcaacatttccctaacctaattattataaatagactgagctttatatataattgcttcataccaccactaccacaagaatttcatatagatttcaagattttcaacaaagttaagaataaattttaaagctcttcaggaacctaggtaaggtataagcaccaatagttatgaatcaaaggaatgagcactttcattgtccacaagataccagttatgcaaagagaaataaatcattgcatagggtatgcaaggtgttgggctttaaaggcacaaaccttggtagtctcagtggcaaaaccccattctggggagattgtcttaattgtaaatttctgtttttgtgcaacagtcaagcttgaatttgcatctggaggtgctccaatttggctttggtcaaacaatgtttcatagtagtcagaattaattacttgtgtttccaccatagaagaataggcaggaaatttgacttcatcaacaccttgaggttgtgagaaaacagctgctaacatgggaggggaatcagaagttgaagaaacaccaaaatatgccaaaaatgttgtaagttaaccaggtgaaagtaaatcatacagttttcagaatgattactgttgaagttgagccactgactgttttcctggttggaaactggtacacttcttgcagaagatactgaaatttcctgctttaagaatcaaacattttaagtattgcagaaacacatgaagaaaattatttcaacatctgagaaaacataaaattgcaaaatgatataaattttattaaatatgtcgaagcaatacttacattttcaattggcatgtatacatttttctgtggtaacttgactgcagatgaggacttacatgattccagcacctctgtccataaagccttttcatttccatcagggtaaccatggtctattaattcctgataaaattcaccaccatcacctataacaacaaacacttttagcatcttttaccttcctctattcccatttgattttccataatgaagaggacaaaacaaactataaagggctgaatttcacttgaaattaaaaatataaagttaaaaaaaaggttttgaacagataataactaatttacaaggaaaaacttcaagcaaaggcaaaaccaccattttttatctagttggagttacagggcccatatgatataaacagaaacttcctttcgagcctcttgttgttgcaaccgggatttaccttattgagcgtgattttgagcccgaaatccattgtataagtatacttcgagactgttttagtattttccttgaatttttccttaaatttagtattttccttgtttaatttggatccttattcaggttggctatcaccatcctgtaagtatgttgtgttatattcttcatggcatcttttaaaataatatcacaaccttttctctcaaacttcaaattttcttgttattattaaaggttagtcaagtgctaacctgtcagccacatgcaatttatcaagactagaacatttgttttattttccttatcaaccatataaacgaagcaaaacacttcatttattatgtaacatatggaattttccactcaaaccttaacagcaagttccacattttgatatgtttttataaagtctactggggtaatgtcaaatacaaagaaacctagccgtgagtaagttgtttagaaccattttttttcctggttacttggcttataataagaatcgcatatttctcttaagattcatattgagaaaaacccaagtccaacattgactaaaataatgaataaaagtggggggacaactaccacctaatgagctagcttttggggttgaattagtctcaaacccaaattctaataattcacacaacgcaaccagcatataacaattagggaattatgtttcagtgagaaaaattaaacaaatacaccaaacaagaagatggctataatagttgtgaccaacttaatctaaacaggtatgctatgaatttccatcaacaaattacagaaaactagctgtgcaggtgtaagatgctgcaagcacatttagataagtagaagacagatatctgtaaaagtgaacatgttaaacacacgatagattaagcactcagatatttcactgacttaagccatgcgttctcaacagatcaagtttatttaatttaccttgcgtttcattatatccatcataaaatagtccttgatcatcaggtccagagaaagctgcagattgttcttgattgctgatcaccctttgatcgtgctgagggtttgaatcatgtgcagtttcaggctcactgccaaaggaaacaatatcttcaaagttgtcctcattcaaacttaactgcacctccaatcggcgcaaagcttgagtaacctcgagttcaggcgaggttcctgattctgtatctgtcccatccatgtgacccattttattgttcagtacgaatatatcagacgtaacttctgtagaccctggactggagaaactctgattaggttcatacgaatcgccaagtatggatgttgacactggattctgagtagaatatgggctaggactctgagtatatgcagaagaggaacttggtgataattgtgccccagctccagaactgagctttccctataacatgagagtgagtgcattaatgcaaaactcaaagatgggctgcacaacaatgttactatgcacacagagaataaaacaatataatttaataattccacccaagataccaaatatgattcttaagaagatttcaattttttattgaaggccttaagaaaatttaagtatatctttatttgaggcacaaagccatcaaatgaaataactagtgcataaaagcaacaggacattacaatctttggaataatcactgactttttcttataccaattgtccttatcatagagaattaactatatgggaggtgaggtgtaggcatctctgtaggtaatttctgcttggtagaagagcataaagagatgttcataaacatagggaatagaaaagtttcaagaagttaagagaatgcatggggaatgactttaattcatagttgaattgtgttgcacaataattattaaagggtctaatattcatgcaattagaaattattacaagtcaacaatgttaccatacatgacaatctacaatttggaatgcaatgtaaaaatcctttacactatcagtgcatactaaaattcattattaaatgactttggaagcatacatgtacatttataaatgaagtttgaaaatagaaaatgagagaggggagggggagagagggagttacaacacagtagtaattataatggtgaataaaagaatcagtacaccaaacttaaacaagaaatcttaacagctaatggacaattgcacaagccatctacaaaaagtaaatatgaaagaatacagaaaatgtttgaaatttcatggaacaggaaaatgaaccaaattatttgagtttcacaagtgaatagtaaacaggcaggatgtctgtaaaacaactaatccaaaacatgttcagacagtgagcaatcttgcacaaaaggattccccaaaattttctggagggacactatgcacaaactacaagtactattattatgtttatctgatatcatgtatcggagactcacctcacttgtgttcctataatgcacaagaacaatatgctcatatgccctgccatgaaacaatagtatgagtgataatgaatgactattacgataacatatatataagcatatcacacaaatagttatgtacatcgaaggctgattctgtttcaaagtctaggataaactaatctttgcaattcacttaaaatttagttagcctctaggatggctttttaccgaaaattgcatgtttgttttaaaggatacaacatgtagtgataagcttaataatatgaaggatatacagttagctaatagttaaaatttactcacggatccaacatccaatagctccgcctctggaaagtagggttctgctctccgtgtgcatagtaacaatttaaggcttcaacatttccaacctagtcatgcagattagtacaatcatttaaattgaagaaatcagtatacagaataccatcacaaagacaaatgttggcctacactcataaatatggcaacaataagtgaataatgttttgataacatgctaaaaaagaatcactaaacagaaataagttatatctaatgtatataaaggtcagttgataggcaaatcattcattatttcaaaagcatcgtgaaagacttcaatgaaacttccaataaggatttttaactatttttaataataccatctgtcaccattcaccaagtttgagacatctatcaaagatatgaatatattttttctaacagttcaggagagtcaacaattttccccctcttaaatattaatttatgaactgcatttctacaactgatacccctttagacacttgataacaaattttcctttttcatggacaactaataaacacaacagtatagacactactaacacaccttcagcctttcatgtgcttctcccacagttcttccatctcttttcttacgccagttatgaccatctttacggaagaaacgcaggactcttttgttaaacagaaacagagatccacctgttaagaagatcaattgataatgttaacaatcagcattttatggtcaattctgaagaaacaatgacaaaatctgtcatttatttttatttctaaaatcaattggataaagggaacacagatcttactggttggctgttgcgggggctcttgggtgaactggaacttttcatgattctgtaaaatgtacatcacttctgcaggcttcaaccatctggcttgagcctcttgatgcagatcattaatatcgtattcgtaacctaaaaccacaacataaataagtcaaaagatttagaacccttcccatcatcatcatcatttttttcttttcttccttcttatagcagaagaactagataagctggggacatttttatgctttaacaagaactgcacaacgtaactaacaacttaattttttttcttctctgtacggcaccaatgaattattccaatattccatatcatttggaagcaaaatgtgttaggggcagcaaaataattgagtaaattaaatcaaattgcaaaaagcatgctacagagaatatactaaaagtgctttactgtcagtgcgagtgtttgattttcaccgattccaaacaaattccaaaactcacatggtccctattgaaagcaccaacctcagaaaactaaacagaatgcacacacccaaagtcgcaagtgatgtggttcacttcaactactcaatgaaaccaagtcaaactcaattcacttcactatacatcgcaacaaaacattaaacatcccaattttccaataatacacccaagacataatgataacatcattaatcattaagaaaaagtaaagacacgtttaccaggtgtcatggtgttgaatccgaggaataaaagctacaagtagtagaaccggacacagagcattgttggagccgcagaggctgctagattcgctacggtgcgagttggttccgaagaataatggatcggagaaaggaagttgcaaaagcagaaagctgaaacagacgcagttggcgttagttgaagcttagcatagagttgatttgaggttgtgattaaggttaaggttatagcgaaacgtgcttttattaaacaactttttttttttttattaacacaagttggggaccccgaccaagaccaagaccaagagatattactattagattgctactactatgtcttgcttttctcacctctttaatttaattttagaatattaaagactttacattaaagtgattaaaaaaaagactttgcaagttggagcaagtgtgatttttctaagcggtaatcacaatctggtagtccttttataatttaataaatgtgtagtagtattatacacaatttacttttttgttaactttgctaactaccctcttaaatatttaaagaaatatcaaaagacgaaataaatatttgattacgcaattaaaagtgtgattagactatagagattaacaaaatattataaatagttctactcttcgattataattgtctttattttaaatattttcattttttaccttaataaaatatttaatgtataaatgagccaaggtgtttttaagcgatatgcaagtactgcataaaaaaaagcgagatatgcaaggcgaacacattcactaattgagtggatgatcaataaatcaaaagtttcgtcatgcatattttaataatatagcatgccataattaaaaatttaattaatataaaaatatttaacgtggataatacattgaaattaaactttcattataaatttagaaaatgacgctcatgaatatcgggaaaaaaaagaaaaaaaatgccgctcatataattattgcgcgcgtaaatttcgccacaaactaatgattcaactgtaaacgtgactttttctttttggtacaaaactgtaaaacgaacagaaatgttttttttttttttttggtagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaaaaagttatattatgataaatttatgatttgataaaaagaaaaaaagaaaagatattaatagagtatttaaataaaaaataatttgtatatcattatttttttccaagcgataatgataatattttattcctgaatgaatatgaatctgtgacttaaattttctaaataatgaaaaagagtactgaaacatacccaaacagttgttcgtcactactattgcgattcaaatgtgaacaaaaggaaaataattccttccagaaattcacaatttttcttacagtatcttttttagtagtatacatatactacatgtatttaggtccaattaattataatatcaataaaaaaacaaaatgtaaaatataaaatgtgagcaaaaggaaaatacttccttctagaaattcacatttttgttacagtatattttttagtggtatacatatactacatgtagttaggtgaaattaattattaataaaaaaataaaatgtgaaatataaaatgtagtgtgaaattgtgaatgaggtgagtgggttgaatatctcttgggcaacctgattagcaatgatatcatcataaaggaagacctggtcatcattattaaacacaaaagacaagtttgtactgtgtgaacgagggttgaagttcaggattaatttcaggtaggtgaaaacttattagaagtattaggcgtttgagttgatatattgactttcaataaataaataaaaaagacattgacttcatcaacatttcaaaacaaacaatttcaacgtatgttattcattaatctcattttatttgttatatatggtacatgtttgagaaatgctagcagatttatgagaaaatatttaaaataacttatcattttaatcatattttaaattcttttcagttattttgaaaagctgaaacagatgagaagttatgattatttcacgagaaaattgcaacataagtgtgtgaattaaattaatttgagagggtatggttcaagaagcatgtggcatttaatcaattaatgtcatttcctcacgaaatacttggggaacaagaggtgaatttcaggtccctgatgacacgaacgagagagaaagtgtgtgtatggagtacacgtgtttgattcaaagccatgttaattggtgaacttagataagaaaactggataatctttggggaagataaagtcatacatacttgtccatttgttttaaattctttccatcgtgggaataaattattccaaacgttttacatatgttgtgcatatgggatgttatttttcagagtatggtagtattttatttgctattataaatttaatagaaataaataaatattcattatgaaaatagtatttaagtatcattaacaacttgagtcttgagcattaatatatctctgattaagacctgattgttttaaaactaaatagaattaatttaaataaatttatttaaattcgttaagtgtaattaaaatgtttacttaaattaattttaattttaaatttaccttcgagcatattcttttccatctctattaataaactaaaatgcaactcttgatataagaagttttccatgagtaattgctcttactttaactgggtaattgggtcgagatcaaagtcgagttttcttcccacaagcataatgtaaattgtaggatagatatagtaaattagtaatattattgtttacttaaaagcacaaaatataacactataagaaatttattattttggggcaattttacgtcctcaaattgatatgggattcggggcgtgcaaaatcccaattgtcctctaactcggcttaacctaaagttgatttgtacaggtttgaattttaaaaattagatctgttatattttagggatgagttcggattaagcttcaggccatcttaacctgatcttaatgtcttattttttttaatattttttaaacaaatatatattattaatattttttattaaatggataacattttgtataacatgatgttatatttataaaattattatttattttaaaatgtatattgtaaaatatatcttaatttaagggttttttttcttcctttttttcattcttagattcagctatatattaagattgatatattatatattttttattttgagattcaactatacaaattgttaagattcatatatattacgataataataagtcaggtcaatctgatcttctctttaatttatcaagttttggtcgagttagatttgagtttaagtaaatgatctgaacaaattttaagttggataagaacaaaaataaacatctcttaacccgttttactctcacccttgtatgtgagaattttgacaattgctgtaattacattagccagaagtcaatttatgacaattttaggattcctgtaacctgttttaaaactcttctatttgtgatgattgtgttgtgaaggtttaaaccttctttgtttgtggaggttgaaaatcctcttctatttgtagcagtattttcgaggaggattttaagttttagtttcctctatttgggatgagttaatttttaattttttccttttccatttatagtattttttaaaaatattttttcgaagatttaccctccttttaattgtcacaatttttgaaactttttcaccccttaaatttgaaccaaattgtaatttttttaaatgcataacattcttcaaattgtaattacttaaataatatgaaaattttcattattataactatagcaacaaacgtaattcaaacagtaacattaaagataaattatcattcattgtaagttttactttataactttttctttacctcactttataattaacttaaaatccacaataacataaaatggtttcacaataaatgtaaataattgtatgtaaaaagcacactacagaatcctcttgcattcaattaactaattcgcagcattacttggctgaaattataaaagaaaaatacttagttgaactaattaaattaacaagacacaagttaacgttcacatatatgatcaaataccatccaatcactaaatttatttaatggtttttcaagtcttagattagggatcctaactagtataactatgaaaccaattaaccctgattttgtaggacacgtccgaactgaatattaaaatcccaaaaccatatataatagtggcctctaattccttgcttcagaaccacataatcggcggaaggtgaagcacccaattgtaattagcatgggaagcaagttatccttaatccaaatccaagtccaatatcaaagcatatacaatcacatgcacgatagcagtgaatccacagtaacttaagccccaaaaactcctctcacaccatctttgtccccccacaatcatttccaacattgattgcatttatatgcaacgtccatccatgaatcccccacaacacaagcttagttagcattctgtgagtgtgcttcactctaattaacacaacacagacacaaacacagggtatacagccttaacagtagagtagtactagctggaaaacatgtcggattggggtccagtgtttgtgtcgttggtgctgttcgtgctcttaacaccagggttgctgtttcaggtaccagggaggtcaagggtggtggagtttgggaactttcaaacaagtggtgctgccatactcattcactccctcctctactttgctctcatatgtgtcttcttgctggctgttaggattcacttgtacctcggatagttcactttcaacctcatcaatggtggggaaatcatttttctttttcatttttgttgggattattcaattcagtcatgtttctgttctgttctgctttgttattcccgttcttattgcgtgttgaaataacaacggggctttcatcatgtgattgtatttttttttttcttgttcttgacaccgagcttggtcagatgttgtgcctgtattcagttttcctctgaatgaatgccagtacttgattttatactcaattgcattttagatatctgaactgaaaattcaaacctgtataagctttgcatcttcatgtatgtatgcgtttcagttgacgtagaatatgttaatttcggattaatttacggcatttgttcaattcaactcgaggcttgatttgatttggtgtaacgcgggaaaagaataaaaggtgcggcactttgcagaataagtgaataaccaaccactcgtgacacagtttattttattctccccttgaataattgtgaatctgtaaaccctgaatattaaacatcttgcataaattttcaaatgaatgaatcgtctggagcttatatgagagttgatttaattgtgctgattatgacagaatatttttgagatatcaacaaacaaacaagatgtaattccatttaccgataatatttttcacttcgtccaagtatgatcttagtgcagttaaattaggtatatgaatttatatatatttcttaaaaggttttattaatatacacgttgttttagtctcagttttttaataaactataattagaaaaatattttaaaatacataatggtataaatactaaaaaataaagatatatactttaataaatatttgtgaaaattatgaatgtagacactcttatttcttaatatgaatgtgtcaacaaattataaccaaaaaatattatagtttgttaacgcaatcataaaaaaataaaaatgtgtaggttagcaaatttccttcttaaaatttatatgtattttttgattttatttatttataattaaagtaaatgtagctctctaatccgatataaaggtaggctcaggcattaatttaagaacccctggaaaaatacgagttgggccggtctattaaatttgacactgtggttaagaaggttcagacaagacacacagcccaatttaccagctccgttaatcatgaacaatattcataacacagtcgaagttggaagcttaatttatggcactggagcccaaccaaccagcggaggataccaatactacttagaaaaacttttatcagactctcctcccttcctccgcagtaaaaaacaatttggagtgatattttcctgattaataatacgtaaattagtttccatataatttaatgataaatttatccgagaactttacaatttaatatcaaaatagattcttaaaaaatacaatttattatcaaattgattattgaatattataacttaatcataaaataatcttacaaatttaagaatcgaacttatttatcgtactttgcacatttaatgattaaattgtatatttcatcttttaaatactaatttatcacaggatcatactttcataacaaatttaattatttacttataaatctacgaggaaaacattggaaatacattattcgacatgctttttaatatattttgttattggataaaattttacagacattttttattatatatattagttggattcacaatgacatttgtggtattgaaacaaataaaaaatattttgttaatatttcccattgaagaatctcatacaaaacgaatgacagttgaaacaagaactaataggtcttttgctttgttcgtttcttttcctatgtatatataaaaaaattcatcgcgagaactattcctatcctaccttgataactgatatggatgttgaatagaatttgcctttactagaatatatttgtaatcctaaaccaaaaaatacacataaaaaaaaatcaaatttattatctcttttctctctcatttttaacaatttttttaaaaaagataatcttccaagtaacaatatatactactttctttttaattgttaacttttaactaaaataaaatctgataaaaaagcaaacaacaaatttgatcaacatattaacaaggaaaaaaattgttccatatctttttgcggttatacactctattagcaataatacgagaaatgcgacaggcgattgaaaaaaagagattaaaagaatgacgtatgtgatggaaaaaaaatcgaaagtattggatagtagaatatcgtagttgtataaagaatctctctagaaaacttctccttaacgaaaagtaatgcgagattcaagatgcgctgacaagttatgctctagattgcatcaacctacaaggcatagttgatgctaattttttggttgtcaattataccttgcttctttgctccactttcctcagtcatgcaattgcctcagacccagatcagaatcatttttcaatttcctatttaataagcttagcttatagatgatcatcacacagcatttaattcattgaaaactgggacatctgtgaagtagtgatcactatctaaaactagttactatatttgttgtaaaacaagtagtaatttctgcagggtgtgatggcatcagattggggtccagtggtgatatcagtagtgttgtttgtgcttttaagcccagggttgctgtttcagcttcctgctaagggcaaggtggtggcatttgggaacatgcaaactagtggcttatctatcttagtccacaccatcatcttctttggactcatcaccatctttctacttgccattggtgtgcatatttactctggataatcaatcatcccatagcaatgatgtaccgctatatgttgttttattctctacggttggtgtttttctttttgttcttttttattctggtttaaattattttgttgtaatgtaacttttaagatgtgatcaaggatggatgacttaattaatttcttctttcatttctctctcatggaatattgatctgtgtgatgtgcttctctttgctcatttatgtagaagaatatatgaatcttcaaagttttagagacaagggtaaaaacaacatcttatagttatatcgtggaggactggtagtaacacacttttatactttgtctctgcatgcgtatggtcgtatgcttgtgtgtataggaggggtaggatgtaatgtaagatgtcgcggtattaaaaaaaattaaagagctaggtacaatattggataagagttaggatcaattccttagttgcgtcttgtttgtgttttcttttggctgtctcgaattgttctatgaaagttaggcatttagaggtttacttgtaacggaatgctaaagttttgatgctaacagattcctataaacgaagtatgaaacggttaacatgttgattagagtttgaattttaatcacgtgtatgaaaaaaaattaagaggaaaagtttattttaattatcttttatatcacacaccgaaaaagataatctccaatgatacccttgagtaaaagaatggagtcgtggtaggaggggggaatcaactagtccctagctatgcttgtttaggcaaattttgggaagaaagggtattgaacgaaccattttggtgagacgatatcattttctgttgtttgatggacacaaaaaaggtagtgactgattaaaaccgtgtgggtctaacataacattctatgctactatgcaagggacaacgccaaaaatacaacatgtaaaacacagtgaactttcacctcatttccttcgtcccatcatgtgtaaaactatatataattattcatttttctccaattttgcttttcaattcgatcaaacaaagaaatatttcccctcttattttcttttcattttctttatctaaacaatgtaaatttctttccattatatctttgattattcttctttcgattccttctgtccttcactttctttcctcatccagaaggtcatatttaagaatcacagtatctggcaacagggaccttgcattcaagcatacttattaatatcggatagtggcgcgtaccaatcacccttaaaaaatgctatagctctatagcggatagcgctacatcgctatagcaaagtatataagtaaacattattctgaaatctgaattatatatataaattataaacaacataatccccccccaaaaaatgacataaatatcaaacatttgcataatgcagataatatagaaaattataagtaaaaaaataaaatagtccaataataaattaatgaacaataaaaaaacaaaaaataattagactagaagaaaaaagtaataaatagaccggaagaaaaaacaaatatatgaatatactttatataataaaaaacaaatagaaaaaaatttattgataaaataaaaatataatataaaattgataaaataaaatataatgtaaaactaactagcttaggagagttgaatgctttgaaagaggagaggagagtttctgcctgtaggcatggcaacttgacccgcacccgtgggcatccgtccgaacccgccccaatgtcaacggaaaaaaatcgagttgaccggtttcgggttcgggttcgggttcgatttttccctgcctgttgaattcgggggcagggacgattttgataatgctgataaccgccctgcccccgccatgctatatttaattatttataaaaatacttttatatatgtggaataccttgggataaagacttagttttattcaagaattaggagtataactaattttattttccagcaatgaacatctaatgttgaaattttattgtaattacatgcatttgagacttagcgcgatcaaattttatgttatgattgttgtttaaaattaattttttaatagtaatttttaagtgttcagggacaaggacggggtcattttttttagccccaccggttttcgggggcggggcccccaacccgccccgttgccatgcctatctgcgtgtacttgcttaagctagtctatgtgtttatcaagtattataaaggagagtttatgtcttaaaaaaaggagagtttttatattagacttatttactagtactaataattacgggaggagaaaggaagcttggagaatttttataatcactacttacaagccaatatttacatttttatttttaaattttaatagtggcaccaataaaaaaaaaaaacaaacagcacgacacgagtacagaagtgcactgacacctgatgcttttgttttaccttttatgaggcttgaccaatagcaaaatggcagcagctgacgctttcacttcatcttcctcaatgggcctcattccgtttcgtctagcccgtgcttcctcaacacaccgcaccacacccgctttttctgccacacccacccgcgatagtggcagctatcgccactttctcatttgctctattgtggtgcagtctatgttgatcgactgccgcaccgcaccgctatttcagtattgcgcgcaataacgccactattgataactgtacattcaagtactgaatttgaaattttttcccaacttgaaaatattttatttgaagcaattctattaataaaaactgcagattttccccatttacatttctttccaaaacttatattcaccctaactaaggttccacttgatttataggcaaccaaataaataatatgggaatggaattctaaaacaagtaaaaattagtttagccttagttcaactcaagcgaggcataactctgtcctcagtttatatatataattaccaataagagaaccgtggtctcgtgagtcatcagatcatattttccctttcattttatagtatatatagtcatataccatgtttggaaatggcaaataaaaaaaaaaaaggaaaatcagaagcctatataattcaaattttacaaaagatatataaaaataaatacaataattgacatcaaaagacagtagctgggaacaagtcctcaattcttggtgctggctaattgtaataaaaagagaagccatatccacaaaagcctgatattcatgactcctgcttctagtgagagaagttcagtaatcttcattgttctatgggcagcatgagcaggcaggcacaaaaccagtatagtactggtcaattcgattatttatcttttcatataattttccactctgaaacagcaagaaattgtaatgaagttcttaggctcgtgatccaaccaaaaagaatgagataatcaaagacataagctttgcggttaagtcaaaataaacagcagaaatgggaactccaaactggctaatatcgaaatttagttacaagatattgtacaccacacaaatataatatttctacaaaagactaaaatgtaatttgcttttcgaattggaggctattacctgtagtttatatggattatgtatcaaagccaagcaatggtagaatttgccaatttagcctaaaaaaaggtagaatttgctaacttagccagcctcaagcaacattaatatacccggcttcaatcatttctcaacaggaatatacaaaaccagcgggaagcgggtgcaaattttgtattttatacttctaaaacaaaaccaatcttgcagatccaacccttaattgaaaaagaatttcacattttattttttggattcatcaaaggccatacaccaagatagtcataatctatcttattctcaaaattttcactatactagtagctcccaatagaattttgaccaaactttataatgaagtatgaaattcttaatagtatgaaaatctgtttcaaaaagaaaactacaaccatcaataatgactgagcaaaacaaccacaaagaacattatttttcaaacaactagcctgctaacatcctgttaaaaaagggtaatagcaaattcagcacctacatcatactgaattgcagcctatctatctgtgatatgggttttgccaattccccgatagatgtggcttaataagtttaagtttaaatatcttatggcttgcaggtgcatatatctatgcaacaaaaattatcccaaaaattccttactagcttttaaactaattatctcaaaatttcagcaaatctcaatgcatgtagcaggtgcatatacaggaaaccaaacagacatatgataagcttgtgaagagatgtgatgggcaaaagaggtttattaattgataagctcgtgaatcgtttttaatgcactttttacgtgcatataggtcatgtttaggatcatttgtctcaaattttcagcaagataacagtttttcttttaaaaaattctttcaacaagattaaaatataacaattatttcttcaaaacaagttaatctaacacgcaagtcttccaaacactaccctagaaatggacctgagtagtctatactagatgttaggttcaaatttcattaccaactatagttaaaaaatagagcaaaaagcaacaatttttaacaatttttatctatccaaatatttctcaaagatctcccttcctctaaatatttggtaaaagtggatgaatattggaggggtagaaaaggaaaaagacaataaacaacagagaaacttccttttgggtcccacaacacaaacaagagatcagatagataaacacaatgattgccaaaaacacgtaacttatccccaatacacacaccatcaaatctggacaatatccatcttcaattttcttcagattctaacaatggtagattaaaaaacaaaacctaaatttctgcaacaaataattaagcaacatctcaaagttttaattttttgggtttcttaccagggagatccttacgtggcgtagcgtaacagagaatagaacgccccagaacggagagagaggaaacgacgccagcgacataaaacaccataaccaatccgagaacccacggcatcagcatgaacccgatgaagaaagtcaccgatccacacagcatcagcgccaccgaaatccctagtagtagcgacgcgaaacccgccggagtaatctgcgcccccgccggagaacgcctcgccggcggctccggaacgatcggcggtgaccggagaaggttgaagaccagagccgagagctcgcagaaaaccctagattgttgatcttcctgtcctctcatggtgtctttgtatcagggaaagaaggaaaagatgtagcaataataataatagggagaatttaaacgaagagcaataggataaaacggagggagatggaaattaaacgtgttgtcgttctaaggaaataaggaaatggaagtatttgcagaaagaaagatggaaatgaattatgtttgcatttggggagtcgcgttgcaagtaatgacacgttgtcgttttgcgtaagattaaagacgcagaagcagaatagaaaagttgaagaaaagagaaagtgataaatgagagaagatgggttgcgttgaagagaaaaagtgttgcgtgacgttaggattttggttttgagggatgggatgtgatgtggttgaatcatccaagttgacataaatgaagtggtacacgtcgcacgaccaattaggaagataatagagggctactattgtaattatattttattttcaactaacgacggttgaatgggtcagttttacccgttttggcccatcctattattagttcacacaaatcatgactaagggtaagttaaccagtttagtctgacaaataaataaaaaggagaactgaagaataattataaataaaaatgattcataaatcagtattgcttcctaaatataatactattctttccataataaaattaagtacaaatccaaaactctacactattctttttgttttcttattaaaaaattattgggccaatgaactagttcctgcttagttaaaagccaattttttttttgttgggtaaaaacaggctaatgaattgatatctctgtctcaatccttataagaaagtaggttaacgataagtcaaatttgttttgcaacccatatactcatgtgagtaaaatttaagcacttatatctttcttttttttttaatatatacgggaaaaaaatgcccaaagaaaaactataaagcaactagaggaggaaaacaaatttctctagcatcgttcaacaatgaagggtaatgctcaagaatcaccaagtctatcctctctgtataagcataatcagtaagcttgtccgcacatatatatttttatatatttatgtgagtaaaattcaagcactcatacctttgcatgtcacatatatattttgatcaatttaaatatattctttgctataatttatttgaaagtaataaaatatgaatattattatacttttaatattaataatgaaaaactaataaaaggaacattaaatacaaataaaatacataacttaaataaaacatattactaatttaatcttaattgtaaaaatattacaaataattttattgacttaattataaaatatttttagaactttcaatttgtttttataaaccataataaactcttacaaatacttactttatttaaacgggaacttttttaatgaataaatgctctaccaatgatagttttcataaatacttagcatcaaaacccaactgccaccatgcttatcacgccttggaggtagggcacacaagctgggaaataataaattgtgtgggacctcatggattttttaatatcaacttttttgtttgttgctgggcattatttaatacattaattattggcatatatcctatcaccggttttcatttttattttatgtttacattttcttagttaaatttattaaaaattataaaaataaattcacatttaatgaatttctctctcactattataatttttaattaatagaatgtttaaaagtaatattagaaaatattcttaacacttgcggtgagatattaatttctcaggagccgattaaacaaaattaactaattttttactaagaaatttaatttttaaacaaattataaaatttagttaaatcacatttttttaaaagcaccctaaatttgatattaagaataaaaataaattattaaaaataaaagctcaattaattgaagggtagttttagaacaataacattaaaatatgataaaaataattaaattttattatatttgagtccattgaaccttttttggttgtttataattaagtttgaaggaaatatacttatgggagtgggattaaattatttaaacaaaaaattagtaaaattatttaactaaaaatagcacttcatttgctaaattttagtatgcatgttatttgagataatattaaattgttaataatcaaattattcttaacataccatgatgcctatctaattccgggcagatgtgaccccgatccatatgctactttgattttactatgcgagtttcataattcagttgcacatgattaattattattgctacataattcataattggagtatgcggggaactggttcgctgatacgcacaaaatttattgtgtcctaaatagaaaatggtggtggtagcagctcaaagtgctgtccaatttttaatatttgttattattcctttctgaatatattatcaccgtcaagatcatgttactttcattgctgttggagtgttggtaacgtacattacaggaaattgactaaactgttgactttggcattgcttaacttaattgacatttgatatgatattcttcttgtcccgttatatcgtctaataacctccagaacagattgaattaatattataataccatcccttactttcaccgtgaactgttcccatatcttagctttatgagacttataataccatatcaatattatcgcggaaagagccttatttttttaggatatatatatatatatatatatatatatatataacttattatgccggaaattaaagcatatggtatataatgtcacttattataatttaattaggcacagactagtagctgaagcaaacttccccatggcaacacattatgtttaagagcttctctagatgctccatgtttcaaccagaatagaaataacagaaggcaagtagctaaaccatggcatagttccctatgcatgtattaagcacacaattgcaaaatatccacagtggtggctttcagctgcatttacaaaccagggagcagattatgcgtcacccgatctgtttgatcatattcaatataccgtgtcaccacgttattcaagtcatcagcttttttcagtgcctcaatctgcaacaggtgaaaaactattattgatagaaattggaatgtctataatagttttattgggataaagagtatgttcactgttataatctataaattgcagctcgaatgggctcaccaactggtccgataactagtttaaattagcataagataacgacttaaataagttttagaaaggatttaacattttttttattcgtagataatcgaagataaataccaaaaattacaacaatttatgcatcatgttcaacaaactaaattagagtccctgagtaaaaagtatttaatataaattttagtctaaaattccgtatgctttttttgttacaacagaatgtataagattcctccagggttttttggtgtataatgacaataatgaggatcaaatctaagtttttgcatatctatcccaacctctacctctaggccaatcatagtggtcttatgagtgtcatttaaatgcataaatttttaggttgtattcagccttaattaatattgcctttctatttatttataccgagttcaagaatcgagttaaaaaaagtgtgttcaccacatagaatgatagtattgacagataacttgaagtgcatgactttgtatacatttttacctgtttcttcaaaagctcattttcatttctcaagatatgttcctgtttgaagcagcaaaaagtgttaaaaaagaaagaaaaaaaggttaacaaaccataattgaactttgatccactgtttatcattcttaatcgaccttgtttgatattcagacaaaaaggaaacagtccaattatgtaatgcagacgaatgtgtggaaataaataaacacggttcttcacattatccggtatattgtttagaatatttctaattataatttgtctctaataaagtggcatgttaatgatacaaattgcaaagtatcttttttgatcctgaaattgcaaaatatctatatgtgattatgaatatcttggaactttagtgtcgtgtctggtactctggtgtgtgttagtaccatcagtttgtatggatatagggcgccctgaaactcaatatatatatatatatatatatatatatatatattcatactttaatgtgaataaattttaattgccatactcaatatgaggaatttgaattattctacatctaaaatttgaggcgttgtgcatagcaccttgatattaaacgtgtcctggacataatttgctagtatgatgaatgatgattagttctatccaactagtcaacctaacaacttaacttatccttaagtttatagttcagattaaagcaggggagggtggggagtggtgatccatccatataagtggttatcaaacatacaaaatcgagaaactcttaccaactgcatacctttttcttaagattcactacagattccatcatcaatcgcatctgcataaaaaacttctgcattagaacagtcttaaatgtaaaaaggtggagctaatgaggacaactgcatcgtcaattgaaattttaaaatttgttgctctggccgcaattgccatgagtcaaaagtcacagggaaatcttcatcagataaacttcggtagttcaagagagaatgagttttctaaaatagacctttagttaacacttaacaacaaaaagaacttaggcaaacgtaaataccgcaaattgagcttgcaacagaatggcgatactagtaatctcatacgcaaacaggatgatatacaacaccatcactagaatggaagggatcttcatagtataaacatttcacgcccagaataattggttctaaatgatagtgatttgaacagagaaaataacaaaattaagcagttaaaaataccagaatttattttgatatatatctcaagcacgacactagagcaaagcctttttgccttgaagtaaagataaataataagctcaccttattctgtaaaaaaaaaagaatgtttttgttaagaagggggaggtctaatatctgtttgggaagaagttaggtaaaagtgcaggcgaagcggcctgggaagaattaagcttaggatgaagtagtcccctccggtatttggagccatcagagttgaaattataggacaagttaaatactctcaactttcattcaaggatgaagaatgcagtacaacagttgaaaacttgacaactagttagttgaaatagggtttgataccttgctaagaaacctactcacctcacagcttaaactgtcatataaagctattgcatgcccgagcaaagtttgccgctagagttggtaagaccccggcaaaaactgattctataaatccacaacctggcttgaagattatttccttgactctagtctaggatacaaattataggtctcctgttaataaaaataaccagaattctaaatagataaacatggacacaagatttaaccaggatcaccaagtatgtcctcgggactagagcagttgtttctattattgattagaacaaatagggttacatcaattatatagaataaatcacgatatagatttgcaatatcaccccaatattgtattggggagggggggtgggggtcaatccataacgcattacaaagtgagatcaacttcctattgttggatttggcaacatctaactccacccatccctatccctgcacaatgtcatccatcctggctaataatgttatctccatacatcagcgtactcaagatttgaattttgtagtaaccttttttcgttttcacttatttcaagaacttggcatggggaggatgattggacttgctaaagagtagggtgagttatacttcttgcaacacatgaaggttgatggtggtaccaacaaaaaggtgtagtcttcaagccaataggcaaatttcgagacttgaacatctgccaaaatctggcttccccacaagtgtcttggacatccaccatttagaatgccgagtctttatttactcatttgtttataaaagagtcagtcgggtgttttgaaaacaccatcgtgcaacatttcttcctaataacaataaaagtcttgcaccttttcaccttgttcattatgattacattcattaatgattgtacttgtgtgacatggacatttcttatgaaaagtaaatctaaagtttgtcgatttctttcgtcttgataaaatttaattttgaaagcctattaagagtttcggtttgacaatggtacaaaatatgacaatctaatgttaagttcaattgtctgagcttgaggtgcgtatccttgaaagtattactgatgacatgtgcattgctttgagaaaaggaaaaaagatcgtttaccaggtatcctatttctcagtttgtttgtactgaccatctctctgcatcgtatcagagttttattgcaacaattgatgcaatcaaaactcttacttcagtccaagaagctctgaaatatgagtgggttcaagccatgaatagagagataaggacattcgaaagaaactcaacctaggagatagttgacaaaccaaaagataagaaggcagcgggatgtaggtggaaatacactgatgtatcaattgagcaaaaccacaagattggaagtgaagaaagtctagtagtagaaaagtcccaataccaaagattgatggggaagctaatttatttatcctacattagaccagataatgagtctgtttggatacaagctataaatatttttgaaaacttatctattggaaatgtagaattttttatcaagtaaaaaagctgtaaaaaagacttttagccttatctccagataggatcattgctaatgttattaatgtggtcatccaatttatgcatgatccctgtgaaaggcacctgcaggaagttgatagaatccttcaatattcaagaaaaggattgttgttcaagaaaaaagtacgttcatacattatccatagaggttatatagatgcagactatgacgagttagttgtaaataaaaggtcctcgtctggatactgcatgtttctaggaggaaactagtaacagggaggagcaagaaacaaaatgtagttgctcaatttagtacataaacaaaatttcaagttatgacacacaatatatgttttttcttatataggtaaatgttattggatataggggaagcatcatgaagagtgaaagactttgatttaaaaatgtgttttaagctttcaacatgcttgaagtgtcttgaagttttgtaaatgaatcaagtataagagaaagataatatgttgattcttgcattatattcattcatccattaacaagcttaaatggttttcattaaaacatcaaagtttttatctttttggttaaggattcaatctgattaaaagatttttggaaaaatgattttttactgttttaatcaattacttgatggtataatcgattattttgttcctgattcaatctggaaaaacttcatgaataacttaatcgattacttatcggattaatcgattatttggcctttgagtgaaactgaactgctttgttaaatgttttaatcgattactgacatagtgtaatcgattacatagttgaaaacaaattttaagtttgcctggaataatcgattaccatcatctgtaatcgattacatagttcattttgaaaatcctaattttctgacttaatcgattatcaaaacttgtaatcgattacacagttcattttgtgaaactgaactttttgccttaatcgattacagctcgatttaatcgattattttgctcgttgttgaaacccagaaatcttcttgaacattttaatcaattaagtgataatttaatcgattacataagcgttttaatcgattatctggcgcatttaatcgattagagttagttacaaaatctgttataaataaatttgaaggcttgacttgttttctaacttgaccatttcgtatttctgagtatacacaagccttctaagtctttcaaagtgattttctaggttctattactttttgcttcattcaaaacattcatgggtctttgaatgattcttgagcaagaaacttttcaaggttaaggaaaaatatgttctgattttgtttgctattcaacctgacttagtaacttatgtgcattatattcattagatcatcaggttgtctctctccttaatctttgtttgtaaattcgttttgaatttctgttgtaattgactattgtaagtgggttctttttgcttgggtctagagaatggttctctagctaaagaacaaagtagtgttatctggttcttcctctttagaagtctaatagagttttagatttctattctttatctagtgttggtaaagggaggttttgtaaaagtttgtaagaacaaaaatttataatagtgaaactctaattcagtgtgaattaaaagaaattggatgtagcttctgttgtgaagtgaaccagtataaattgcatgtgtttttgtttctctatctctattactcatcttgttcattgattctttgattcatattcattgtccaacaagttctgttttgaacaattgatttttagggactgagttatttgattgagtaaaaatatttcttatttttgaaagtgataaagattctaaactctaatttgaattaattttaaaataccaacattttaatcaattcaccccctcttgtttattgtaagtattcctattattttcaaatgttagttttattagtagataaaatcaaatgttaattttcttaaccatctaattcaccttatatttccaacacaatatatatgtgagaggtaatggatgaagattattcttgatgacctctcaaagtacaataggaaggacttataaggctgttttgtggtaacaattcagttattagtatggcccataattcaagctagcattacagaacaaagaacacagaaattgataagtacttcatcgaagaaaaaatggacaacaatctttagtcacaacaaatgagactccaattcatagacgtgttcaccaaggggcttcctttaacaagattttagaaacttattggcaagttggatatgattggtatacatttaccaatttgagggaaagtattaatacaattgacatttaagagagaaaaaattatcttttaatttatcttgtaatttatttatttttatatattttagtttatcttttgatttatttatatatatatatatatataaatacacatattataacccataatattgaataaataaacaatttcttctctttcatctatattcagcgtttttgtccggtgaaatgggggctagcttgttttattgttaagagaagcctcaacaataaagtgaataatgtctcttaatgcatacacttcttgtcctgatctaattaagacggtagaataaaacttagaaagaactcgggggtgattgaagtatcttgcattcaaacgtataagaaaataatagaaattatctgtgcaccggtgacaaagaaaagtaatgaatcactactaactgccttcgggacttgacaagtgtacactgtctaattactaggccatataatataaatgctataaacttgtactaaaagtataagcttaaattatctggtagagttccaagaaagtttcatagaaattttaatcaatcctccctccggtaaatatccctacaggattttttttcattgatgcaatgttcaaaactcaaatgatatttgctatctaaagtgctttattcgttttaagaaacccagaggataaagaagatatgcttgcatgacattcttagaacaatagcttttttttttttttttcattgccaaagctgagtgatgtatagtttacacttaataaattgaaattcgttcactgaatagagtgtttaacctttgctgatctgattcgcgaaagatcagaacgaaccactttctctagttccataaggtcagtcacactcagatgctcaagttcagaaacaccaaaatgcctgcaatgaaatttaattagatcagtgattcgttcataccttaacgttgcagaaagaagaatgcaaagaatcacctttgcaccacttgagaaaacgctgcaccagaccagatatctgcaatttcaaagcggagtccctgctaccaaataataattataatatcaataatctcggttgtgatatgtttttccaagcgtcagttcaacatttttcataatttgcttcaaataattcccctaaaacaacaatattttatgtatcactttcttttgctctgtcattttttagacaaaaagaaattaaaaatacaagcttggcgaagctaagcataataaagcatattttcatttgaagtgaaagcgagcgagagagagagagaacctgagataaaagcaacaaaacttgaatatgcaagttttgctgtattgagaactttacctttattgtaacattaagaaatataatatcgacacccctagctttcatattgaaattctcctacttatttagttcccatgttagccacactatctatatgataccttgacaatattaagtgctctcttcatccttgttaccttgcaactgttacgagacagttcagctcttatatatgtttacagtgataactttcaagatgttcttatggcagctacggttagattttcttactctatcatgtcttgtatgagaagtgcaatatatctagcatacatgaaaagttccgtacctttgtgtcagtaccgcttgctcctaaatgatcccaatatcgctgcacaacctcggccaaactgagaacattaaattcacggatttttcattctaatattgaaataactaaacaacaacaaacgcatgatatttgataggcttgggtgcaagtagcttaacaggtcttttttctagccagggatatgtttctgcgtttggattaactttcaattatgtcaatatcaattctaaaatcaagttaaagccaaagcaacaaatagttgcttcaactttttcaattttccaccatgattttgagggtcaaaattggttctaggaggtatttaaacacactagtagttaaaaaattaatattagtgtgcgtacaaaaatgggatgaatgaaaataataaatttaaggggaggggaggtcatcccatctcattgcagtctatgataagctttagcaattgtttacctagggagactatacacctggtcctttcaggcatgggttttagttcatattaactaaaacaacctcataaacataaaatgaatgtttagtagaagtattaaaaagaacattagggttaatcatattggtgttatgttagtagttttaatggacaggacttgtattagttttattattgcttaacctaattaatatggtagaataaatatgtgttaagtttgcatcaaatatatacatctgttttttttgttttttttttttacagaatgtacatatctatcatatcgtatgtactcaatgatctttcttatttgattctttcaatttcaccatcttattgtagtgatatcatcctccaatcacaatctaatctatctcaacttctgcggccaattaagtaccaaagatttgtagcttctttcctactttgcatttgtctctctttcgtgttggctatgttctaactagctttgacaaggaacaattcttgttttttctgaagttgtatctataggttaaccgttaacctataattctacacttaaaaaacaatgtagaggatctgaggctctaagctgttaaaataattttattaatttaacatatatgcgatataatagtttatatatatatatatatatatatatatatatatatatatatatatatatatatatcaatttcatataagcttggaccgtcggattacaactgcaggacggtgcagttacatctgaattccagaggacctaaatttaatcagcaacttataaccttagtgttgtataagttggatttattggaggtcaacttaattaaaagattaagtttctgggtcaagtctgggccttttttctaccttcacttctacccgtcattgcaattaagaagttattgggctcctccaactatgtttcatggtccaaggtagttgagaagtggtgaattggacaagggttgaagaaaaatactgaggagaaaattaggagaaaaatactgctttactgtgtactttatattgcagtctattgattcttaccttcacaacgtctacaccaattttcatacttgttatgagttgtggactcaatcttcgtaaacaacacatgagtgttcttgaaattattggacagtggttatctatcaaagctaaattcaatgctctcttaccaactggaaaaccaattgctgaagagaggtttgggttgaaaagtaaaggttgaaagctataagtgaaggtttataaacaaaaataataaatagaagcaatcaagaaaaattgtaaggaaaagcaataaataaatgcaggattaaataaacttgtttttaaattgattctccttttgaagttaagtataaggtctatttataggcttgaaactcagaagatcatctattggatcatatctttctacctcataactataatatctcgatcaaatcacaccataatgagaggaatatggaggttttgtacatgtgtgcgattgtataattaacaatgatttaaataaattaattgatattacatatatcaacaagatccatctatttttcactagcctataacttaataacttaacaattaagcatcttggtttgtagtagttatgagatggttgacctaaaatgtgtgagtgaggacaaagtatcctaaaaagttttatgttggtttgtgggacagtcattgattttgacatcaaccgaaacagattctcgaggtctaaaaaaaatagcatcagaaggttagaaagttctgactaacaagaatgttgagcaaagtgttactgtgtgaagtgtcatgatatgtgagttgttgtgaagtcgacaattaggagtattacagtaactacctaaaaaatgtgacttagagttgcaaatgtttttttcttaaccctccaattcatcaggagaaagggattttgactaatccaaaatttaactaagaggtaagtaaaatctaataaagatcggacttgaataatacctaaatgatttaatcttacaagacatgagtaatcgttgcaccaatttgatttagaaacagtcattaaattacacccaaatagcagcttcaataaatgtttaggaaccaaaccgcagctgtctaacatgttagggaaattatatatatatatatatatatatatatatatatatatatatatatatatatatatttgaagttctatcagaaagttatataaaaaattaaaaagtattacttaaaataaattcatttagacacacatttgtgccaacgactttgaatgagattttctcaatgtttagggcttccttgaatattgttagatataaaacgtcatcttaagctaagttttgggttatataacataatataatgttagatcatatatgactattctctctagagatgtaatttaaatttgttgctcccattcttctaagcaatattttagaacaaggtaagatgcttaagtgtagtctcatgtctgacaaagctatgttacgctttcatctaatagtttaaattcgtgggataattagttcatgatggtattagagacatgtgacacatatttttacctaaacaacttagggtgtgaatcaactcacatcggattcattgaccagtaatcctttgtgaaagtaagatttctacgaaaaaaccataaaacaaacacactaataagctttaggagtaattgattcaagaaatggtattaaattaaagacttgttctattcgaagtattgacagtggtggtccaaactctatctaggactaataggtgtagaccgataaatgatttttgccttgaagtgtgagggtagtagtctgaacttcttgaacctagtctgcatgagtggtggtgagagtatctgcaaaggccaaaggcacactccgatgccaagttagtgaagaactttacacaaagaccaatagtaataaatgcgcgtaattataacacagatgccaatagtatttaaaggagtaaggatggactggatctctatgctaaaggcccatgattcgaagagagaaattattcgttgttcttagaataacataaagtgactttaatctccgagagagtttgcagggtcaacattttagaggaacgggacttggattcgggttgggtcctagctaggcctgattcataacaaaactcatattaaagatgtactatacataaaatcatttttgtatttttacttaaaacgatttgataagctttgaaaatggttggctcttccacatgccatcgctgagtttctatacatgacctcgggtcaaagtttcggaattgcacctattatctaaatagaagttaaaatatgttggatttaaaccactcagaaaggggcggaattaagggactaggatgggtcatcactcccctaaaatttaaaaataaaaaatatatatttttaaaaaattaataaaaaatgaaaataaaatgaaaatgaaagaaaaaaaaaagaaaaatattaaaaaatgtgaaaggggnnnnnnnnnnnnnnnnnnnnnnnnnnnnnnnnnnnnnnnnnnnnnnnnnnnnnnnnnnnnnnnnnnatataaaaaaaagaaaagaaaatgtaataaaaataaaaagagaaaaagagataacaaaaaaagaaaaaaggaaaggaagatgataaaacaaaaaaaaaataataagggaaagaataaagaggaagagggataaaaaacactataaaagagagaggtctggacacataaacacacagaggagaaaaaaaatatacaaatcccaagagaacagaaatagtaaaaaaagttgtgtcatttggtactagaattagtgaaagagaaaggttccagttatcccttcattcctttcttttttcctcttttcttctttctcctcctatttcttattgttgttgttaatcttctaaaataaaataaactactatttattcaaggctagcaagaagaggaaagttcatcatttacctcttattgatagagtgattaaacttgtattcactcttctattttctataataattactgaaaaatctttctcaactataaagataatcaagactagacttcgaaatagaatcaaagaccaatttcttgatgattctttgattacatacattaaaaaaaattgttttgagttttaatacatattcaattatagataattttaacaatatgaaaacatgtagaataagagttaagtgaagtaatcttaatttttgtaatagatttttttaaatttttttgtatattaaatttgtattatttttgaaatacttttatttatgttataattttttttatgttcatcttctctcaataaaattcctgtctccgccactctcctcagacattttttatttatcaattgacgcttctgccacgtccctggatatggtacagggtatgaaaaagtgacacctgtacctgaccatgcagttgatctgaaggctttttatacttgtccaaaatcccacactgtatacatgaacgctatttttaagtcagatttaatttttcattttccaattaagcatatttctcaagatttctagatctctttaattcaaattttatgctatcgttgataatgcttttttaatgaaccttggatatgtttgagtcttactataatgttggtaactgatattttcattgggagtctttttgacagtgtttctttgctcgtggtcactcaatattagaaacattttttctgattgttgaatcatttatatgataatttatttttttaggttattcaacgtgttaattgtaacaagctgaaaactcagttgtaagcctcaatttgcagatgactgttaattagaacaaaagtatttgtattgagttggagttgtaccctaattatactataatgataactaacttagattaatagtaatgattggtatctacaagttgacaccttaaatgaagttgatgttagtgtcttgatagtcgtgaacttgtataaatgttcaaataaaattgtttattacaattgagagactaagaacttatgggaagtaaattctatgttggtagtattctagaggtgaaaactcaaagaaaataaaatacataagaggaaaattatttgggactaaataattttttgattttattttaacttttgcttggcttgataatatacctagtgagtccacatatttatagtaagcaatggaactttctagagaaaattaattcactagtgcatgaactattattacctagatacatgtgattttctaagtacatgaacataatttccaaaacaccctgtactaaactcccatttataatccaaattttctatttcactaccaaaatgagacaccctatttgtcaattcactcaaacacatacgattataagattgaagttttctttcatagctccatgatcactactttaagaaatttctagagctaccttccatgttagaaaagattggccaaataatctataaccgtcgacgttatagtaaaagcctacactcatgaatactctgaatcgttttgaataatgaaaggaaataacggggaagagtagcctagctataatgaaaataccaaacccttaaatcggcagaaggaaaaaaaatgaagcaaagctacaccttgggaagggaacaaccgacttcaacaaaacaagtagggcaaaaagtaaattaggatattaaaccaatcaccagggcggtttgacagtgaaaacacatggagagtaagactataaggagacattgagattgaatgacagttttttattttatattatcgatcaaaatatatgtattattttttaatagatttaagaattttatttaacttaagaataaatagtataggtagtaataataaagagtttcatattattatacaatgattattgtatatataaaaaaggagttatatgtttgagacaaaatctgtcattgatcaagtaaaacataaaagaaaaagaacattagcaatataaatatacatatataatacaaaatcgataatcagatgtaagtaattaactatattgatttgattatcaccatttatagacttatattcattaattatattttttattaaggtatctttaatgagagatttcaaattaggattttatatcattttttgatggatttcacatcgtcatttaggattgaagatctctcaaaatctttctcattttttcttttagtagtaaatctcattttgggatcttagataacttttaaatcttacatggacctcacttttaaatattttatttaaatatttattaaataaaataaataattaataaaacatggaagaaaaaaatttgtaaatattaagaaattgaaaatgagcataaatttaatttttatttatgactaaatgttaaacaaatgcaaaatacataaatttgataataaaaaacgcaacacattaatgctaacgaaaaattaaattttattattgttgtaattgtaatgttttcaaatatgctattccaagtctgtttaaagttgttgatgaattccttttgtatgcataagattaggcctgattaggtctgaccttgacctgatttaaaaacataaagtttggtttggcctagttacatgtgataggcttttttaggtttggtctgacctatttaaaagcctgattaagcttacaagcctattaaaaaaacctatttttaataaaaatttaattttacaaaatactttaaatcaatttaggaaagttaacgaaataattttaaacaaaaaacgtctcaacatcttacttatatttttaaataagtaataatcattttatgagatcttcaatgtgattttttgaagtgattgatcatccaccttcataataagaaaaaatatttttagaaaaataaatatattatttttaagttttaatatatatatatatatatatatatatatatatattaaataggccaacctgataggcttggcagactttttttaaagtttaaatctggtctttttatttcaacagacttttcaaaaaactttagcttgacctttatgataaacaagtcagaccaggccaggccttaaccaggtttgaccaaagacccctgataggcaatctgtcccattttcatccctatacatggtcataatcaacatcgacattatcaccgaatgtatctcgtttgtcttcaacaattatgttatgcaatatcatgcatatcaacattatatacttcaatgtatccatgttccaggcacacgatggaacacatataattgtgagtcgagatttgagcattccaaatgctcgttcacatcctttctcgctgcttcgcgacattttgcaaataattttcttttagggctttgtggcattggaatggtcttcagaaatgtggctcaatcagcataaaataccatctgcaagatggtacctcatattatatggagttccattaattgtaaattgtactagaagagttcgaccttgcaaaacataatcaaacacaggcgattgatttaatacattgatgtcattatttgaaattgcaactccaaatattaacgtcaaatccacaagtcttgtgaagcaataacttcaagttttattgtggatttgcgattatcacttctatgatattggctctgccatgcaactgaacaattttttcactctcaatgcatacaaccaatagaacctaacatgcctacaaacctcatgcatctccaatttgcaataggcaattgatgtcattgttgttaggccttctcaagaactcttgtccaaatatctcattgacaccacttacaaatttttgtaagcattgagttgcaatgcatttatcaattctaacgtactcatccacataattgacaggtgatccgtgtgccaatatacgaataactacagtgcacttttgcaatgatgagagacctattctacccacaacgtcaagtctcctttgaaaatactcatcgtgattactaatagtgttgtcaatttgaatgaacaattgtcgccgcatttgaaacctacgtcgaaattgagtctttgtgtatactgaattttctgagtagtcattcatcaatcgtagatgtccatcttcacgattgcgattaatcactcttctagtccttctgtattgactgttgttgccttcttgttgttgcatcacacgtaagtagctcatgaacaattaaatagcaaattatataaatgactagttttgcaacagctagttttataatgactattaaattatataaatgactagttttataatgactacaactagtttcataacatctagttttataacaattagttttcaaaaaaaaaaagacggttacaaattaataataaaaaaaagacaaatcaaacccgattcctaaaaatacaaattaaaaaacgatctcaacaaattaaaactacttaacaaattaatgctacatacctagtttacgcctaattattttacaaaaggcctaacgatcttggagttgactttcggttgtaaatgtgtcattcattaaaatgtcgtaatactctctttccaattctttcttccttaagattgctagtctgacattgagaacgtttatttcattcattgctttctccacaccaattaagtccacagaattggtaaatgtttctactcctatcccattgctcttcgttttggttgccttttgacccattggacggacaattggagacggtgtgtcagcttcagaatcttgtactgatgtttttgaattagatgacgatgaatatgtcccagatgcaaaaatcttcgtccttttagagccattttcaataaattggtctaaccatttcggttgttcttaatattgggaggcttacaaaacacgaaagaattgttttatggtattgaaagaaaaatttgagaactttgagaactttcagtgaaagggatttgattattttgcataaaattcattggtcgtggcaaatatggaaaaaatggaggaggattttgagaattttttatggaagaagattgattattttgcataacattcattgatgatgttggttacaagtagggaaaaaatgagggaagattttgagaatttccattcaaatgagaaagttgataattctacaaaaaaaatgcaataaacttgccaatatactgatttggatctattaagaatgaaaataaaccaagagattgagattgcaaataagatattgagaaataaaggataataaggagaggagaattggtgtgcaaaatataaacagtatttgttcaatttataggttgcaaaatatttaattaaaaaaaatacatagtctattgtgaatagattaaaaaaattaccaatattggttgcccactaactaaaaggcaacactaattttttttaaaggcaacatttaatgcaacatctattttttaagttcaaatttaaattgtaaattttttaatcttttttctcttcatcttcatcctcattttttcccaatccacgtgcagtcccttcctctttttttctctacgcctccccgctccccttcccctccttttccttttctctccgaccaatcccttcctctttcctcttctcctcctccccctttacgtttcctcttttcttcctttcccttcatgttttctccaccctcaaccaccaccacattcttttcccttcttcgcccccaatcactatgcccctcctcttccttcgctcttgaccaccacgactcccgccccttcctttgtccccaaccaccatgagccccctcttttcttttctcttctccacacatctcgacagtgtcacgcttcccttggtgccatcgtgtgcaactcagcaccgacaagggccatcgcccctacttcggtgccgccacagcctacatattatgtttcttcttccccttttcatttccttttatgtttgatttcttcttctttctgttgattcctacctaaatctattagggagagaaagtaaaaaagaatatattttattttcaaaatgtgtagattttcaaggatcttatacaagatttcattctccataatgaaaattttgactcctcctttaatagaagatttattaaacaatagatcttaaattcaaaatctttgttcaaaatatattattgaaaaatattctaaaatttttctctcaaaaggtgctcaaaatatattattaaaagatattctaaagtttttctgtcaaaaggtaaaaagtgagagacaaataaagcgattgaacatttgttagcatatcgctccagcttgattgagacgaatgtgaaaaacaatttggtccataactttttactattgtaacaaaataccttttcttggcattattctcatggaaacaatattcgtacatttgaaaatctcttttcaaatcaataaatctttcagcataaatgttctctctctgtatatatattccagcacaaataaataaattatctacactttgaagtcttttcttcaagtaaaaaatagatttaaaaaatgtgttctagcaaactctagtagcataaacgtggatattatatcaaatcaacttccagtagtgcagcagtgcagagagctgacaccacaaacttatcctcccaccttttaacaagtagttcctatccatatctaaggctccgaaaaccgtgacaatttgacacgactcagctagctaatggatactacttttgcagtttgcactagtttagttaatcattcatttccatttttagtttccaaccaacgaaaagcaattacatagcaaagcaaacaaatcaaattacaaaagaaaaggcataaaacgaaactaatttcatgtgcgacgtgacgtgatccaaagaagttggacacatatactaggctacggtgtacggaacggaaatcataaaaggtactgtgcggtttgcgcgtacctgtcaccgttacagagctcgtagagcttgcccgtgctggagacgatgaccagcgccaccttcgcatcgcagagaatcgataactcgcgagctttcttcatcaatccattgcgcctcttggagaatgttatctgccgcgtgcttttgttctcgattcgctttatctccaccttcttcttccccattcttcttcgcgccaaaaccctagctcgctaccttcttttctattcggatttctctctttactatctccctccttctattactatctctcctcatagccataggcttagcgtgctgattccttaatcgacacgtgtcccatgaccagactgcgatttaaattaactgatattcgtttcattttttaatcatctcatttcatttaacagtactagtcaaaaaagtcaaagccacatgctgcccacattgtgttgctaggtactataattttgtaaaacttaattaatgtaataatgtgtctttatatcaatttattttagaacttaacgttatactttgatcatcatccaattattcatataattaaaaattattttagatattgtatttaaaataattgtgttaattaatattataaaaatttatcttacacaatctattaaaattaaaaatctttattttagataaatatcattttaataatttaaattttcttaataataattttcaaaatatgcattcaatacttatttaatcaatttatttatgtcaaaaatacatttaatttaaataattaattttcaaatatccattttaattagtttattttatgtcaaaagcagatttaattaaagatttccaaaaaaaaaaagttttaaataatgattgatgtttccaaaaatgatcttcctcgttcatttatatttaataatgaaaacccatatggataacataactacataagtgaaggtccattttgaaaaaataagttggctgaaactagctaacgtgtcaaaagtcaaaactcgaaacaattactataattaattaattaataactattagatgcactgaggtcattggcacgtgattcagccattcaggccaacaaagtgggtgctgcaaacaattattactagtactggcagtattcttgttcgtattcctattattctaataaaaattattttaaacattcaaattcaatgccttcggtgcataaggatggatcacgatcttctacagttgcataaagaactgtacgggatatgagattcttatccatacaaaaatattcctttcataaaattataatataaaatatatatttaacgctataagcatccgttggatgcaactgcagaaccgtgcagttttttttttttctaaactgcagggatcctaaaccacataagtatagatataagttatgataagtagtcaatgtaaaaagagaagaatagaaagaaaaaagaaatgttaatagatcattaacatgtagtttgctgaataaaaattaaagcaggtaattcattcgtatattaatatttatatcatcctaactcctaagtggcaagtaacgtgcattctattttgagaaagtgataagaaagaaatcagataaaaatggaatggatgaaaaaataggtagatgtttataatttatctatcaatactcttattaaaagggaagaaacagtaaccgaagcaaagaagtgcagttttatgaaagagttagcacacacaaacaacattgcttaactttgttcctacttcaaacatggtagacacttacatcttccttacattcaaagccattttcttccttctttttttttttcgttttcaaataaaattggaacggcaaatgtgctggtgcagtggatcttatgcaggaaacgctaactatggtaaccatcctgccatgtaattgctcatgcttgggcctgctgtcaccactgatactggatcaggctgatacctgcacttgaaaaatagtatcattattaaaaaataattgaaatctaaaaaacttaggccaagaatgaaaattctaaataccattatagttatgctaatcaaatcaaccaactcatatgaccccacatctattctaatcatatttacatcaaagatgcactcctaagcatatcccttactagtgaaccaaatttgtcattgatgcacttatctaccttactagtgaattgaccatttgatacagtttagaagagtaattaacaattgtgaactgtaaagtgatcaatgattgagtcaattagcattgagtgcatacccaatttgtaacgttggctcacactccatttgttgaaagagggcttcaccatgagtatgagctggatgcctgccatatcccatctcttcaactccgggattcagttggagttgatttatttgatacccttccaactgctacaaatcagataaagtcatttatacccatcaattttcgatatcacaatatcagttgtatcttatagcaatgttttggtcttgcatgattcttaattctattttaaaatgtattaatcatatgttatatactttgtgggatgatgcatatttacatatacaggttgatgaattctaagtttctaacttaccctttgtctgagagacctgttagcttcactcagcaagtgttcctacacaagtgacatgtataaattggtgagcaaccggaggtatggcatgagatggtaaacggtggcaaaggaaagtaaaattgttttcatacataccttacgttgaagatcagagagctgatccagcatgaactgggtctgtaaatcaaggaaacaaacttaacaaaattacatacacatactacatttttacttagaaattacacattttgagattgatatatctatatttagaattatgtaacgagtttctcctcttcactaatcaatagagaaattaaagaacagtaatttccttgttagttactttaccctttgaattttaatggtaataatgtgcccccaatacttgtatttccatttcttacattactcagagcatgacttaaataacgctctcaaaatgggcttgaccatatagacatagggatatttcaagattgggctcttaatatgttcctagatctacaatttcatatgttaattggcaaagaaaagttggaaacttgagtacccttgttgatcttatttgcttcaaggacgaatctagctgcctttcaagagactcgagctctttgctgcttaaaggaccaagatcttctcccataaggttcctgagagggtaaaagttaaatacaacacaacattgacttggatgctatatagtatcaaccaataatcatgagccatattattagaaggcccaatagggcatccgtacctctgggaccgttgtagggcctcataacgtgccttcagcttcaagtactcttgttgactgcttaactcctatagtcgtggtagcaaaatcaaactatatagttaaaggaaaaaactatataattaaaggaacatatatagcgattccttttatgtttttccttagtgacctggtcaagacaacagcatttctattcgagcaatattctacttgcaaacctctcagctatcacaaagggttggataaaatatgttttatagtctttgaaacatagttaaatttagtttttttttttaatttttctaataatactaattttattcgttataaattttatttttataaaaaaattattattacttattgatattgtgacatatatccaacacgttacaatatgtgtcatctcaaaatcatctttaacttaacgtgaatagtcatatattactcaatgctgacattcagagacttctaaaaaaataaatttatgagaattaaaagtaataaaaaattaaaagaataattgaaattaaatttagtcatatttatagttactaaaaatatttgtgtaagccatagccaataataacaaaagcttttataaaacatatatgctggcattcattttctgagctttatcatctttttnnnnnnnnnnnnnnnnnnnnnnnnnnnnnnnnnnnnnnnnnnnnnnnnnnnnnnnnnnnnnnnnnnncttttttctaggttgaggcataccaaaaacattcaacgtgttaaagtttgataagtcgttgagttgagtagaaaatagaaagaaaacatgcatggaatacacaaaaattaaggaacgatttattcacacgagttgaggaaaaaattaaccataagaataaaagatttaatggattcaattaaacaactgacgtcgcaaatgattgttattgttaaatagggttttgttacaataatactataagcatatttgtaacaaataaaattatgctgatacataaataaataaacatgataatgacgggatgacgtgaatatgtaaacatgcaaacacaagtttaaaacacaatccatgaacatacacactaaattacgttaattagcaatcaataataaaataaggcacgtaaattagatactattaataacataaggcaaattaaatccaccctcaaattaaattttatttttctacttttcttcgattgcgagtagctacatttcagcacatatgttatcgatggccaaattcatgcatagcttcaatccctgccaattttttgttgttacaaaaagggcaaatactgagtatatagtgagctagagtataagcaaagcgttcagaccagagcatgcggttatatatcatagttgcatttcttattgcaacaaatagcattttcaattcctaatttggctctattattgcttaaattaatttacttatcaaagggaaagtcaaacttgattattctaattattttagatttatatatttatgaaattttctaattacaaaatagcgatggctcatgaaacattttttgcacgaaagaaccaaaactataagagcaatgcttattctacaaaacttaatgggttgtgtcaaaaaatggaccttgatatacaattttttgtaaacaactagacaaattcggctcagcacatttagatcggagaactgagagaaggaagtactattggtacatgatactaatggcacacgatcgtacacaaataaaattataggctcacacaataaaagttactataagaacaaaaaattacatccgtcatctactatatggagatattcatgacaatatatatatatatatatatattaagattttattatttacactattatctaagttttaaaattttcaaataatgcttaaataaaagaattcaaataataataaagggtctgctacaaagtgttttactagtatttcgttaggctataattggaggctcgccttaaaagtccttatgaaggacatgggcaccttatgcataaatttaggaaccagatcaaatttatgtaatcaaattaattcttagtatttcgtgtacgttatgaaacctgatttcctgtataaaactaggtaagtgtatggtgctccatatgccaatttgatgatccgaaaatacttccaatttctgtgttccccatacccacctcaaacactggatactttctagccattgcactaaacgggcctagaagacatacagtcaaaagttcttgtgtgtgggaaactatttggagcagttatactgatcatgaataatcttaaacttatttgaaacagcctaacaaagaaaacaagtggaaggcaaatgacttaattttattttggatgaagttgtccttaaagttcatgtatctttgtaacaacatcaccaaaactatggtccactgtaggatcaattttaaatgagcatgaagtcttagatgcagatacagctacaacaaagtttagggtgcctaaaaaatgaattccatgatacaaaagactaaagggacttcgaaattaaaccaatatgtgctgtctctatgatacttttgtccacatgcaattaaaaagtaacgcatattaattaatgcacacttgaattaagtcaaacgaaacacttgacttttgttgttttgacaaaacctcttatatcaaacaacaatatatacgcaagttaatatttttataattattaagagtgtattaactgaaaataagaatagaagtcaaaacaaacacattgtattttgaactttttttttcaaaaatagtacaatgagctaaattgattatactgtatattatgatagtagatttgcatgaacaatattaagctttatttttaaaaaaaaataaaagactttttttcaaatccctggattcagaatttgtagttgcgttaggttattagttaaacgttttacaccacaacaaattcaattatatcagtcaatgaacaaaaatcagcataacttttgtttgctaaagaaaaaaaaatacgttacgatttcagtatttttatttatatccatgaaattctttttcaagctggaactataaggtgattttactgcacttgccagttgtttatgtaatcaacaaggtaaacctctgatcaaccacgagacacagcatatattgacaatgctaaacgtaatataaaacagctataccccacgttaaggataattatagtaaatagttgcagcccaggaaccccaatccccttgtaagtaaaacaaaaacagaaatggatgaggtaataaaatcagccatcaatttaggcaaattaaatgggcaaaaaatgcatttaaatacgatagatgggactattcaccattaccaaggcttcccgtgtagacacattagcctcaggcgcaccatagttacatttctggtatctctctagcgttttgagcatgctgcacgttttgagaaaaaaaatatatgtttgtataagttagatgtcaggtacttagtacttacaaaatgatccaagataaattgagtaaaactagattctacaaatataaattattgctcaaggacaaattatccatttattaagacatctttttacttcaattttgctttaagtccaacatcaacaagaaaaagggcacacattttttccaagcaaagaacaggaacaacttaagtttgaaacgaagaaacccccatttggaggcaaggatgggaatgctccataaatataggaaaaactataagagatgcagaaaatcggtaaacgagctggattggaagatcttatgagttatgacaattaagtaatgttttagttttagggctactatcgaaaaacatcatatgacatcaacctctgaatttcttgaccaggaccagagaaggtcaccgatgacagaatttaagggaccaatcctctatttagatgagaagaatgaaaacaagatgtgaggaaaaaaaaatttataagaaaattttgaagttttttttctaaagttttcatttttgaatcaaaaagaaaagaaaaaatctcttttttttcttctctccattcaacataaaattgtttacacaacaattttttatagtaatactatatttttttctctactaaatcaagtattttatctcacaattttcgttatcttctcttcttatatctctatttagtctgtatattatagcagaaattgtacaaactaattatataaatacaatttcccaattactaatgttaataaattgtacaaaatgggtagtattggatttgacgatgagacatgagactggtttcgttgataaacgtgataatattaggccatcaaaaggagccaactacaaatcaattatcagttatagaaaagaaaactggtgtcctattgaatgtaggtgaggtaagatcatttgcatggagtgccaccttataaacccagaagaaaaaggacggaacataccaagttactaacagaattttcggtacaataatcagatctgaaatgaccagagtgttgcttccacaaagaaaatatacgaattgaaccttcggaagacgcaaaataatttaattatttgaaatgccaaaccaattaaaagaaatcgtctgtctatgcagataggaataatgaggtgattggaaaacatgaatttgatgctgatttaacaaaatgtccactctgatttaacaaaatgtctctatcatgaaaaacgttcaaatgaaaaagaaaaaaaaaaaatcttgtgtcagtagtaacgtggagaaattaatcaatcaagcgattgactccaaagtgagaacctttggtcatgattgtggatcgaaaacaaacaaaccccagagtgtctgtaagtaattgaagcgcttgaccaaaatagaaaatcacgcaagctaaggcaaaacataaaataaattttaaatgggagaaaaatagaacactgcagagatcgatatatggtgagaggtgcaggaggggaaaaaaaactatctagaaataaaaaaaagaaaccctaggcccccccagagatgtggatgagacatacataaaatattttctttaaaaacggggcgtattaatttgacagtgaataagagatgagttacgttgttggagcgatgtttgaagactgaaaccgaaagcaggctaggtgctaaacttccaaatggaacaaaataattgatatatatgcttcttttacacaacacctaattacaccgaaaagaggcctgacccgagactccaaaattacttttgggaaacgcttttgaacctgatctgtttgacggagcagaaaaacggcaatctcaaatgctgggtttagcaccaaaaatgggaaagaaagagaaagctcaagactcacccaaaaagaagaagagaaacgagggcagagaaaaaaagaacataaatagagtggatacaataaaacagtgatcctctcttgcttaatttattttatgtatgtctgttccggtttaacgcgtttccagttgcagatctaacagcaacgcgtttgcagaaaccctcaaacctcctaaaaacgccgagacatttcacggaaacggaaaaacctcaacagtggaaaatgaaaaataaataaataaataaatctacttttctttctttctcgtgttttctcaaacaaaactaaaataagcggggggaaacgccagctgtctggaaacaaacagcaaaaaaaaaaaaaaaaggagagagatttgaagatctttaaaagcaaaaaaaannnnnnnnnnaaaaaaaaaaaaaacttatttcttaacaattactcaatctcaataatactgttaaatgtgcatatcaattgaaattagattgttttagtttagacagtgatattgagtttttttttatgcaagtgatattgagtctgtacataaggcttctaaaaataatactaaatgattaacaaaattgtattttactggtaaaatggaagtattattattaaatataatttcagggtattaaattaacaaaattgttgaattgagtgactccgtgttatgtcataaagcactaataatacatccattaatttttaatgaataaatttacgcctctagtttaatattaatgatgtactaatagtgttaggattgctatcaaggagagtctaaatatatcatctaaggaaataaaagtacaaagtttttcttgtaaaagatagcatttattatgtcaaaaattaatataaactagtctaattaatgcataatttgctaagtgatttaaaatctctaatatggtgtatttgttatttattacccactatccttaattagcaggacactacttaacaagaccgtannnnnnnnnnaaaaaaaaaaaaaaaaaggagagagatttgaagatctttaaaagcaaaaaaaataacaagaaagaggtttttttttttgtgtgtgtgtaatttgtttacattttagtgaatatacatataccttgaactgctgcagaactcgtacagttttcctctattggagaagatgatgagagcaacctcggcatcacaaagaacggaaagctcgtaagctttcttcaaaagcccgttccttcgttttgcaaaggtcacttgcctgttgatcttgttctcaattctcttcaactccactcttccccttcccatttctctcgcttctctttcttacacactctaatatccaataaaagggaaaaacaaaaattggaataataaaccaaaaccctgtgatgaatattttcgtggctcgctcgctccgtgtatgcttgtacacgcatatatatttatatagccacgatgtcaagatcttacaataaaaataataataaaaggggaatattatatatattatgatttgtgaaattattattattattatttgtatgaatgtgagagcaaaaccatctttatcaagccctaatgcaaactccaaaatcaaaaccccttgtacctgtccttttctccctgctatcaccctctggtgtgtttaacacactgctaactccatgacaatgacacgcctaaggaaatcaaaagtttcgttttgtaagtggggaaggcattttctgcgacctagctacacgtaaagtggaccttaggatatacttataataaatttttataatttatatcttttttctatcacatcactagctatatctattttttcttctttttattctaatctttctcttaattaaaatgtacattttaatgtgtgagtaacactgtatatcaaattttaaaagcaaactaaaattatctttatcagcaaaataaaatttattaaacttgggtaaaggggtgccacaacttatgcacatagtatcatgtcattgccttcagtcctagtagattttattatattctctaaacatattttcattgtgggatggattcaatcatggatcaaccgttagtttatgttttcgtacttttcgtgtgagacattcttcgtatcataaaacaatttcctttattatcttcttaaactctgtcctttttaaaaacaaaaaaaaaatgtgttaaataactatttgtaagagatgaatagtatccctaaaaacataaagagatgagtagtaattgtaattacatataattataagaaaatgattgtactaataattaccttgagaacaatgattaagaaatcaacaaataaaaaaatagataagatgcagtagaaacattaatnnnnnnnnnnaaaaaaaaaaaaaacttatttcttaacaattactcaatctcaataatactgttaaatgtgcatatcaattgaaattagattgttttagtttagacagtgatattgagtttttttttatgcaagtgatattgagtctgtacataaggcttctaaaaataatactaaatgattaacaaaattgtattttactggtaaaatggaagtattattattaaatataatttcagggtattaaattaacaaaattgttgaattgagtgactccgtgttatgtcataaagcactaataatacatccattaatttttaatgaataaatttacgcctctagtttaatattaatgatgtactaatagtgttaggattgctatcaaggagagtctaaatatatcatctaaggaaataaaagtacaaagtttttcttgtaaaagatagcatttattatgtcaaaaattaatataaactagtctaattaatgcataatttgctaagtgatttaaaatctctaatatggtgtatttgttatttattacccactatccttaattagcaggacactacttaacaagaccgtaatagttcaaaattacatcgtagaaagtttaaagaataatggaagaaatcataaattatgttagaattgatgaaaatatgattaattagaacgaagcgaaataaagtttcaagttaattcatcatttggatttttttttaaaaaaatgaaatagaatgatgaatgatgaaatgaatttcatctcatttcatccaaccctcataaaagtatagtatatattactttttacttgtattcaatcgcaattctattcttttaaaattaaaaactcagacacaattatcatttctacgttgcattttttacaaacacgtctacctacttaattactcttgcagctagcttgttacttttaacttataagagtatcaacggaacatgattgcttaaatggattgtaacttgtaagtatccgcgttgaagatattacaaggtaactaattatacttcattaacttgccaaacaatagaatgaaaaaattatttcattatattataaaatagctataaaagtattgttttatttaatttattttactctgttatgtattatttttccccgctctattgatagttagatatatcttggcgaaacctcaaagagaagaggtgagccccataatgaagatggagagcgaatcatagctagttctacgtgtcaaaagaaaaagatgaagacaagctgatctatacttgaacaatatcgggtccgtaacttcgtacaatcatgtgaccataccatagtactgcttaagaagtgtatctggacatctcgtactcatagctcgtatgttctttccccaatagatttacgatcactatgatatatatgaatattcatatttttatatacctaacaaattattatttttctcaccattacgaaataattttggttagaagtggtaattaatttttgtagaaaacagtaaacacatataaataaatattttctttttaacattatttattttaaatttaaatatcaatcaagatttgaattctgaataacttaattaaaaaaaaagtcattattatgtcaactttattattagaagggacacaagttataataaattaaactcctatcaaaaaaacatgtatatctatctataaatcatattacctataaaatctatacttttttactttaatttttttctcactaagtgttcattacatactagatgtccatctataacttttcatttacataccccttcaatactaagtagatcctttgttgagtaatgcaactcctctaaaagaatctttttatgattttttataaataatgtcttaattttttacattatcaaataatattaaaaatcacataattttttttactaatgttactgattctgcaattgggtctagtgctaaggcccattaagggatcgtggtcgtaattttcggggacgttccacaactaaccaagaggtatatacaatataaataagagatggttacatagaaaaagttacacacattctcgttctctctctttttcattcacactgtgcacacatctcatcccactgagtattgtttcgtgcatagtgatcatcttctggaagtattttcttctatataaatacctcccactgagtattgtttcatgcatagtgatcatcttctgaaagcattttcttctatataaataccttaagaaataatttgatctaacatcgaattactagccgtccttgttggacactactgttgataaaacaacataacattggggatgcatttaggttgaccccttcccactcaacttattgatttgttttgcggaccaactaacatttataataataatcactttaaaaattatactaataataatttttaattagctaatattaaaatataaagaaacttttacgctgatgctacatctctattaaactttttttattcattcgtttaaaaaaaatgcgttttttaatttgtttagaagtcgctagtgcactttgcttttatgcctttcattttatctattcgagatcaatattcaattctaaacttgttctcattttcgttagattggagaatggatatatattttcgtcccaggagagataagagaaacacgcccccgctctcttttcttgcaaaattattcgtgggtaaagaaacttgcccctacccagtccactttttttcaaataaatattataataaccatattttaattcgaactatataaaagtatataataatattttctagaaattaaaaggtaggtttaaaagaatcaaatcatactactaatttaaatttgtaaggtgttattcaaatattattatagttagtgttatcaggtcaagtttaagttgagtcaggaattaattgaaaattatctgtattctcaaatttactttcgcacctccatttaaatttcggaagaaaaaaaatctatgataaattatacatgccctctaaaattcaataaattacacttagtattattttctttttcacattactttgagttttctttatctatataactgcttaaaatattaaggggtgtttgtgttaatgggaagggtatacatatgttgttatgttattatgtaaattgaggaaagtttgtgtgtggggcaaaaaacaaaaggatataccgagagaaattttaaacttcaagaggtgtgcttggatgaacctaaaatggataaattgttttttttaataaaaaacacattcgttatcacaaaaaggataatagtaatctcaccattaactactttaatttactttaatttaatagtaataaaaatattctgatgtatatggatcattggaattgctgatgtctgtggatcatttctgatgaactaaggtgcgcatgtctacaagggacgaactaagcacttgcaaaatgcttcatttctgatgtatgtggatcattggaattgctgttttcagggtctggttattatctgatttggtggtgtggaaatactctgctgatttttttattataagtttacatatatagtagattcttggtgggagggaaagaatacatcatgttttttttggagggagacagtagttatatgttttatattcttctatttttggtttcagagtatagttataattaagataagaggtgtataagctcctttcttagtgtgtaactatgactctgtcatgcatgttctttacttggtagttgttggtacttctggttccagttgatatatattatttgtctttgttggctgatataaataaataaaacttcaagggtgtgaggaaaaattgtccaaaaatctaatctcgaataggttaaacttagtttttttttaattaacgttgaggcgaaatagagtatagatgagctactcaaatttataatttttttatcatgtcaaagataaataattacaaagtaaagataaatttacagcatacctttttttttctcttttctataataaaatgtggtagcataatgtttttggaaaaaacacataaaattaaagagaagataaaatggtttaggaaatgacatattataaatgattcattaaaaccaactatgcttaaactatgaattttctttttcaagttatactcaagttataagattaactttcttaaacatgaaacaacatatttagattctattcacaaataacgtctcaataactcatacctttttttcacatgcaagcttattgtcatttgtcaaccttttcatacaagtttccgggttcttttaccattgtttctttctaattaagtttgaatggagatcggagatcgaaatacaagtctgacacgtctctcatgtagtgattggcattatctcgatgctttaccaacatcttggggttattcagaaaagaaaagaaaaagttgaactacttctattgtttagttaaatgcattttttgttccttgaatttttaacgttacaagtttgtnnnnnnnnnnnnnnnnnnnnnnnnnnnnnnnnnnnnnnnnnnnnnnncactaattttttttttaatatcatattaaaatttgtgtagggtattggaatattagaataattcttttctgttgtaactaccaactgtatttcgcattttctgttgtatctaccaactgtattttgcattttcagtttttagtaagcttctgttttcgtgattatgcagtagcttgctgactgatataaaaagattgtattcctctttttcgggtaataaagatgaataataaaatttcttcttccattatcagtttgtaagatggtatcagaagatattctcctctaaaatcctttgcttccgcgtttttctccttccttttccattcaacaatggcggcccaaacagcttttccagaaccaataacaaatcctgctaatcctctctaccttcatccaaacgaaaatccttctctaatccttatttctcctcccatgaatggcaagaactatcatacttgggttcgagctatgaaacaagcgttaatatcgaagaacaaatttgctctggtgaatgggagttttcctattccagattcttcagctccaaatttctatgattggcaaagatgcaatacaactgttctctcatggatccgctgctcgctcacagaatccattgcaagatcaatcctctctgttgaacgagcagatagagcatggcaagacttgaaagacagattctcagagtcagacatttttcgaatttcagatttgcttgaggaaatttatcatctacaacaaggtgatctttctgttggcgattattttacaaaattaaaaataatttgggatgaatatgacaatctagatccgataccttcctgtcactatgcatcttcttccttgttacgaaattccagagatagaaaccatgctgtgagatttttgaagggattaaatgacacttatgctgcagttagatcccaaatcatgcttcttgatccttttcccaatataaacaaagttttctcattagttattcagcaagaaagacaatttaatgttgatccaatgcttttatctacaactgaacctcgagcttatactcatagcactgatcatcgaaatagacaatttcaaggccgaggcaggggtcgaggtcgcaataccaagctgtgcacatattgtggtaggacaaaccacaccattgatacatgctttgtcaagaatggttttcctccaggatataaatcccaagttgatcaaaagaatgttaataatgttgattctcctgcaaataattcattgtctgactctgtatttctttcaaaagaagaatattctagcatcattgatttgcttaatcgatccaaggtgactgaaactggatcaacttcatctcacgcttctaatctggtacaagttaatgcctctgcttctactattgattctggaattcctggtaagtcaattgaatggattttggacactggagcaactgatcatatcacaaactctatacatcatttctcatccttttcaatcataaaacctgtttcaataaaattaccaaatgaatcacatgtgtttgcatatcattcaggcactataaatctttcaaaagatcttattttacataatgtcctttatgtaaaagaattccatgtcaatctcctttctgttccaaaattattaccttcttgccaacttatattttctggtttttcatgcaaaattatacaaatcaattctcaacggatgattggttcagctaaacttcaaaatggacttttcattcttcacgaatcattgatgcctcaagtcaatgcttgtcaagcctgtcccactactgattcaactttatggcatcttcgattaggacatatttcacaaaccactatgaaacaaatgtgtataaagtttcctttcttgtcttctcatcatataattccttgtgatacttgccattatgcaaaacaacacaaactgccatacacaaccagtaccacttccagttcatgtatttttgagcttttacatactgatatttggggtcctttcatgacttcctccattaatggtcacagatactttcttactgtagttgatgatttctctcgatttacctgggtcatattaatgaaaaccaaagctgaaacacgttcacatttacagaattttattcaatatgctgaaacacaattcaaaactcatgttcggatcattcgcagtgacaatggtccagagttttccatgacttctttctttaaatccaaaggtataattcatcaaacaacttgtgttgaatctccacaacaaaatggtgttgttgaacgaaaacatcaacacattctaaatgtcagcagagctttattttttcaggcaaacacaccacactctctctggtctttttcaattactcacgcagttcacttaataaatcgtctcacaactcctcttctttccaatcgcactccttatgaggttttacatggaactcttccttcacttgaccatttgaaagtttttgggtgtctctgttatgcaaacacattggtttctaannnnnnnnnntataaagatggcacaaaaggatatctccttctagatctcatttctcatagtattttcacatcccgaaatgttgttttctatgaaaaccaatttccgtttgccattagaccttcttcctcatcagatatttcaaataatattcaaaataatctttcatctcttgatcttgatttttctaataccaacccacaacctttatccaatacaccaaatttagatttcactactgaaaatcttgaaccaacagcaaacatatcagattctcctactcatattccagaaatacctgttaggagatcagctcgtactcgagttcctccaactcgattacatgattatgtttgcaattcttcaatcaaaataccttacccacttaactctgtgatgtcctttgctcattgctcaaaatcttacacacgtttttgtaattcaattacttcaaatgaggaaccaaaatcatacactgaagtagccaagcattcttgttggcaggaagcaatgcgtgttgagattgcagcccttgaacagaacaatacctggactatagttgatttacctccaaataaacaacccataggatgtaagtgggtttataaaattaaatatcgagctgatggtaccatagaacgctataaagcacgattagttgctaaaggttatacacaatttgagggagttgatttctttgatacattttctcctgttgccaaaatttctacaacccgtgtactgctttcagtagctgtttcacagggctggattcttgagcagcttgatatcaataatgcttttctacatggagaattagatgaagaaatatatatgatgcttcctccaggatctcgttctcgaaattccaaacaagtatgcaagcttcaaaaatctctatatggtctacgacaagcaagcagacaatggtactcaaaactatcacaagctcttctgtttttaggatataaacaatctaatgcagatcattctctatttgtaaagattactgcaacatcttccactgttttgttagtctatgttgatgacattttactagctggaaatgattctgttgaaatacagcatgttaaatcatgccttgattcccaattttgtattaaagatcttggtacattgcgatattttctgggtcttgaaatttctcgatccacaaaagggcttgttattaatcaacgaaaatatgctttggaacttatccatgatgttggtctcttaggtgctaaaccagcttccactcctatggaaccatcaacaaaactaaagtctgatacaggggttctttataatgatccttccaaatatagaagactaattggtcggctgctgtacttaaccataacacgaccagatatttgctttgtagttcaacaattgagtcaatttatgtccaaacctatggattctcacatgatagctgctactccggttcttagatatttaaagaaatctcctggacttggtctattttttagctctgccaactctatcattccatcaggtttttcagattcagactgggcttgttgtttggagaccagaagatctattacaggatattgtgtttttataggatcatcacttgttgcttggaaatcaaagaaacaaactactgtttctcgatcttcttcagaagctgaatatcgggcacttgctagccttacttgtgaattacaatggttgtcttttctttttaaagatctgggaatacctttatcacaacctatttctgtatactgtgataatcagtcagcgattcatcttgtccataatcccagctttcatgaaagaacaaaacatatagagatagattgtcatgtaattagagaaaggattcagactggtttgatccatttatttccagtctcatcctctacacagcttgcagatgttttaacaaaagccttgcaaccacatcaatttcaagatttcatttccaagttgagccttcttgatattcatgctccaacttgaggggggatattggaatattagaataattcttttctattgtaactaccaactgtatttcgcattttctgttgtatctaccaactgtatttcgcattttcagtttttagtaagcttctgttttcgtgattatgcagtaacttactgactgatataaaaagattgtattcctctttttcgggtaataaagatgaataataaaatttcttcttccattatcagtttgtaagatagggtcaattttaaaataagaaagagtgaatatttattttagtttaagatattcctccaaaatattttgatactttaaattcatgaatctttttctttacttctaacccattcacaagggatcacttgatttccatccgtattgttttaggataaaaatataataacatatatatctttaaagggaaaatttaatatatatatatatatatatatatatatataatattataaatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataataatatataaagtaaattatgattatttaacaaaaagtagataaacatttagaaaaacgtaagtaacaaaattatatttttatgacttttattatctttaaattttaaatgaacggtaaaatatatgtacaattttattcttttcatatttatcattaaatctttaaatatgagtaattaattatcacagttttaagaaataaaatagaaaatctctgctagataatacttagtttgcgggacctattagaacttaacaagcaaatttaatttcaacacgactgcaaaattctatttttgttttggtacttaattatcatacacctcctctttaagtgaatctatatatactaaactctgatttcgatcccttcttctgcgatgcatttataatttatcttatccagtgttgtgttgcgtgtttatatatatatatatatgctggcttccgttgatgtgtgctgtagagaaactagtacgggataaaaatgacataaaagtttagtagtttacatattctaccatagtagtttataagggtttatctaaaaaattcattatgattaacttcaatttctaaattttgaaataaatgcctggtatccgtagccacattaagttttattttacggaactaacaattaaaagcttttaaattaattccaccatatattcctgcgaagggacatttaccgaataccgacctagctcttggaactaatttagaagagttctgaaaagggttggagatcatgttctgtttcatatgaggagggaaaaacgtacccctatcaactagacatgttattacctttcctgccaaatcatgcgcttcttggattgcagttcttgataccttattttatggaaaattttggaaaccaacatgatggctgcaattcatgatatgccaaatcggtgctttgtcagaagcttacaatgaaagtaatgtgtggtctttgtgtaccaaaatcaattaaaataagaactattttagcttgaagaaataattaactttagccaaatatgttttctggcactagtagttaaacatgtgtataacgggttaatatcaaacgggaaaccgatatagaatcattttatatttaagtatatagccgaacttcagtcctcatatttgactctattcttattcatgatttagttcaattaaaaggatattcatattgctcattttgataagttttatttttagttccacgtgtattttttctgacaattttattcgaaactatctgatacactggatgtggatattctctctcaacaaagattctaaccttgcttcaatgaataagttaattgaaaagaaacatattttagcaactagctagagtatttattaaaaaataaaatgttaagtgttgtgattattttttttagtataatttatttttgacaaattttaaattggagatatttcaagtttctattaatactataaaataatttcgttggtataaaacattatatactatcaaatacaccaaatgctagtatgataaattatattatagggcttcaattacaaattgtttaatttttcaatagacaaaaggttatacaacaataaatctcattccattagataaggttatactaataaaagtagttctaatgcttgatagttatttatttattaataaataaatgaattttttgtgtgtgtagatatcataaattatgcctttgttataagtggaagaatgtgccaagaaataaatattgttcaatctcataggtttaaaaactatttttgtctaaaataattgttattttttatttatttattattaaaatacatgtttttttattttttccattttaatttttatgagtaatgatataattagcgagtagcaaagtatcattactttatatgtcacctcttattcttgacttataatctaccacatcattaaattcattctattagaggtatatattattcgttttgcctgacataagtctcatgattttttccttaaaatgcataatggattaagaggcaacatagcggaatggtaaccctccactggaggctaaagggagtgtgtgtctatagtttatgtgtgtgacctaaaccctctttttaatgttaaggctctaacttgaaatcgactacatatatcgttaaacttatcacatttaaggcattgtctattatgactcacatgtttcttacaatttagtttttaaaatacatctcaatagatcaaagaagaatgtttataaactaagaccttgactcctaatcgtcatgagactttttatatatattgaaatagttccaacctttgcatcatttgctcaacatattcaaggtattgtccacatttcaacgaatttaaggataagtgtgtctatagattatcattagttttaactcctaaacaacttgaaactttttttatatataccaaaacactggtttataaaataaaattaatgataacaactaaaaacatatattttaataagacacaaaaccacatttgctatattaattgcaccatcaataattttatatacaatgatgttattttataaatcaatctaatcattgaattttaattatatattactaaactatttctatcaaattttatcaaagttgaacaactataaatatgtaattacatttttttatttttatattctaaaagtaaatattacataattttttatgtatattagtacaatattaaacaagtttgaattaaaataaaatttataaatatgatacgaaatttcaattgatagtagattttgagataaaattattcaataatacaacatacaatttgtgtatgtgatattggcatgattaatattacacaaatattcatagattttcaaaagttaaggcaccttatcactctcctttgcagcacatgggtaagattcgattttacagatctcctaactcctaaatatgtgatagtggtagggaagtttcgtatgtgtatttaagtctaccctggacgctaaatctgacgagttgattatggatgcttaatgttagctttcattggattcaaagtaaaataatgaaatgttaaatatacacatcatctccatccataataattatttgattccaatccagtcctcttctgtgttctaaaactatccattaccgtatctccaatagtaccacatatatatgggtattggagtgctatgtcttaattcaacttcatcccccaaataaaagcatatgtccaacgaccaacactccacatttctttgaattttactacccaagaaaaatagaacgtgggttgggccattcttgcatttcatgcacttgatcgtacatcccagagagagagagattttttttttaaaacgataaggttaagaattagctggaacactgaacaaggtcccatgtggtatacatatatgatatatatatggacatgcatatatatatatactgatgaaccacttaccaatgttgttgttgtgttgaggaggggaggaacagtggaaatgaagtgaaccatgaacaatctgaattggggcatcgaatcgaagatggaaacatcatgggacccagcacactggtgcaccaacaataattaactatgattttattatgtgcatggagcaagatatatgtcaagactacttgggctcgttcgttcggggaaaactgtggtgtggtccaacgtaacaggaactactggctggtggaccatggaattgaccaatcaactggatattagcctcatacaaatatggctctggctctgctttgatgattgagactcccacgtttttttctctttcctctccttctttcttgaaagtgagagcgaaagattttctgtaacgagtgagaaactgtctttagtactatagattcttttgtgtattttactattaaattaaagagtctaattaattagtgttattagtcaaataattaagaaatttaaaagaaaaaatatttattatataaattataagaaaatacggaaagattatgaataacataattttttacttttcaataaaaaaattatactttgaatcctttaatcaatgttcttagatcattagttagtatttgtctaattaaataacctcaagaataaaatatgtttcagctagttaaagtataatgaaattgtgaaagatataatatgaacaataattaatagaatttaattaaaatattcttaaagtataaaagtttttaaacagccatatattcaattatatatttattctttacaataagaatttaattttattacactactatagtatataaaagaaaaaagttgctctatcttaaattgaactgagactcccttaaatccctaacattagagtgagtgtgcttgaacatgcggaaaaaaaggagtggtgggaagacgaagagatctatctatgacactagtaacctaagtgccaattaccacccaactagagtctcacatttcttccaactctaaggttcgatcaaaccaatcttaaaagatcgttgaacttagggcgtgatagagtccatgaagcagggaacaactcgtggccgatattatagtcaatggcaccacctatcatcatgattacaactataactgttttcatgagaattatgataaatacctaggtctttaattttttattattataattgtatatcatatttttagttgttgtaataatgattttttttacatatattatgatttcttatttttttatttatatatgttttttttaaatgtaatttacgtgacttcttaatttattttagcataatgtaatgaaaattaaattaaaaattatttaaaataatcatcaataattattaacaactaagtcatccgtaaaattcaaaaactaattatctaatgtgtgaaccaatgtaactcagttagtttgattaatttgatttgtttaattctaacttcaaataaagcgaaatcaaccctcaatacgcttttatatgtgcctttattttcaattaatttatactactgatactataattttattgtgttggctttttaaaccacatcaatcgctttatgacttttatcttaatatttttttactgtgcatatttttatgcgttaaaattaatgtaaatacaactttccttgtcaattcaacactcttgtcattagtcatagtggcccacgtggtgtggctttaatttgccaatctacccaaccgtcaaagacttattaacactctgtcctccacccgtggaagagaaggaactgtgatggtcaatgtcaaatcatttccaatacttttacaatcttataggctagagtaacgtcattacaaaagtcatgagaataaagccatttttatacttcaaatttacgtatgtataatcatactttacgtattatatttacgtattatttatcgaagacatcatattttcctttgcgaaagttacctccttaagatgttgaaactatataatgtgaaatgaatatacttatatagttatatacgtagtttatatgtgtatatatagtgggaaaaatcaccacacacggacatgaataaactctggatggaacttgtacaactttgcgtctttggtgcaaacaaggaatgtgataaagtcaatataaggcatattctaatttttacatttatctttcaaccgccattgcctctatagcttctttttagttttgaaattttttctctggatcgcaagtcgcaactagggaaggacgctagaagtggaagagcttttgtttctgtgttgggccacaataagtccttatgttgaatcagaccatcaaatcctcacatctggaatacatatattagcaattactatgcaactaccccatgtatagaattagaaacaatattaaagggaagacaactacgtacgtctttgttcttcgaaactagcacgcattttagcctaatttaggtcatgccgcactagactcgtccacgatctaaactattttgaatcccttaattaaatgagaaaatacacttatgatgtgcatgtgttttataaaaatagattaccatatatttttaagaaaaatggataattaaatatcagacaaataattacgggcattacatgcaagttaaagtttgtttgttcaagtttaaaaataagtgataggaggaaaattaatgttaagaaaagagattgaaacaagggatttgataattgaatttttttaattaatgtctaactagggtttaatttttattttaaatataaattcataattaaagatattattttacttcaaaatgaatcggtctaatgaaagaaaattaatcaaatgtaaaataaaaaattccagaatcctatggttaaaaaagaagaagaaagaaataggaaatgatgatgaatgaaagacaaagaaagttgaacaaatgagatggaggtagaactttgtagtatgtggtggggaccatggttggatgggtaagggaaaaagacgtagatgagtaaatagagttgaatgcgtgggtccattgcaaaatagcacatagggggtgtcagaaactctaccattttaaggcgaacaacatctgcatcaacataatagcacgtggaccttattccaaatttggcacttccctttaaacaagtcacgtcgtaattagcaagtgggctcacattataacttgtgctgtgtttctatacgaaaccccgtctctttcgttttaaatataataaaaattgtaagagtaaatatataagttgttctacaatggattgctacctattgataaaggaggaggactagtaaaaattggactaaaactaaatcgaacaaactttcgttctgcttctttttcctttgcgattgaaattattattttcagttttaactatgatttgtttaaaaaaaagaaaagaaaagttaagatcagctcgatggcattcctgagtacacgcctgtgctaacgcaagatgacagtgtatgaatcaaaagggactttttcacaaaaataagaaacaaataagataaaaaattatttacataaaagttgtaatataaaaataatgtatatgggtgatcttatttcttacattggttgtaattataattaatataaaaaattctttttacatcgatcatatttatcacttttttggttttatatgtgttaattaacatgtggacaaacacacttaattttataaaaaaattagattctagtttaaagttttttattataattatttattagtcctaaatgttttcttttttcttatttattttacaatcattaatattagttttctagttatcgtaattaagacggtgatttaggcttttctcattaactcaattgtaggattaattatgatttatgatttatgatattctttttttacctatgtattccttgtctaccaataatgtactgatgtacatggactgatggacatgcgaatattagttcaaattatttattccgttcatattggtgtctaagttcacatccatgccaatgagtctgatgaacatcttatcatatgttgagtatgagtatctcgactaattcaagcaaccaagtaaattttagtaatctttgcataaactggtaattctgtgatttgtctctcttacttatcatatgtcatatcctaaatattgggattctgttgcttctaatcatattgatggtatagcaatctctcattttttttttctcaaaattattacaacccaaaatttctcatcatatagctaaggtcacaattcaagcacgggtcaagccataaatctgtaatatatttacattttgttgtcttagtacccaatcctcctttcaatttactctcaatcaatcaactcattcacactcttgattatttttaatctttactaataagtcttttttttgtatacaggatcagggtatgagataaacgatttgcccaggatatgaatcaaatgggctttactatatattttcaaacttcattgtctattgattgcactgctgtaaaatctccaagcctcatgcatcatcatctaagtcatccaaatttgaataggtgaagcatatggtaatttctagtcatttcctttttatagcccttgaagtgagtctatatctgatcacttatatatttccatcagacaagcaacacttgtctattaaaaataaagatttaatgatagtcattttagatacatttcttgtttgattatcgcgaaagacttattttttttatttgcaaacaaaaaacatgaatataatttgttaaactcaggtatagatcgataggaggaagagggccatctttgtttaaaaaaatattttcttaatttttctcttgttttaaaagtaataaaatttgttttgactaataaatattccttgtgttccaacaacatggtagttttagagattttttttccttttaaaaggtttttccaagattttcatatataaaataaacccatggtggctactccggcatgtttcttaacttaaaaatgatttttttggtttttcatctcatcacaaaccctaccatcacaataacgagaggggacatatcaagtgagaataaaactttcattaggagaaaatgaaatgagtaaaatcttatccaagtgataaaatcataacgagttgagattaaatcacatagtcatgtgattactttttaaaatggtcatgtcatgatcttttatataattaaccatcatatccatgcatgatctatattgaatccaaatcatcttgaatgaacttcctactgagttatcacaaaacccatctataaaaaaaataaagatcgaaaaacatgtacagccagattttattgttaattctttaaataattgtccaagttaaaattactgtaaattatctaagatgattgcgactcacattatctcttatatatacgttacggaaaaaaaaaagatgataatcttaattagcctaaataatttacaagtttttcattaaatattttaaagatatgctagtagtagtctcaaaataagctttatacaagtacaactgtacaagctacttaaacaaaaagcacgtacgtgtgtataaaaacaaatgggatatatatacaagttattataacttgaaaatttttaatatcaatacctcatcagtgattcctgtttggtcatgatcattgtacctcgttgttattcaaactaataaaaaggactttgtgaaaggaggaacacgactgatgctgtactaccagttcacgatggaaaaacaaagttatgggtacttgaaaagttccaaccaccacacacgagaaaagcagagtttgaaaagcgactgcatatagccccactcaatgagctccattattatgttgataacagcggaccccaacatatataaaagattaaattttaccaattttgtcttgaggtctttcatggttagaagctctgatttgtatataaatcctgcaccaaagtctgcccaatgcaaaatatcttgtacatcatgtttcatagtgcatgctagtgatgactgatgagagaggtacacatccaagtgcttcaattatcaaacttggatatggattcaaatcctttaattattgcaaattaattactctgttgttggcatgccacaaaagtaggtgaggctctagagcagattaaattcaagtacacttggtagagagatgagactttaattaaacttgagactaccttagttggagaatataaatatactgggccaatgatcatttttaggtgttcattgaggttaaagcgttaaacaaatttgttcaatttcagggatgaaattattaacaccataattaaagaaattattgaagagcaaggaatgtcattgacccatcagcaatgttacaaattaacatatatcagttaactggtttgaaagaattacagttttgttagcctatcacatgttacgtcagatacaatttcaatttgtctactttctactgcagccataaccgtaaagtgattccaattttcactaagctggttgaaagtgatgactaaaataaatgcgcttctattgccacatttctaaatggctacttccaaaaatatattgaaagagcagcagaaatttatcagtgttaattgatcaattgactaataaaatcccttactttttacttttaagtttttaatgtgagtaaataaaattagagaaaaagagttatatattgattcaatcacaattatcttatgtaaatttattaacttttacaacacattaattattttaaaagttatattaacaatgaatcatgattagatgacaatgtaaaaaatattttacattatcaatgcatgcatgatcattaaattcataaaattattcttgatttttcagaaactaatttctttaaattgtaaaataatgttttgaaacttaacttgataaagaaaatcctattgataattgaaagtaagttttatcaataacaaacgtttctcttcacataaaattcctttcataaatcatctaagttggtgttgatttttcattttttttaaaagatcgatgttaattatcaatatgttagttttgttaatagaagagattaaaatccatgattttttccttgatttttttaatcaccaaattaatcttataattttatttgggattaatatttaatacacaaagacaagaaggtgatttaattggtatggaaagcgaaggatgatatatgtgaggtgacaacatttatttatgtatggaggtttattacataacacatgcaagccgtatgtgtatgtcacatgcattatatgaaagtcactctcaacttgcctgtaactaagagaaaacaaagggttcaaaccccaacacataaagaaattggcgtgcaacggagaaaagtgccacaataatgctgtgtgaatccaaaactccattatggtcctcactctaccactaccaccaacaatacaatggatcttcgaatacaacaaggaaccctatttaactctagactatagattggaatatacaagcttttgtaatcctctctctctcactcactgtcgtaagtacgatgtttattcctaaagagtactcatgcgggaaaaaaaaattagggatggttaatatcataaacattaaaactactgttacatcagttttatttcatgattttataaaatagttattaattgagtgaatttaatagaataaaatatcaatttagttccttttttagtaaatattattatcagtcgttttgaatcatgatattttcttacgaaaaaacaaaatttagtcactaatttaaataatcgtcatttaatttagactctaaaattgacattacggcttgtcttattttaattgttcatgtaaatatttaaatggattttaatttataaatttacatgcacaatttaaacttgtattagttgtataaaattaatcaaacaaaagtcattctttttactttaatttatatagacatgccattgtaaaaaaaaatactgtgaattaattagaaataatccttaatatgactttataataaatatcataaaaatcaataaaattattgaaatttgaaccaaagagttcatatatcgaaaattccattagtgagttaaacaaaagccactttaaacgtcttaggtgacttttttttatgattttatgagtatataaaattaaattggcattctgtaaataaagtaataattaaaataatcttatcattacttgttacttttgtaattgatcctgatagacggttggattaattatttttgtttttttttcagttataattgtttattgattatgtgtaagaatgaggagttgagtttatacccactcaagaatttctcttcagatttgtcactgtccctataaacaaccatcttaagttggcagatagctgaatttttttaagtatattattaggagtttgatttttaattatgtgaatgaaaaatattttgttgaaaaagataaactttattttagtgatttatgtttaaaaataattagtaataataataataataataataatatatacctattaataaagacaattatctcattttatatacacatttgttatttttgatttactcttcaattaatttttaaaatcatccataattacaagtagtttttgtatactaacttttcaatagtacagttgttataattacatataagtaaaaaaaagataattaagacacggagtgtttgtttttcagtagtaataataatctatacctattaataaatacaattatctcattttgtgtacatatttattattcctaatttatcctttaactactcttaaaaaccatctaaaatgacaaatagttagtttttcaacacaacagttattacaactacatctaactaaaaaaagataattaaggtatgaagtgcctgtttttttaactaataataataataataataataataataataataataataataataaaggcttcatatgcttttgatgatggggttgttaatggatgctccatgcacatggaattttcatgaatattattctgttgcacttttctccatccatttatgaggtggtgaggtacttgacaaagacagcatctatggcatgcgccagatcaatggatggagataaattgcaaagttagagcgtgttgccaaaatttcttaattatgataaattttacctgcaatttatgcatggctgaaggaggatagtttgattgccagccacgaaaatagtagacatgacttccctctatatcctcgattcaccatattgaatcacatgcgttacatggttgcttgacttatcaacatgtgaaacctatcaatccttgttgcaatccacaaaatttttcacatgtcaaaattagaggatttttttttgtgtacttgtaaaaaaaaattctggggtacataattagagttgctaaagacttaaagtcactttaactcgtcaccacacattacacatgggttgatttacttttttatatatatatgagaggactctttttcatgtgaaaatgagaatgaaaagaataaataattgctattaaaatttgttatgaacagctaaaatttaaaaaaaaaaagtttttcaattttttaaaaagaactatattatgttttcgttcttttattttgaagagaattatttaatgcttattttgacctaagcaaaacttatccttttttttcttccttgaaacagaaaaagaattaattttttttatccataagaagttcaagttagatttgaaaagttatgggttggctcaataaaggggggatccggattgatttattgaattaaacagggtaaaacaattcattgtcatctaataccaattatcatatataataagtttatttattttacaataaatatcttaaaaatcatttcaacgataaattataattatgttaatataaaattagtttacaatgcttaatatataatcattaaactcattattctaagtcatataaaagatgtaataggcatatgaatctcagggaaaaagaatgaaccatttataattcataaccattttacggaaaaagattaaagaatgaacattttactgccagcacctgggctaaaaaaattaaatgattaaatcttctgggtattataagtacataacatccggaagttggaatatttgtggcatcatataacccatatcaaaagttaattgcacctatcttccttgaaaggttcccctgcctcatttgagttgggaaggcttaaatgattgccttaggatccgatactccaccatgattcatgagtgtcatttttatactgtacagtttcatcgcataattatgctacaatacttcccatttcacgcctacctgaattaacagggttacatgcaagtgtttggctaaaagatgaaaagtatactacaaagaatatctagttgtgccgtattttcaaccagactttcaggataatacatgactcgaattccaactcctgcctccaaactgctttggaagctacatttaagattttaccacattgtctctctctgcaaatccatgactagaggcaccaacgtgtgacacctatatgaaatttaaaatgtgcaaaatgttcgttagtttatcaacatatattttaatgaatgcaaacatatattatttcgatttacaaaaataagtagcatattttttcagcttcgaatacaaccagaaggaaacagaacaagaaaggtactgaaaacaatgtggaaaaagaagacagaaggctcaaaagtcaacctgagaaaggccccagcaccagtcttctgcaataactaaattacttaggttgaagaatccttctgcattaaaaaaataataatgatgaagaataaataattaaatatcacgttatgtgagtaagcagagagcagattacaaggtattcaggtcagcaaagtcagcatcagcaaaaaataaatatcacgttagtgatactatttactgtattataagggtccacctatatgttgcacgtactgtggtatgttggaattacatactccaaaaccgttagaaactttgactaaccaaggggtattgcagaactcttggggataataacaattgcatttatccaccgatattgactatctccctcttttaatagtggaaattgttataatttgatattaaacatatccttcagttcaggtttagtgtgttgaaaggcaagaataaaagagaaaagttgtcttccaaccaggacacgtgtctatctggattgctatatgcattgctacatctacttttgtgtatataatcttgccattcttcattaaacatcgaaaagattaggtgggggactttgcagtttgcaatttattatctatccaggatatgccagtagcttattatgattcttgtattatattttaatgcaagactgctttcactgtcgtcatgattaattgataacttgatgtatcgttttcagttttcacattcatactaataagaaatgtataatcacaatacaggcgacaagtagtaggcttatatcagattacacttgtcgactgtattatgaagagagagaaaaaaaaaatgtattcaacaaagacattgcatcatatcagctgtaattaacaagtatttggtttgaatcacaatttgtaaactgtaggctacctttggctttaatatcttttgactgtcactgaagtattgatttggatggttaatccctgcatcacacggcatgccatgaagagcttcaaatgtcaaggtgcaagccaactgctcaaacgttatccatataatcagatatcaaatccaaaggttgaaaattgattattgaagttcagcgggttgtgctaagacctacctgataatgtctatttctcactttgtccatcacatcttccatcgctcggctgtttacccccattctgctgagagcagctcttagattctcttcactattaaattcaaatagcgtcaattaaatgtcatatcccaatgtccgtacaaaataaataaaatactgtccagtaaggaatccgaacagaataagcatttccaacaataattaaaaattagtaaattataacccccttcaactttgtcagatgtgcagcttactccctgtggttcgatctacccctcacaactatgcatgcatatcaagatcaaagaacatgaccaagaatagagccaagctttatgctatgcccaaattacaactaaaatattcattacattaacagagtacagacatacgaaagtcattatttctaaaacagtgtagtacgttgaatttagagagggagagaaggatgaagaaagaacagagttttggagagaatacagaatatgaatgctttcttatttaagagagctgtagtgcataggttatgcaagtgatccacaaagacacacacagacacggacagagggagactcctaatagatgcagtggggattattactaagctgatattgatttagtgcaacgtcctagacactaatacccataaacaattagcattttaacatgagatacaagatattacatgaaaatactatttcttaagtgcattatcattttcaacataaaattactaaatatatcattcaagcacttgtttgctgcctacaaactacgaagtaaaaatttgtaagcataatacaggggtttaaattgctcttgaatcaattcactattaggttcgtcaatgacaaaaatttgttattacaatgattgagttattaataataataatcccgaaaatgtatttagcagaaacagaatgcaaataaggtgtagcatgcttacgtgctttagtttatagtaaaaccataacttactcatcagcaaagagagataaataaatattgtagtacagtcaagagaaacaaataatctgagagaaaatcaaatatagattaataaaatataatactatagttgcacttgcaacgccatagacaaaagtctcctacagaatactgtgtccacaaactgcaattaataacacacttgcctaattacagaccttaatatcagttatactcttaatatataactaattactagttattttctatgaataactgccattaggcagtttcctactaccactatgctcctaataaagaatttttactaattattttctatttacaactctcacgcagcagttactcctgccgtttcctattgctgtctgctagtgtacatcttccaaatgggtggcttgcctggtttgcgaaccgaggatttgcctggttcccatcacaatttcactacagatcatagtctttagaaagcaagacttgtgacaccaaaaggcagagttataattttattaaagcatttatcaagtaaaatatactcgacaataacttatctatttcacatctccaatacagaaagcaaaactatccatttgatagcacgagtattaagagtgacctgaaatgtcgataggggcaaccatgatgatctccagctccaggagttgatgaaataatcttttgacaagaatagggagtataatcctgtaacatccatcaaaacattacttgttgaaactcatcatcatatacatgcattatgcatacaaaaacattgaaagtttgtgtttcaaaaaggaaatcagcaacagaaatatatttgaaacatcccataaatcggtggggaaattcaaaacttacagttctcttcccttcctttccataattatggcgtatgttgtatgcatattgtttctcaaacttctccaaaccaacctacaacgagatcttacatttaattaattgatgtaattttttaaaagaaagaaaaaatctattcaaagaccatataaagatgtctagagagatatggaatacattgtctagaccaggtatacatcttcagaatgatttaaaagtattatgaaataatgtgcaaaaattatcagagtctaaaactgttgaaattctaattcactattcatgtagctgaaaatatataatttcgaatacttccatcgtagatcatgtgcaagaagtgtgcttacctttttagagaactctgacctccaaaatgcaagtgcatcatccagatttaagccaacaccctatttacattatcgagaaaagaacaaaagataagagaataaagaagacaaaaggaggaaaatagataaacagtaatcaagaagtaaacggatgaagaagacatctcatcgattttctcatcaatcacaaaaataaatcagaataaaagtgaaccaaaatgtattactttgacttatttctaacccagcataatcatacaaccataaacccgtgttctttaattgtgccagtttacccagacgaaatgagtcaaagtgtcgaaggctgacataaatttcagactcagggtatcataaatttatgggtataaaaaacacaaatttcaattttctccacttatatcttgttaattacttgaaactaaaaaaagtaacttgaatgtcacgataattccagacaatcattttcctttctccaaaccatgtgtaaataaaccacatgtgaagtgtcaagcctcatttaacacctcaaacttataagcatctagactctacagagtatttttatcatgcccagatggaagccaaacgcaaccttcagaaagaagcctagttgcatccgccctccatgctttaaatgattatcctctttcagctgcataaaaagtggtataaatcaagacgtcagacaaaactgaaatacaatataaggactcaatatgaaaaagataaaagataagtaaaaagaaagatattacagatgaatcaagcaggaagaaacacatgagcataatttttcccaatctctaaccttatcaaataggtgacgcatgcacaaaggaaatgagctcttggcaacttgatctatgtcctttaatgatatatcagcatattctcttgactgcagaggttttcaatcaaaatgaacattgtcaatcctcaaataaatacctaataacagaaataaaaatgaaagaatatactatttgaattacctgagaataatcaggacccagataacttgaggacagagcttccacaatctacatagaaagctagtcaacttttataacaaagaaaggatatattgatatacaagaccaaaacccacacgtacaggagtcaacctatgtttctcttgctctctaattgaagatgtccattttctgcaacaattagatgaatctctaagcatcttaaatcccaaattgcatttaaagaaagaaatcaattttgcatgtgagaaaatttattgagatccaaatgaccaataaaacctgtttgtaaggataagtgcctttgacagctgactgcggaatagtgtggctacaagtgaaacaatctatgaaggaggcaaagttgaaacacaaacaagatttactataaccaatactctgcgattcattgcaagaataaatagtaagtaattacactagtcaacctgattcattgcaacatatgcatatccttgatttataaacactttccgtccagcaacaagctctggaacttcttcaaacggtacctatatggaaataaaagaaaaaatatacaaatgttgcaacccaaaaactgagggagaatgttagagatgtcttctctcacaactagaggtcgtgagagaagacatctctgtttatcactccctctctcacacaaaaacaagcttttgaaaaaaaaataccaaaggataattaattactatttcctaacagttttttttatagattcaaatatttttaactagttaactgctttcttttccttttttgtgaacaaggaagaatcattagaattcaatatttaaaacagtcaccgagttaatatttaaagtagaactgcatgtcacccggtgcatggatctctcttgcaagacaataaataagtacgaaaaagaagattgaacacataccttgtagaagatagcatcagctgcaaaaaaaaaagtaaatgaagccaagcaaaacataggcacgttagatttggaaaagtaataaaaaccaggaaataaaacttgaagaaaaaaaatgaggcataaatttcaaaaactgtagattttttcttgtataatagtagtgcaaatataccacttgaaaaacttccctagatatctttcttcagaaattaacccatgcaactgctagctcactagtggatttacaattacatactaaacaaaatctaaaaaaagatgcgccttcgctcttaggtagcaacagctagttatattcctattcattcaacaacctccagcatggtgcatgcaaatcatttctgctgattcataccaatatgctaaataatcattgcaaaaagaaaaagcaatgtgctcctaccagtaggtgaaggctgacccatagaacgtgcaacttgtcccaatttctcttttatgctctgaaaatccaaaacatcatttctttaggtactaagaggtatttgtaactcagaacaaaattagttttgcacaaatcaacttcatggtaaaattcagattcaagagtccagagcaaaccaataaaacaaatgatgtgactacctcaaattccacattgctaacagccctgtaaggaaggtcaaattcttccatgactgccctctgtgcactcataaacaaagtatatgatgaataagtacttaacttcaaatgcaaaaacaatatagagtaaccagattttacctgagcttcagcattcagaagacgaaaacggtagcgaaagagtgcagattccatggaaagaaaccatttcctcaagtcctccctgggaatacaggcatatattatgtaattttagtatatatggaataatttagaaatatttcttacaacagttttcttattaatttgtctttttcctttctttgatctgggtaaagcatcattcaggattaatacacttacacaaccataaaatatgatcaatatacgtaattggtgccaatggtcttaaactctcatcattaccaatttattcaatttgtagtaatcttccatttattttgatcaggcattattagtcacacaaccgaggattcttttcaatggcatggaacaacagtaaaagagaatgcacaaaagagagagaagataagagctcttacgttctgcaatacaccagacgtagaacaaaatgagatataatatccttgttcagaacctgagttgcgtcttgatgtctcatattcactttccacaggtcctttacctgtacaaggggtgattcacatggaaaagtccaccacacagcattatttcttttttgtcaaccacaagacatgaactaataaattaatattgtcaaatcgagctttttaccaaattctccatttcttccgctttttttccccgcgacataccatcagaaatccccttgagaactgcaacaagcaataatatccatgaaaaacagaccacaaaacttgaaaaatgtccgatgtcaacggaagttaaagaaacacatgcaaacacacacgatttcatactaatttaatatatttaaaataaaataaaaaaacaaatcgcttgcagatttcaggctttcacttcaacatgacactagtttcttaaatctaggatatatgtgtggagcagcggacacagttaaaagcagagcagattatcgaaacactaggcacgaacagagaggaaatttgaaacagatctctggaattggaagaagcggaaaacagtgaaagtatagagatgaagaaaacagacctcggaggcgatcgatggcgaaggactcgaaatcctcgagcctgacttcaagtgggggagcagagcgatagaggagaatggtgggagcagaaacggcttcgttggaggaggacaacaagtttctgcgactctgaggacgaacgatctccatcgctttctttcttctctctgcaacactcccaatcgactgtagactagagtgagcgtgcgagttgcttccctcccaggttctgaatccgcgccaaattatttggccctggggcacaaaatggcgggaaactatttacttttatttgggtaaatgcaatttagttcatttagtttatattcgcttataatttccttctttttatgaaattacatatttagtctataaatgtcagtggtcacgataatttagttcattaaaatcattctttttatgtttacaattatagcctacatgataaagcaaatatataacatatgggactaaattgtcatgaaaattaaaaagtgtaaaacatcacaaaaaccatccctcattcctctcttcttgttgtcgcaatgcacaccattctaggcaccggttgcgcttcctctaatggccacttgcgagagtatagaggtttgccacgcgaccaaaacacgatgtcatccccaccacccaagacctagaatacaaacacgacgcacatccttcccaatgtcgattgcacttctatcgggtgttcacttgcgaatacaatgttgtagacatattttggaacattgcattgacatgtgtttagacatattttggatatatttttggaaaattctattatgtcagtgacactgtggcatgttttggtgtcttttgttttcttggtaatgtacaatcatggtagaaattttactactacttgggaacttgagtatgttatgtgtaatgaataacaattttatgttctatgaatgctcattttagctttgtggactatgtgcatgttatattatttcatggatgattctactactgagtgcatattattagttattttgtggactagtttgttagttaataatatttgttagagattaattttttagtaagtatatatgttttggtggaaattttttagaaggagagttcatttatatgtggtcattatgtttgttaatttgaaaatcaatacattaagaaaaaatgataatttaatccaaaatgaggtagaaagttactgtacacattgtacttgtcacgtggatgaatgtgagacatgtaggctatgtttgttagcagaaacacaaggattttaacggtttagccaaattgtcatggcctttgacatttgtggactaaatagataattttcataatacagagacaaaattgtgagcaagtgtaaagtatggggactaaattggtcgtatactttttttattattttttaggcgtgctggataatggagtgattaatgttgaaaatagaaaaaatcataagttggttatattatatttacggtaataaatagaaatttgttaaaaatattgtaattatttattaaattttatagttttaaaaaaataaaaattatatggatattttattaacatttgtttatacttaagtttatacttaaggattgaattttctctctctaaataataagaactgaattattctactttattgacttttgcttgaacttgcaatactgatgtgttttaacatttaaatttagtttttacaatgaagtatcttgattagtataattgtgtagagtaattgtatatactatttgaatagttttagttttaactttgaaactgttttcaaaagagaatcttacaataaaatatttttaaggcttaactattttttaatctctaataaatattcgatttttatatttgtttttaataattttttattttatgtaaagtctctaataaaataataattttatttttttttttatcacttgtttttagtctataataaattaatgaattttatttttaatcttgataattttttattattatttgtcattagtcgggattaaaacaaaatctattattctattagaaaatataaaatttgttaatttatcctagattaaaaaaattatcaaaaataaaaaataaaaatattattttattagagactcaacgcaaaataaaaaatcattaaaaataaataaatatatatatatttattagagataaaagtatatttaatttttttttaaacattccggaatagtattgaaaaaattcacatagccgcataacgaacacccgtccacgtaacgagacacccaactccgtcatccctaattgcaagagcagaaataacatcatactatcacctgcttaaattttagctatatcaatcagtcgtctttttctttttttagtgtaattagttgggtcaacaaagcaagaaacacacaattaagtatcttgcaatggtataattaagatcagttaggcgccgtttgtgcggtgtatctcccattgattaattttcttctccagggactccccccacaaaaagatagaacaaaaaacaacatccgacattgcgaataaagtgagtagaaatttgtgcatgccaagcattcctcagccacagtgacgacgccatatatattccaagtggaacctaatattcaaatcgtatcgtgtttactaaggtataaataactccacaaaatggtatgacgttatatattgcaagtggaacacctaataataggcaaaatggtataacattaaaatcattcatatatatattgcactttaatgtcagaccgttgtttcgggccaaaaacttggatagtgttttatgttgaaattttagaatcgaatatcaccgctattactgatttgaatctctcacagtggccatcatattttttcctgtaactaatgcaactcttttttgttacatttaactaatgtaattaactttgcatctagcaatttgataatccaattcagaatcaaatcaaaatctgggttggatggttaatggaaaaaggaagtgaaaaagagttatggattcgatcacctctactaacaaaactaacattgcaactaacatttttcgatataaaaaaaaaaaaaaattacattgcaaaaattaaaaaggtgaaagaatataagattctctccaatacttgaagccatctcgctgaccctttcagaatatttattcaactataaatacactcctttcatgccatttggttagcaagtctcagcaagcatcttagtgaaccttgcttgagttgctattgcttttcctaaactatgggaacttgatatcagtatatatgttgaccaacatgttgaaatctttgcggaaaagcctaagccttcaacagaaatgtctccagcacaagaaccaagttgataacgctgagtcagtgcatggtgcaaacctggcaaattgcattttttgcgtggaggaaactaaacaatggaagtgtgaccaaaacaaaattgaggatacaaagagtgcagaagggggcaccaatttagatacacagcatgactctgaagtcaattgttctttcactcatgctgtcatcaatgtggtcgggatggtaaagtttgcactgttgcttacgtaccatttgaacgaacatatatgaatgtgcccttttagtctttttagctagttactttcaattatatcatattattgaataaattagcatgttcaatctccatttggccattacatttgctaaggattgaaaaattgcatggaagtatgaaactgaaatcatattatatttttagaatcacaaataaagcctacatttatttcagtcaacctttgagcatcatataatataagtcttatttcaaatttcaaatataaccactaggtgaagataagtaacatgagattcccctacagactacttatatacacgagagaactctttcaatgatgctcatggcaagattatcatttttttttctttaatctaacagaaacttctataatcacccactaattgaaaattaagaataataaaggatctagtgacatcataattaattgtaatcgctcagtattgaaaagtcaaaaccgaatcgcagcatatataggaaaaacaccttaagtatactttagcacatataatctgacactgtaaataattagttggaagttttgtatgtttactccaatatactattcgatccctatatatacacacatgcattcgtacacacacatttatttatttaacatatggtataatatcttgcaggtctggggcaattatcaactccatatgctctagacaaggagggtggacatctgcttttttgcttataggactcggtgtgatatgtgcatatagttctcatttacttgggaaatgactagaaaagaacaccaagttaagaagttacgtggacattgagggtcatgcatttggtgcaaaaaggaagattcatagctacaactttcatctacatggagatcttcatggcccttgtttcctacaccatctcattgcatgacaacttgaattcaatcttctcagggatgcatctgaagctgcaattggcaaaactatctaaatcatagctcctgatcattggtgcagtgttgattgctctgcctagtttgtggctcagagatctctcttccatatctttcctttccaactggtggcattctcatgtcccttgtcaattttgtgtcagtagcatccactccaatttttggacgtgttcaagttaatcataagatacccctcctccacctccacaacattccttcaatttctggcctttacatcttcagatgatgacacattgtataaagccatgaaagacccctcaaagtttaccaaggtaaataatatatattatatgagtttaatgttgatgaatatttttacattattaactaatttaaaaataactttttttatatgacttttaaagtaaaagtttattaaaattcattgatttttttttaatgtatggtaaattttttaacatttatagtaattacctttaaaaaatcatgttaataataatttcttattgcaagaaaattaaattctttgaagtatttgttttttgttaaccctttaaagtaattagtacaaaagttaaaaaaaaaaaatcaattatattaccatctatgattgactaacaaaattaaattcatatgatgtatgcatagacagtatagttgttcatcaattgcttaagaataggatgagaaaaaaaatcaacgagtgagattatgcttaaaaaatgaaaagattaatgagatgtttttattaattattatttttctaatttttcaatttgggaattcaggtatctatagggagcttcacattagttacattactttacacgaccttgggtttcatgggtggcaatatgtttgggccggatgtcaattctgaggtaaccctcagcatgccaccaaagctttttgtaacaaagattgctctgtgggcaaccgtggtgacgcctataaccaaatatgccctggaatttgcacctttcgctattcagttggagaaaaggcttcccaagtttaacagtgacaggacaaaaatgataattaggggcagtgtgggttcatttttgctttggttatactatcccttgctctttcagttttgagcatgtattcagcctcactgtttctctactaagtgttgcaatttgtttgattttcccatgtgctttctacataaagatttgttggggtcaaatattttggcctctctttgtcctaaacctctctgtcatcacatgtgggtttcttcttgggtcatgggcaccatttcctcctcaaaattgctagtgaaacattttctacaagctcaatctgcttgaggcaattggaatgattcagcacatgtatactagtatactaggataaggatgtatgaaaaattgtcataaaaaaaggggaaatcactatacttgtttggtgggtactgcgtagtattacatactttgtacctttagacaggtaatatgtagccgttgttttttttttttttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattcagcacatgtatactagtatactaggataaggatgtatgaaaaattgtcataaaaaaggggaaatcactatacttgtttggtgggtactgagtagtataacctactttgtacctttagacaggtaatatgtagccgttggtttcttttttttttttttatcattgtataatgtctttgatattgtcaataaaattcaattataaatagatatattagaagggttaaaataaaattattattttattaaaaaattgtcaaaaaaatatattagagactccaaacaaaatttactaatagaaatttaaatcatatttaagccaaaagttaatttcaaaagattaaaaaactaaaaggttgaaaatattataattcaacaaaggcataattgcaaaatcagaatattaataaaaaaaggaaatgttaaattagaaggatttaaaaatttaaaattttgaataagtgtcacgtgaattaccataaatgaaaatttataaaatatatagagataggtgaatttaatttttatgtatttttattgtaaatttttttgtactaataatcaataaaaaattatgatttactgatttttatgataactattnattaccataaatgaatttttataaaatatatagagataggtgaatttaatttttatgtattcttattgtaaatttttttgtactaataatcaataacaaattatgatttactgatttttatgataactattctaaaaatcaatacaaatataatatgttaatttataatcgtttgacaatataaaaattctttttagtttcatataccattgttgtccttatattgtttattttttttataagactccttttaaattatttattacattaattattttttgacaaaaatatccttaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgtagtcaataaacaataaatgttataagagtaattttgaaaaataatacaaattatttataaatttaatattattaactaaattaatcaactttcttaacaagttaaaagaggcattaatcgtagtaaatttttatttttacctttgtcaacgcgcaagtgaatttaaatcaactgaatgaacttattgtggacactaattattaattagtaattttgatttgttgacttataactttctttttctggtcaaagacttgtaacatttaaaagttaaaactgtcgtactaaacaatgtagatgatgtataaaaataatggagatctgagtttatttgttgtattgaccttctccacctttagttgtggttccctaccaactttattccaaccgtttttcgttaccttcgttttcaggcccacattcaccgtgtcacactgttcccttatcttaaattcaactactagtaattgcttacacataataaacctctgaattgtaacttgtaaggctcaatttcattggcaagaggcatatagaattatcctcaaagaatagccaagaggtcttattttggcaccacttggaagtgctaccaatagagtttgagacaccactgtgtctgtgattttgaggttgacaatgtctgctgctgtgtctgcaaccaaggattttcccttcaatgctcatttggaggaagatatcaaaaacaaaggaagcaacaaggttgttggggaagcagaccagcttccttacaatgatgatgctgaaggaactgattcagaggcagaggaagaccccaagttggaattggatcttggtcctcagttttccctcaaggaacagcttgagaaagataaagtaacattctttttttcaaatgtttcttcactgccctgccattctttgtatttgtttgttatgtttccaactgttctatgatgaaagggattcaacaatttaacaatttttcttttgtttctcaaaggatgatgagagtttgagaaaatggaaggagcaacttctgggaggtattgatatgtctgctgttggaggtacttgttttccttccattttgtttttcttctggaacaactctatcaaagtatcaatgattattaattaagtggagatgacgtgacataaatagtgcatcagtattgaaaactcttcttgaagattgtcctcttcatccaatttaatttctttgttcatataaagcagcattctcctggttttcgtttacaagatatccctttttttcactcacttgaatcacctttttttggagatgacaaattttgatgaaaaatgttggtctaggatgattttaatcctacctcttgttttaagcatatttgaatcattaagtttgatttcagctccttattatttttgagtcctaaataacctaaaggcaaaagcccttgtattgtacttcagaaaacaaggagccagaagtgaagatagtgagcctcaccataatatgtccagggaggcctgacctcattctgccaattccatttacttctgaatctaagaagagtatcttcacccttaaggaaggaagtcaataccgcttgaaattctccttcactgtctccaacaacattgtttctggcctcaaatacaccaatgttgtttggaaaactgggcttagaggtgagacataaaaccccttttatgttttagattagttaaacatccgtatcttgatcgaattgtcttagttacatgtggctttcatgaatttattgaaatagtagacaacacaaaaaagatgttgggaacttatagcccaagccaggaaccatatacatatgaattggaagaagaaactaccccttcggggttgtttgctaggggaacctattcagcaagaaccaaggtaagaatattaatttacatcatacaatatttattcactgtttgtaataccctccgttctaaaataattgttttctaggttattttatacagatccaaaaaaattaataaacaaataaaagagcataacaattttacaaaacttatcttaatataacattacattgaaaaactaatctgatacttattaggagtattaatggaaaaataattaatattacgttaaaaagtcaaacgtgatatttattttggaacggataaaatgttagtattgttgcattttttagtaggaagaactaactattttttttttgtttcagtttgtagatgatgatcgcaaatgctatttggatactagttaccactttgaaattcagaagaattggcctacacccatctaagattcaatattaactaatttattggtggattttcttcctttgtcatgtatctttctgggggagattgcaatccaactttttgtttattaatctagatagtcaattgttgacatgcatgctacatgatggtgttaatcctctccttctattctatggttccttttctccaatctaataactataattcacataaaaggaaacgctagctcgtgaaaatcgcactcattccacctatgatgcttcaaagagttaattgttattatctgttaagggtgtgaggtgtgaagggatgggggtggaaatggaccccatgtggataaaggaacagaaatcaacaaatatcctcaactactgtttgtgctttctcaagcaaatagccaaaaggtccatcaattctttgatggtccagaagcttttgtcatatgacgaccacatgctgtttgctaacggtggaaatccgaaaaatataaaagaagggaaaagcaaaatttccattaaaataatttattaagaagattgaggccatgaaccaaaattttaatatactgtaaaaggtatcatttataaacattttgaagctgcctttgggcttaaatttgatattctgagttcttcagtaatttgttaatctttgatttgtccaaattatatgtgtgatttcaatataactcttgtttaaaacatttattttaaaatttaagtaaaccaaaaaaaattgtcgactatcgtgtatctgttacttgagttgttttggtgtcaagtaatagttttaatagtattttattctccaccaactctaattctagaactaaacccgtaagttatttctaactaaaaaaaaaaaatattgacctnnnnnnnnnnnnnnnnnnnnnnnnnnnnnnnnnnnnnnnnnnnnnnnnnnnnnnnnnaaatattgacctctatattctgaaatcaaatattgtacgcattttgttagcattgtttacattgtgtttgctagttaggaaatcaaggagaaaattttattgtatttggttaaaaaaattgtagagaaagaaagaagaaatgaagaaactaaaacctcccttattttgtctcctctgttacattagagatttaaaggagaagaaaagtaatttataatttttaaacagtacatattaaattgtcctgtgatattattttatctctgatatcatttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggattgaacaatcaacttttcaattttcattctctattcttggtagttgatgttagtttgtttcacttttcacttttgttgtgtacaatttatatcatatatcaattctcagcctgatgagagttaagagctttttttgtttatctatttatttacagaaaaaaattaaccttaaatatcataatatttacaacaaattctcctcgtatatattatttagctaaccaagctaagcctcttaagagtttaattgataatataaaggagagagaaattttgaaactcaaaaattcaattttcaattcatattcttttttcttgtagtattattttctttcatccaaataaaatatcttaattttaagttataagtgaggtgcaaagaacaataaatttagatgagaagaaaaaattaggaaaaatatatagtaataatttattttcttttattaattgaaaagaaaagaacaaatattttaaaaatatatatcctttcatttatctttcaattgaatttttctctctgttttcattttctttctatgaaacatactgcagaaggttattctgaaaggatcatcgaaagtcaatttatttcagttttgccggcaccaagattttcactcttagcacatttgtcttaaattcttgaataataatttgacaaaattatatttttagtttccaaatttttgaatgtttatagttttggtccttaaattttttgattattagtcaaaattttgaagaaaaaaattacaatatcccaaattcgaatatatttttcaaaacctatcttcttctccatcaccgagaagaacaatccagcgaccctaacttaatttttctttttcttttttgcaacctttcctctttcatttcactgaacaacacgttgaatccaattttaatcaattttatttcagtgcccaaattaagcacaacagaatcccaaaacataaagaataatagaggttagggtccctgaagcttcgagtggttgtacgaggcaacaggtgcgcctatggtggcagcgacaccaagcgaaggagatccagggattcgatgggtttgacatattgcgaattgggtagctataggaagtgcaaaaattatatctttttggagtaagatttcgtgggtggttttcgcaattcaaagggaaaacagtgttgcaaatgtagggattggtgagaaggggtttacaagcaaatgttgtgaagatagagattcaccgtctagtttgtgggcgtggtgttggtgggagttgcggctgggttgagggggtagaggagggcacaaaggggtgaagcatatctggaaaatgaaacccagaaaaaatgaggacataaatttagtttgataagatttttactcctttgtatgcataatgtggttgcaattgatttgtttgaatgtggatcacaaattggaatgtaaaagaggcatgatgattcacggctacgttgttcaatcaatatttacatctttagttttataccaaaatcaattaatttgtagccactaaaaatctttaaaaattaaaaacataataaattgataataaaattaaacgtcccatcaaaatcattggatgtaaataaagtttgaagactttgattgattataaaaatttaaggattaaaatcataaatgttaaaaattgaaaaattaaaaatataatttatcctcaaaattttaatctcaggtgatagatggaaatcaaaatttacacttataatattaatatgcaagatggtaatattacttaccagtggtcacacccgagtttggtcaaaagacaaaaaaaaaaaatagtgaaaatactttaattcaggtgcaagtaactcgagtatattctcgctgaccaaacgagacatacgttaaggttagttagcacttgaagtgttacacgatgcgttgatacccctcttcgcatagcactcctattacagaaatgtttagtgtgaaaccgtgcatgcatcatgcctatataggcatgtttggattctctccaaacttgacttgaaaattatgtttagttgtagttaaattatgttctttaaaacatgtttggttaggagtaaaaaaaagtacaacttttcggagagaattttatattaatgtagacttcttattgagattaaattttcaaacatgtattaccttactttaaaacataattttaactaaaactaattttaacataatcaaaaccattcaaaatcaagtttaaaaactcgtcctaacaaacaccaatgtgtcctaccttctacatgtgccatttttttctatcctgcaaagtgtgaaagcctgcctctttattttttattccgtctccacttgctcctctcttgtagatcacaatttggtcaatggtcattatggtacaggtagccatttttagcgaaaaattatttaaaaaataataaaagcaatggttttgaccattttgttgtcaattgagtcctccaatggtgtttccgttgttaactttttctgctcatttgctgtacactagtcttgttggtcattaaagtttagacccaacgcaattagtggacaccccatcaaagattcctttctttccaagtaaagttgcataatttactattataattatcacaataggaaacaacccttgcaggaattacagttgctacttatcaatacacgaaatataggagattggaatacattttgaggttagtgatcgtttagataggtaaaacattgatcgttaatataatttttaaaataattatcataaaaattaataaatttatcatttatgataaaattattattgaatgacagtatcaatttataacttttttttcattgattttatctactaatatcacaatgatccgtaacattacacaattatctatccaaatttaattataataatcaattaggggcatgtaaaatgaagtataatnnnnnnnnnnnnnnnnnnnnnnnnnnnnnnnnnnnnnnnnnnnnnnnnnnnnntttttttttttttttacttgaaaaaaataacaatatgaagaaagctatacattagcaagagcatgtaatagatatggtcaccattttccatctttccactgtatcctttacctcctctttcttttccttaaaatgattgccaatgcattgattttcaggtggcaaatgtcaagttaaagacatacagaaactgtcctaaactcctaaccctacagatacactattcctgtgcacaaagaaagttggtttgataatattttatggtttaaacacaagtcagttatctgtgtcttttgatctagtgcaacccgcagccaatgcatgcaaacctgtcccaattgactaaacgtaaaatcaccgatataaatttactgctcaagtcacgtaatatactgtttagctccctttcatcgtaagtgataagcctgacagactatacacataggcattgtattaagagatgagagcacgaaagaaactaattttgatcatacaaccaaatatcatacaatcaaaatgaatgaccaagatcaaatttaggaaaataatcttcactattcatatatgtttggatatctaatattaactgctctcatctcttatgttagcatattacatgaaggatcagtgcctgagaagaactaacattgaccatataattaaaatggaaggtcaatttagtattttagttaactaaataattaagataatgtttggtttgatattttttttttttcattttcaaagaaaatagaaaacaaaagtggcaatacctttatttaaaagttaaaaaaaaattgaaaatattttaaaaaataagtccaaaattgaaacaacaaattagcattttttgaaaaagtgaaaacacagtggtaccttaaaatactttcttcaagttttctaaatctttaaaatttgaaaatgaaaattattttcaaaaaatattaaaaaaattatattcactcaaatcaagtgtcacctaaagtatcttaatatcaaaagacttaacatctcttattatcaacttatcaacgactctcataatataacgtttcacacggtgacacttcacttaacatttttgttcatcagactcttcagtaagtaaccattttccagacctcaacaaccagctctgacatcacttaactggtctcaagatagattacaaatacaagactttttagcgagttttatccttactcagacactttttgatttttttttaaaagatcattcatatcataactaattcaaatcaagtacacttagttatgacattcttaggtgataaattatcaaaaagtaaatacatcttgtttttatagataatatcaattaatatctttaaatcattttcaattgcacaatattatacctacacatcatctagatctcattcttgtgtgatttatctagagtattacactcctcactatgcaaaagtatgggaaatttagagaaatgagaaagtatcattatatgcaactttaatgcttgcatatgtacatcaaccgttttagaattcaaacctatcaattacctagacacaactttccagttgtcctaggacttggcatcacccatattaaatttaaaaaaagtataacataatcttgaccatatatatgtataattatacagtcaacgttaatttttctaagccactaaatatgttccctacacacatcctagtgtcttgatacaaaagatttgcaagcgccccatttatatatttgcaaatatatggtttaatttgtgttttcttttttccattttccccataacttattcacgatgatgatttaaatactcaacatttaaatgtatccagaattaacagaattgtcaaattttaattttctattgcccgatgtgaacagccactcattttgtatactgtcctgtacacagcctgtagaaagaatatatacaagtgatcaatggtttcgaaaccattttaagcaacacatgacaaccaatataccatgaatagaatgaacggtaacctgaaatcaccaataatctaacaatgcaaacttcacttgtaatccaatcttaccaccatcagtcactagcttagcagctgttaccaaccaatggccaggagcatcatgtgggcctcgcacaacctcagctgtctccacatatttaagtagtttaccggcacgaactggcacaggtggaccatctggataaactccagagttaagtgcagttggagtctgttttggaggaccagtgttaccgtgctgtgtgaatgaaaatgttgtgctcaaatttgtgagaaaagatgattttcttgaagcctctggtgcagcagtccactctgacttccggatactgcaattgggaatatgagcaaagagaagccgcagatgaagcacattccttggccagctccctttgctaaggagttgtgcacctgttacaatataaacacctccagaattattcaaccagttagggtcatgcttaaccactgctgtgcacacatttgagaatctcttccatctgattcgttccagaaattgatcactggattcattatcatcagatcctcgccacatcgatggtgtacttgaggttgaggttcctgaagagaggatcattttatttgggaggcttgaaacatgatttatatgtaaagcaagtctgtcacatttcctgccctccaagtacatgcgcatgccaaccacaggtttttgttcacttaccacctgacattttgtacaaaataccataattaacaagagaatattgtgtgaacttaagaataagggatcaataattcaagatcgttgagaggagaaaataaaatcagcgaaaatccctaaaaagctatgcagcacatagaatgaagaaaacagataaataactcataggtggccaggagctcgcataaggtcacatgagctcactgctcacattttatgacctgttcgaattgagtgtatttccgagttctgtccaaaagaatcacatcccaaaattattagaggtgagcagaagcttacacaaggtcctgaagctgctgatccactataagcattgttacatgtgttttctccttaactaaacaaaacgcgagaaaattttgaaattgtttcttaaagtcaatttttctcttttttctctccatttcctcttttaaccaaataaagaaaatgcatagttaactatgttatctcttaaccaaacatacactaaaaaatgatctcgtcttaatctttgtccaattaccctttgctacagtttcataataatgctcataagcttaatacctctatagctgggagaattctttctatgacccttgttcaattacccttatgtatggtttcatagtatgactcacaagcttaattgctctttagttagaaaaatttagtaatatctcgcttgttcttataaatagtaatactgttcctccttaaatgtagcatcttcttagacctcattatcttgctaaacaactttgtgaaccaggttataatccttttctcccccaaacagcaaccaaactattcatgtgccttccctagtagcttgagctttgagaatagtcagttgactcagttcataacagggaaattttttggtccaactactttacaattgtccatcctctttaatgtttcttttaccctaaactacagcttactaccaaaaaaaaaaccaataaaattgtaagtatagcataactgcagacaaaatgctatagatagttaaatccaacacaattggcatgcaaaaataacctaggggcttaaaacttcgtagtgttttcaagaatttccttacatatttctcacgacaatttgttcgaaaatatgtaagatatatttagattatcttagaatatctttcttgatatgttcctataggttctatagttctagtgttattatttgtaggcttgggctaatactagtaggactagtaccttacctaattagctattcagataggattattaagttaaagtaataccagattttgtttgagtttggtgtctatgattggaagaatgcaagtcttgtaggcttgggctaatactagtaggactagtacttgacctaattagctattcagataggattattaagttaaagtaatactagattttgtttgagtttggtgtctatgattggaagaatgccagtattttcaaggatacttttagatgtcacctatttcatttttgttttgtggtgcaattttagaagggtttctttattgtgcaattttagaagggtttctttattgcatataaagagattatatcttttctttgctcaatgtatttgggttttcttgttaattcctttcatttgttattattttgtgatttcttttaggaggatatcttatcctcgtctctagtatttctttcataatctataatgaaatttctcttgggggggggggacaataaaacagtgtttctcacaacgagttatctttcggtctgaaaacatcccacaccttgttcaacccctgaatcctaatcctaacttgatgccatttatttcagactccttcctattctctgacaatacatatgaaataaggtgtacaagaaaactcaagggtagcagactaacaggtaaagtaactgattaaagaattaggcaggttaaagaataacaaattttttaccccagctaaatttgtaacataacagaagtgagtaacgggaaaatcctgacactaattaagcaaaaactttctcaaggaaaatattaaactcaaatgtaagagtaaagtctaacacatacaatacttgctcaaacacaaagagtttggttaacagtacctgtgtagagattatatgaagctttggacccatgaaactaaattgcagggaaggggaagcagtctttctattctgatgcctgagaggcagctcacaaaacatgggtgcccattgccttggaatttgaaactccagaaagtattgtaaatctccgggagaaggcttatctgcagagagtaagtaaatcaatggagtgttgtgcacctcaacagtaaagaaattaaacagtggtctgtgcaagaagcgatggcttggaaacttcatgtaaagaaaagcaaaacatacaagaacaatctaagagnnnnnnnnnnnnnnnnnnnnnnnnnnnnnnnnnnnnnnnnnnnnnnnnnnnnnnnnnnnnnnncttcaacttcacactacatacggcttatgccttaaagttcaaaagacatacaagattccccaggtttcctaacacatgtgaaacatctttggtctggattttatggttgcatgacaggcatatgacatctttgttaaattttggatggatgcatccatcaagaggagcattcaattgaccatcttgcttgtttatgtttaaggaataaactgtggacataaagttgaagggtgtaacttgaactcttcctcttccctaatttttatttcggagtttatctacaccatggtgaaaatatataaatagtaatagacataaaatggattaggataaatgtagtagattatagtatcattgtttaatcagattagaacatacagcgtagatacagattgattgcatgactaagatatccacttccaggaattccagtcagaagtgaggaaataggaacaaacttgaagaggattgcttcagggttagacggcactgtctgaagccaatttgagtgactgtgcttgaacatatctcctcctctttttgagcaaataatagtgaggccctgttccaagataaagcaatatattcacaacctagaaaaattatttatttcaaatgaaaattatttccctttcagggcttacatccttgcttgatgtttctgaaatactagtgaattgcattgtgtttgattgcatcacacggttaaagacctcagggacctacatgaatagagccattgcatcagcagaaaaataataaataccttaaagttacaaaagatagcactataccttctgttttccatctactgtcttcctctgtagtaaagaagggcttctgacatctgagaataaaaaatctccaagatcctctaaatgtcttctgagatcaccaggaggaatctttgaagaatgtttttgtttgacacagattacatcttgacctcctacagccatacccactattatgtgtgtaccatatgtctggatgaacctgcctaacaaaattgattagcatcatatacttatcaacccaaaattatgcaccattcaaactgtcaaaataagttactgcatcaaacagttcacccacaaaacattcaaacatgaacacacaaactaacatcaactaataaaagttaattcaagcttcatgcgaaggtaagaagatattaaatcctttaatcaaccagttcatggctaccaaacatactagattttgcagggatggtcataaccataagtgcacaaaaagctagcaacaaattgaatctatcaaattcaatcccattataatctgtctatctaccaggaaacgaaactatttttacaccaacaaattgaagttataaagctaaaagaagctattttaacatgaggaaaacaaagataccataatctgtctatctaccagattgttgtatcagcttagtgtttacctagacaacgaagccggatcccactgagccggaacagacttcttaacctcctcttgcagtatgagtggagaagcagtgaggtgcaaatagtagagtgaaatgaaatacccatcaaaagcaaggtacttggtgtcagcagcatcacgaaaccaatccccactcaaatcaaagagcgcattaaaatagccagaaggaactttcccttgcactgctgatttctgattaagcaactcagacatctgcagcaaggagaaaaacgcagagtttaccaaaaatgcaacacaaacaaacagatcttaattcaaaaacgaaatcctcctaactcatctacagtaacagataaagaaggaggaggagaaaagggacctggttgaattcaagtacatcagacttgaagcgtattctatcccctttatcacaacgaatattctcagaaaccccttcaatggtaacacctccagttccaggaatcaaaatatccctcttgttctgttcatcaagcaccaccaacctctctccacgaattccctttgcgaaccgcaaccgaaaatcgctggccaaatcgaacccttttcctaaagactccaatgccaccatctcaacaaccttttccgccgccatcttcacaacgcaaattcagttcagggattccaaaaaagaaaccccagagagagaaagagagagggagaaagagaaaaggtgttggctttggttaaggttaggacggtgccaaccaaccccaattgaaatgggttagctatgtcatgtggggtgtgggccaaaacagaaaagaagttggctttggtggttttgcggaaatgggtattgttagatgtggattgaaggttcggggaagaagatgggatcagtgaacgttacgcagcttttaatgagggaagataaaaaagagtactttggtttggttgtttggaagagaagagaggcaatagctaaaatagctattgctcctatgtaatgcaagtgtaacgggttgaatgtaattgttggagtttgactgtgtcagtgatattattgtgaaaaaggtaattggatggggaaagaataatttttatatctatctgcgtgtgtggatcagtgttagaaaagaatgggcatcgctctgtcaattaagataatcttgtatttaagtatataatttcgggttaaaaaaaaaactgaagattatgatgttttttttttttattattttggccgttactttactctcttctctctcaatggactttacctactacatcagttgctctcccataacaacaagatgctgatgcaacgtaagggaaaaggggcccgtctcacatttttctagtttcttcgtctgtctggtcaaggacaccggacccttttttctgtgccaatccggaaaatgagttttatacaaatctatatgatgttcccaacgcaacagccacgttttcttaactatgatttacattacttatatgtttataactttatcagtactactaatatcttcctcccatcaaatataaatagtatcataaaattaacaaaattaagagagagaaaaatagaagacaagaagaaaaaaaagttacaaattcaatttttcctactaccaaaattgataaaaagaatagtactatctctgatgctaaatactataagaaacaattacgtagtttgtcaagataaataaaagtaatttaattaattaattttatcaagttttaattttatgataaaaataatcatgaaattttataaattagatggttatttttcaaattcaacaaataaatatgttttattttgtgatagcttttataaagagattcgttcatatcattaatagacctaacaaattaggagtaaaaagaaaatttagcaataaaatatatctatatttttataattagaaccaagaaaatatcttttattttttatatatataaccagagataataaatactagtaccatctaaattggaacaattttgcattaattaatttaagcattcaatggtattatataaatttataaatgaaactatagttttcttaaataatattctttcggttccaaaataattatcattttaatttttaatatagtatttgttctggttctttccagaacacaaatgtataacactgaagtgctatggagttgctgtttgatcactctaactctgcagcttcaaggatatcaatggaaggtgataccttggggcaggagatcacagagatacaccaattgacgtggggtgtgtgctctgtgtaattgaaagagagagatagaatgtgtgtgtgtacctttcaccaggaattactgtgtatttataaacagaatacctcgtaacgggcattagaactgcttcctggattcccggcctcatccagcatgttctcaaagttcagtatggaccaagtcagcctccacgttctatgggtaagttatttgcacgattattcataacaattggacccaggcccaaactataacgtctacgtaatctgaacacgacaaccataacagttgccccccaacccggttatcaagtatacttggtagccgggatgcatcaggtgattagctaccttcagggtaaccattaatccgactacaattagtcggcttcttccgggtagaatactattcggataatcctccgtccgcaatactccgagtaacttatccggctacgttcatccggatacaattcttcgatcgttttggagacgtattcccatgactatgctttgttctgtccactcttggaggcatatgactgtccggatagaaaaacatctccgactagacttttatggatacacgtatccggattctgctgaatgtaactgcatttgaccacatcccaataattgtggtcggatttgccctggacgagtaatgtacccagattgtttataacatatttgaaacggctattgaccttcctgattcgaatcagttacttttcctgcccttaatggcaataaatgtctttaaaggatctgtcacttcatttgcctggtaatgattaccattgtcgtaactttactcccttgccctcataattggacgtgcttttaccatgatacccctatgtgtcgtttcattgtggtgactgaaccgtttccctgcgcctggtggttactgcaagttatcatcacatttcaaattttattttcaaaaccccgtaatcgtgcctacttttttccgtgcttgccacttctgcttatttcctcatattacttcctctcttctcttccattaacctttcaagcatcctctcgtattttctgcaagttcccccttcgttcttctcccaatcatcctttaattcctcattaccgcaggtatcttctttctcctttctttctgtatcatttggtgtttttgcattaccgtgactctgtcagcatcaggatttttagggttgcatcatattttctttctgactttttcttggtttatgggttttccttcgcgttttgtaatcatatcattctccttttcttcgattctcctttgattttccttaacttgccctaagaatgacccctgaagaggaggcagagataaggaaaaagtttggccctagggccgcttggttattgtttggccttccattttcggcgggggaaaacgaaagtgacccccttcgccgtcatactggaggttcttcctcctccggaaaacaaaagaccgccgccgaccatggcggtttagcccctttatttcccccgcctcctccgattcctgtaaaccttaaaccaaggacattgggcccatccttaggtccagcctcttctagaactttatcttctttggactcttcgattcttgggcccaaaattgatactggtagtccacgaggtctctctctaggattcttttgccatcaccctatccctccagttggcctttctccatcttatgatgaggaatcatcttcatcctcggttgaagcaatggaggttgattatgatgcctgtatggattgtgtgtccgaggccattcattatgttcaaataggctccgacgatattgctgattcgattcttagttcatgtcgtcataaccctattttgcgtcctgctttcaagggtttgcaaccaggatcgcatactcattctgttgtcgacggggtttcggccttagtgtcttgtgaatttgatgcgttgtctccaggtatgtttactaacttttatttcccctcttcattttcgtaggtataatgggtgttacttcggaaaccgtggacgaatctgcctctgtagaatcctattcagatgtgcccccagcattagcgtctaagttcccttgggtcacttatgaaattcttcgaacttcttctgtcctcgaccttcctagtatagtgtcgacttcagtagggaagcaagatgggttcgcccttcaagctcccctgcccggtgagcccatttgcgctcaacgggagggtaataaccccaacttcttcttcttttttcaagatgtcataacacaaataggtattacctttcctttttcctcttttgaaatcgaagttttaaatcatctacgggtagctccttcccagctccatccaaatagctgggggtttattcgtacttttgaattattttgtacggatttagggatcccctgcaccgttcctctcttcttttattatttctctccacatacccctagaacgggcaaagaaccttctgaccgaaaagggtggatttcctttcgtagtcagagtaaacggaaactcttcgatcccttttcggactccttccgtggcttcaaggacaaatacttcaaagttgccaccgaacctcatcggcgaccctttttcttgtccggtcctgagtcgtccgatgtagaatgggtttttcccttgtactggtcggatgatcattacaagcaggatcattccaactatcgatttatcctagaggatctttccgactcggatgcctcttctgtcttcgtgatttctgagtttataagcgctcatggtcagcctaaaacttccgactacattggcgttggtcgtcgaaatggtctgctttggtgactacattatctcatggtttatcactgcatttgtattaattatgatgttttctgattgtagccggaatgggatcccgacctcctcctaaagccaaggccgacgtcgcccatatttccaaaccaactgaagtgaagggcaaaggcaagaggccgacgaccgacaaacttagcgctccgtccaaaaaacgtggtgcgcctccttacagggcgttttttgacgaaggtgctcaaaaggcggcgtcagctactccggttgctccactgccttcctcctcggcaaccttgaccccggtttcggtggtcgaaactgtggatcttaccgtggcggatggccgcccacgtactacccccgctgctggctccgagcaccttgaggtgcgggttcgtcggataatgtatggaaaaaaggggttactgaagagttggttcgtttgaccaaacccccttcatatatgctcaagccgggtgccccggtggatgaagaactggccgagctggtccggatcgaggagaatgtctttcgctgtgcttctcttgttcgagcacttaccactgttcgggagaagtatgcatcttccttgtgacatttttaactctacttatactttgtatatatttctaagtgttaatgtcgcaggtacgggtttgcggtggcggaaaaggacaaagctttggaggagaaggacaaagcctgtgaggaacttgtttcctttaaggctcaacttgctaccctccaaacgcagtcggcggcggagcttaagcttttgcgggaggaattacttaagtcccaagccgtttctgcctccctgcgggtagatttggcgcggtgtcaaggctcccttgaagctgccgaccagaaggtggccctcctgacttcttcccttgattctgccaaggccgacaaagaagcctgcgtccaggattacgaaggtcggctagctgctatgaaagcaacccttcgtgatgctgccgaggatggcttcaataacgcccttgagcagattactttcttgaacccccgggtagggatgactactgccgggatgcatttcttggcttatgtcgaggacggtcaactgtttcctcctcctgcagctgaagatccttcggtagtggcgtcagaacctttgacaaccgaagaaccaacctccgttgctcctgtcgtcacttctgttgccgaccccacatccattcccgatccatctcagccgactcccgattccgttccttcaaaggattagggaggcggacattattgttttatctttgtatttcttttctttgttgggcctggtgcccggaacaaatatttatttagtgattattcaagttttttacttgattcataaaatatcttgtgcgcgcatcttttggttccaacgaccatttatttattttatttattgcttgtcgtttgtctgaccgtgaacaactacgctaaaggaggcttccattatccggcctgatcggggccgtttagcgtatcattcacagtcatcgtactacaaaaccgcataaaatgattcaatatcgtggtaattcatagtacttgcatttatattcgttgttacaataacaatatgtgtgtccgaatatgatcagactaacacttagaaattacaacgatataatttatttgatacgatgacatgctcagaaggtaggcttccgagttcgtatttattaacaacgtcttcatcgtgaaagaggaccatatgggctcggatatgtgtattccggacccataccctcaataacgaggttgccttcttctactgcctcatgtaccttcgatgaacagggaccatacggactcggatgcaacattttccgaatccatacccctattaaaaggaaggtcgagactttaactgtagtatttcttcaatttgtcggcattccatgttcgcttgactggtttgccttgtagcgtttccaacatatatgcccctttgcctaattttttaatgacccggtatgggccctcccagttggctgctaactttccatcccgagcgtttttatttccgatgtcagcacgtcggagtaccaaatcggtctcttcaaactgtcgcgggaccaccttcttattgtaagcgtgcgccatctgttgtttcatttttaattcccgggcatgggccgttatccggacctcttcaataagttccgactccaatgccaaaacttcgttgtttgcttcctctccgtctcgtagcatttgactccgtcgccatgactgttgtccgacttcgactgggatcatagcttcatttccataagtcatccggaatggagtttccccggttgacgactggacagaggttcggatcccccataagacataatatagttgttccgtccaggtcgacccgacgtcgtacattcgcttccgtaaagcctttaggattgccttgtttgcggcctccgcttgaccgttggattgagggtgttctactgacgcaaaacggtgtcgtatctggaaactagccatcatctcttgaaattgtttgtccgtgaactgagtgccgttgtcagtaactacttctccggggattccaaatcgagagattatattcctctcgaaaaaattttgcactcgggccgaagtgattgtagccaaggggggctgcctcaatccatttggtataataatctatggcgactatcagccacttcatctgtccttccgccggcttgaatggacccaaaaggtccataccccatttataaaacggccatggagccgaaatggattgcaattcttccggcggggataatacccttgaagcgtgcatctgacaattttcacatgaccttacatgcttggcagcatccgtacccatcgtcggccagtaatatccagctcgaagtgctttccttgtcagtgctcttccccccatgtgttgcccgttaataccttcatgtatttcagacaggatatatcctactcgatccggggccacacataccaacaaagggttgtgcagtccttttctgtacagctccccgtcgatgatcgtgaacatggtcgatgttcgtatcaaacgccgagcttctagctcgtcgtctggtaatgtccccttgttgtgtacttacggcaagtgcaccgatcgttaacaagtaataaagtaggtaagtgagttatcgtctccacagggattagggtaatttttacaataatattaattctaaatgattggaaaataaaacagaaaataagagataattgttgaattgatttgttgtttgaatagaaatagaaaataaatgcagtaaaaatataaaagaagttaccaatggaagaaacaattgtggtcaggcacaatcccctttgttcctacctccttcacttgattggtttattatcgtaagtcacacacatgataaatctttcctaaattcgtaaatcctagaactactatagtcataaccagcgatttaaccctttaattcgatcgagaaacctaaacccttagtgaatctgtcaaactaagtattcaaagaatatatctcatgtgatcttgttaagattattcggagaataagcctttcctaagttagttaatccctaattccttagtgaattaaccctttaacccaattcaaaagaccaattccttggtgaattctattaagttaagcatgaaaaagaacatattataaaatccgtagccatgcatccctatgtctaggcgaagaacaactattattctaaacaggtcagaaattagaaccccaacgtgtccattgcgaatcctaaccctcaatacttaaatagaatagccaattccaaataagaataaaacattgaatagcacagagtagaataaaataatcaaaacagcattagaatcaatatcaattcaagttacagaggagttacatcagttcatggccttcccacaatacaagttcagcctgccataggcttcaagaaaccaaaggctgtcaaataatacattcttggtgaccttgccttgattcttgacttccaatggtgaaaatatgagaaagagagagtgatggaaggggttgatagatggtagagagattgtgatttggatgcttcctagaggcctttatttatagataaatctaattagggtaacaaggcctattttcttgttccaaatctgaatcaaatcttcttaattaaggaaactaaatatatttatagaatcctttaattaaggcaactaatcctaatatagtaccaaatctgaaaatatataatttaaataaggaaacaatttcaacctcacgcgacccgcgcgcgatctcgcgctagtcgtgtggaatggccgaaagaatggcgcttgtcgcgtgggacatggcgcttgtcgcgcggcttggcagaagagaatacccttaatccttgaggtactggcgcgactagcgtggaacaccgcgcgagtagcgtggaactccagattttgttttcttcttttgcttgcctttattctcctcttttaagccctgaaatgcataattggtattgacattagataaaatgaaataatattaataaactagctaaaattaatctaaatcctaattatttaatcaaaacataacctaaaactatcctaaaactaagatgtgtttgcaacacatcaaataattcccagatttattagttgctgtcctcagcaacagacagaactctaagataaaaacaaggatcaacaatcaaacctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattctcaacagatgcaagcataattagatcagaaggtctttgaggcttgtaacttggctgggctaacggtaggaaaatctttggatagtagctaatatgaggctagatccagtcctttaagtccaatcctgtagtcttccattttccttgttcatcttcttcacaatctggtactttattcaacatttattccttataataaataaaacaaaacaaacaataactttctttttgatttttcttttcttttcactatacagcaactttcaaacttttcagcttatagtttcaggcataatatttctgaactggcctgctgcttatttcttctttttccttcataccaattgaattcactttgttttccttgatgccttgatgaacacttccctgttctctgctgtcatgaacttaaattaccttctctagcctcagggaggttggttaatggacatagctctgatttaggtaacagaattgaaaggttaataaagctcaaaattaggtgcaaatggaataataattgaaggtaagtcaatttggccctggttttaagaagaagaaagtgtcttaatcatgtcaatttatacctgcatccagagaaacaattcaagttctagagtactaagaaaatggaatctctcaagaagaaaaataattactgtttggctcaaaagtctcacaggtatttcactcaagtcaatcactattgacttcatttcaagcaacatttcaacttcaacatgcatatcatataccaacaatcaaaatccaatcatgtatcatgcaattcatgctatatttcatttcacacaagcttttatcagagaattcctatccattactgtgttcattcactttttagtctgaaaatttttgatgtgctgcaacttttattgaaataattaactaagaatttaaaataatgactaaaataattaaaacacaaattttctgttgggcatcctttgtgatttaacaaataatgcatatacgaccattcccagatttagaaaattgttgtcctcagcaacaagtgaagtggattaaaacattcaaatcatgtatgcattatttgataaactcaactagcactgagtattagtccaaacataacttatttaaaaccgctaactaacaaaacagttaaactaaaagcatactgaaaattaaaattaaaatagttaaaacaaataagaggttccagtgttgtccttttgctgcagtatgtaacaataattccttactctcttcatcctacagtgcagaaaaattccaatttatacctggtgcagtgggtgaattcccagatttattccattatttgtagctcaaaataaccaccaaatcatgaaactgtgcattagtgaataataatcaaacaaatactagcacagttgttaaaaacaacaattatgtatgtaagtggttgggaatttaaactgctcagaatttcgcagtgctcacaattcccagatttatttcattccatagtttcacataatcagctgtttattattggggttacgatttgtaatggtaataatcagtttataacaaccccaaacaggtctcagacacctgaaattttaacatcaaacacataagccaagctacaaatatcagagaacaatttagcatatagcaaagcttacaaatgtggattcccatatttaaatgcaaacatattataattagaactaggaaccacacgagaattcacatataccatgaatatgcctagcaacaattcccagatttaagtccttgcatgtatcaaaattttcagaatttacttatttcatgcaagcatactccatttgattcaacaacttaagcacctataaaagatgaatctcccattcccagatttgagcttttgatatgttcaaggtatttggttcaaaacattatcaatgcatgccttaatagtatttcatcatcactcaattcatgcttaccctagccattcccatcatgcaattttaattaattgaagctttatgcatatcaaactaaccttgatcttattacaagctaatttttcatataggcattttagcaaacaggtggtatgcattaaaacaaatcaacatagtgtgtgcatttggagtatgtcaaaacccaaaattttatcaaaagaaaacagccaacacacaaccaattgatcatcattcattagtactattcatatttggttctctaccctaaggtttttccagaaatttcattagaattgaatgagaagatgagagtttgatatagtgcagtgcataatcatcccattattgagtttcaaaacatataaggttcagaattcttaccttatttctaacccttatggagttcaagctttgggtcctaagatttggggtgagggtaagtctgagaatgaaattgggagtaggaagaaatgaggtacaaactggagcatttaaaaataaaactaagtctgcgatctcgcgcgggtcgcgccagattccagtgcaagtcctttttggttctgccttaccgcgcgaccggcgcggatttcacgctaatagcgtgggtggacagtatctttggcgcgggtagagcggtgggcggcgcggggtcgcgccagatgccctgcacagtttttcactaagtcctatattttgatttttggattttatggacctactgctatctaatttaacttattctaaagcataaaaatgaaaattaatttatttacttctaaaacaaattaaaaatctaatattaatggaaatacttaattaaatataatgattatatagatagatgcatatgtataataataaagactaggctaacaacttcaaaacttaatcaatagttatgtacattaccaaagcttgtttaacgtcttagctagacgcatcatgctttttaatcattagtggaattaagtggattaggagttttagcattatccacttggttttcaatgtgaggtttcagccggcatttagcaactttaaaaggtttacctctgtctacaggcatgatttctatgaatccaaatgagcaaatcttttgaatgatgaagggaccagaccaacaaaatgatttcttacctggaaatatcatgcgatatgttgctagcattaccttttgtcccggctcaagttgcttctttctagtcttctttttcttggttgtagctttctcaattgcagccaaagaccttttaattgcagattgcaatgttccagctttggttgaacttatttccagcttacctttttgtgctccaattggatgattatcttgctttttaatttgcacatgttctgctggtttttctttatatgtagtgttgcattctgcagcaattcctagtgtttccattgctgtccttgctgcacttactgcagtgttatttactgcaagctctgaggttgatgatatagctgctgctgtccaattttcttcagcaatttctgctgcaccatttgcttcagctgcagtattttctgcatctaaggatgttactacacctgcacaactcatgtcatccagcacatttatcatagaacaattataacttttagatggattagtcttagaattaaaaacattaaaaatcacatattcatcatccaatctcaattctaatttaccttgttctacatcaatcaaagccctagtagttgctaaaaatgatcttcctaaaagtagagggatctcactttcaccctccatatctaaaaccacaaaatctgcagggaagatgaatttatccactttcactaacacgtcttcaattattcctgatggtttccttaatgatctatctgctaattgcaaggaaactccggtggattttaattcagttatgcctaaggacttacacatagataatggcattaaatttatactagcccctaagtcacaaagtgcccttcctatatttatatttcctattgatacaggaatattaaaacttccagggtcttttaatttcttgggaagcttccttaagataatggcactacactcctcagtgagtggtatggttcctccttttactagcttctctttcttagacagaatttctttcatgaattttgcataatgaggcatcttagccaatgcctcagcaaatggaatatttacatgcaactttttaaacatgtctaagaacctggcaaactgctgttgttgaatttgctgtttggttagcaccggatatgggggtttctcaaagcgagagaaatctcattgcttttgttgatgtgcagaatttggctcctcagaattttctgtagctttttcttcatttgtatcagctgctgcagatttttcagcttccttgttgcttgcctcatgctttgttggttcatttagcacttttccacttctagttgtgacagcattgacctgttcccttgggtttgtctctgtggcacttgggaattgtccttgtggcctctctgaaatttgctttgccaattgaccaatttgtatttcaagattcttgatggaggcatcttgatttctgtggtgggctctagtctcttggatgaagtcagatgttgtttgtgacagctgcattactatcttctcaagttcagaaatgctagtgttgggaatgggaggaggttgcaaataattattggacttgtagtccagtcctcctccttgaaagttcctttgataattatttccagcagtataattgtagttcttctgttgtggctgctgctgtctttggtcattccaaatgccattaacctgcacagggtcagctccaacaagaataggacaaacattagaataatgctcaccttggcagtattcacaactgacttgtggtttactggctgaaacttgggctgcagagacttgcattctatctatcttttcatttaatttagccaattgttgggctaaaattttctgttctgcaagcatggcatcactgctgtccaattgtattggttctctctttggcggaatggtgctgcttacgttttcagtgcaagccaaagatttaattagctcataagtttgagctgctgtctttgatctaattgtgcctcccgctgcaacattaacaatcattcgagtttcaggagttataccattaaagaatatccttacctgcttacctacaggcatatcatactgtggacatctccttatcaactcttgaaatctattccatgcagcgcataaggactctcttccgttttgtgtgaagttggtgatttcattcaccaagcggttgtatttttccatggaaaaatattcagcgaagaaccttgtaaccagatcttcccatgttgagatgctatttggtgtttgacagtttagccatctcaatgcatttcccttgacannnnnnnnnnnnnnnnnnnnnnnnnnnnnnnnnnnnnnnnnnnnnnnnnnnnnnnnnnnnnnnnnnnnnnnngggccgatgatttctttcttcttcagccatctctatttctgattccaactctaattcgagaattgaatcaaagtcaaaattctcagcttctcttcttcttctttgtatggctagtcttcttcggatggttctttctatttcgggatcgaactgcaagtccttagaattgactaaacctcgcataaaacttggagaagcaattaataacaaaaattccaatcactaaaattaaaaattactgtaaaaatccgttaaccaatccccggcaacggcgccaaaaacttgttgtgtacttacggcaagtgcaccgatcgttaacaagtaataaagtaggtaagtgagttatcgtctccacagggattggggtaatttttacaataatattaattctaaatgattggaaaataaaacagaaaataagagataattgttgaattgatttgttgtttgaatagaaatagaaaataaatgcagtaaaaatataaaagaagttaccaatggaagaaacaattgtggtcaggtacaatcccctttgttcctacctccttcacttgattggtttattattgtaagtcacacacatgataaatctttcctaaattcgtaaatcctagaactactagagtcataaccagcgatttaaccctttaattcgatcgagaaacctaaacccttagtgaatctgtcaaactaagtattcaaagaatatatctcatgtgatcttgttaagattattcggagaataagcctttcctaagttagttaatccctaattccttagtgaattaaccctttaacccaattcaaaaacccaattccttggtgaattctattaagttaagcatgaaaaagaacatattataaaatctgtagccatgcatccctatgtctaggcgaagaacaactattattctaaacannnnnnnnnngtcagaaattagaaccccaacgtgtccattgcgaatcctaaccctcaatacttaaatagaatagccaattccaaataagaataaaacattgaatagcacagagtagaataaaataatcaaaacagcattagaatcaatatcaattcaagttacagaggagttacatcagttcatggccttcccacaatacaagttcagcctgccataggcttcaagaaaccaaaggctgtcaaataatacattcttggtgaccttgccttgattcttgacttccaatgatgaaaatatgagaaagagagagtgatggaaggggttgatagatggtagagagattgtgatttggatgcttcctagaggcctttatttatagataaatctaattagggtaacaaggcctattttcttgttccaaatctgaatcgaatcttcttaattaaggaaactaaatatatttacagaatcctttaattaaggcaactaatcctaatatagtaccaaatctgaaaatatataatttaaataaggaaacaatttcaacctcacgcgacccgcgcgcgatctcgcgctagtcgcgtggaatggccgaaagaatggcgcttgtcgcgtaggacatggcgcttgtcgcgcggcttggcagaagagaatacccttaatccttgaggtactggcgcgactagcgtggaacaccgcgcgagtggcgtggaactccagattttgttttcttcttttgcttgcctttattctcctcttttaagccctgaaatgcataattggtattgacattagataaaatgaaataatattaataaactagctaaaattaatctaaatcctaattatttaatcaaaacataacctaaaactatcctaaaactaagatgtgtttgcaacacatcaccccttctccaaataacttactattggacgccgccaatcattgtcggtggtgatcatcattatgcacgacggctgtaacgtctgttgctgaattacggttcgattgttcccaggttttttagtgcttgccagttttgacaaaatatcggcccgggcattttcttctctagggatgtgattaaccacaacctcgccgaattcggacatcaattcttttattcggctcaagtattttgccagcaagggccctttcacttgatatcggccttcaatttgagatgcgactaactgcgagtctgtgtagactttcacgttcttagcttcttgctcctttgcctgtacaagcccggcaatcaatgccttgtattcggcttggttatttgacgttggaaaacctaattgcagtgaaatttccgttgccactccttccggattctcaattataattccggctccgctccctttcctgttggaggatccgtccacgtatagggtccaccattctccaattgttgaggcgtggggggtgagttctcggatgaaatctgccaacgcttgagatttaatcgcgtggcgagactcgaatttcaaatcaaatttccgacaactggactgcccaatcggtcaatcttcctgccaaatctggcttatgtaagatttgtcgaattggctggtctgtccgtatgactatggtatggctctgaaaatatggacgcaattttttggcggcgacaatcagggcgaagaccagcttttccaacttttgataccgcgactcggagtcgcgcaatgctcggcttacaaagtataccgacttctgtgtggactccacctctcttattagtactgcacttacggcttcttcgcctactgataagtacatgactaaaatttctcctgcttccggccttgacaatactgggggcgacgccagagatttcttcatgtcagtaaaggcggtctcacattccgagttccattctatgacagcttgtttcttcaacatcttgaagaacgacaatgccttctctgctgactttggcataaagcgcgtgagggcggctattctacccgttagttgttgaacttctttcttgctggtcgggaattgcatatccaggacagcgcggcacttatccggattagcttctattcctctgtgtgttaacatgaaacccaagaactttccggccccgaccccaaaggtacattttaatgggttgagccggatgttaaacttgcgtagtcggccaaaggtttcttcaagatcttcgacatgcttatccacctttgcagttttgactatcatgtcatctatatagacctcaatatttcgtccgagctgtgactcgaatactctattcatcatcctttggtatgtggcccccgcattcttgagcccaaatggcatgacgttatagcaatagttggctttgtcacctatgaacgtcgttttctcctgatcgtccgggtgcattgggtatctgattgtacccggaaaatgcatccatgaacgacaaaattctgtacccggatgaattgtccaccagctggtctatgtttggcataaggtatgcatccttggggcacattttgttcaaatccgtgtaatccgtgcacactctccatttcccattcggcttgcgaaccattacgacattcgacagccaagtggtgtattgaacttcgcgtatgaagccggcctgcagcaactcattaatgtggtcctgcaaagcttaggctctctctggtcccaattttcgtttcttctgttccaccggtttcgaccccgggtacattgccagtctgtggctgcagaattcgggatcgacgcctggtatttctgacgccttccatgcaaatacatcacgatttttctttaaacattggatcaattcctccctctgttcgggttctaatgttccaccaatattagtcacctgaccaacctggtctccaatcagaatctgctcaactttctccactggttccggcctccactcatccgtggcttctcgcatatccaattccaccacatttactgaacgtacacaattatgaatgtcgtcgttagcttctcgttcactttttcgaaccgtattataataacattgtcgagattctttctgatcgccacatatggttaccacctgcctgttgctgcccacaaacttgagtttttggtgctttgtggacattaagatgtcccacttatgtatggttggtcttcccaatatcatattatattgggatggaaaatctgccacgacgaattccacttcctcagacttgtaagcttctctcgttcccaaggttaaccgcaagcgaatagaccccattacattcgtgtttccgccgttgaagccgatcaacatcgttttgcacggtcttaattccttaacgtccaacttcatcttccgaaatgcgttcaatagaattatgtcggcggaacttccattgtctacatacatccttcttacccggcaattgcccaccgtcgctgagatcaccagtccgtcttcatgtctgggtactaccccctccatgtcttgctttgtgaaatacaagagtggaggttctggctctcctgtccgagctttgaatttaggttgtgcctggaccgatagcacttccttcagatattttttcctttgagtggcagtatccccaccaccgcccattcccccggaaatcacgttacattcaaactcgggttctgggaactcgtcattatcttcccgaggtctctttccttcgttgatatgttgattttcgtctcctttccgtttgttctttcttccttgtgtccgaataacatactgctttaatcttccttctcggatgaacttctcaattgcatcccgcagatcccaacattggtctgtggtgtgcccaggtccgttgtggaattcacaaaatcgtgatttatccaatccacccttgttgaaaactgggcggggtcgttcaaccttcttcatctctgtgagtgcgacctccttccagatttgtgaacgggatacgttcaatggagtgtatttctcatatttgttttcgtatcttcctggtcgagatttcggatcattattccgagctcgactctccgggtatcccctattttttgggggtgggcttctcctttcatgacgctcctttcctcgtcccgagttgttgacgacctccatctgttccaactccaagcatttctttgcgcgtgcacgaaattccatcaaagatttcaccgggtctttgtaaatggacttggcaaatcttgacgaaccattaagtccggccgatatcaagtatacgtggactctttcttctagcccatcaacctgcagagcggcttctttgaatctatccaaataactctgcagtgtttccccgggtgcctgtctgattttgtccagggtgaactcggacttcggctgctttttactagtcgcgaagttcaataaaaatttctgaccaaagtcttcgaaattctttattgatctaggcggcagagtatggaaccacgtctgcgccgggcccgtcaatgttgtaacgaaaatccttgatattatggctcctcaatgccccggacacacatctgcagatcgaattcgtcgatatgcacttgtgggtcttgtgttccgtcatactttgataggaatgacccatcaaagtcatccaaatatcgagcgtttacgatgtcgtccacgaatggactgttgttttgctgtcccctgctatatttccgacgatacactggtcctgccttctcgcgaaaattctgttctccagtcgggttcctctcgttgtttgccctaccagtgggattgtcgtcatgttttgctcgaatgtccagattttcgtcgcggctctggtttgtgtcgactccatcgcgtgcctccttctgtgcccggttttgaccccgatgcggctcgtctatcctcctttgatctccggggtcggtatctcttctttgatttaggtgtgtccttagatcttgcggctcctctatccacctttggtcttccgggtcggtacttcttctttggttcaagtgggtcctcaaatcctgcgtctccctctcaggatttgaaagttgtacccgatctgctatcatccgcagttgctgctccaattgtgccgttcgttgcatttcggcacgtctccactcctcattacgttcttctatttggcgtgtaatgccacggatgtcttcctgtctctgtagattttgtcttttctccatgttctcaattcgggttaggattgaattgagaacattgctgacaagctgtccttcgagctccccttcctggcccatccttcgcaccggtggggtcctccgttggtctgtctgagcgggagaggaagcttcgtcggaaacggcttccgtcacatgtacttcttccctccgtgccacattctgattctccggtaggcaaatctctctgttcggcatctctgaatgtggtacggagtggctgtttcttgtgtttaccattattgacaagcgtgggactcgaagtttatcgttccccacagacggcgccaatgttctggttctttccagaacacaaatgtataacaccgaagtgctatggagttgctgtttgatcactctaactctgcagcttcaaggatatcaatggaagttgataccttggggcaggagatcacagagatacaccaattgacgtggggtgtgtgctctgtgtaattgaaagagagagatagaatgtgtgtgtgtacctttcaccaggaattactgtgtatttataaacagaatacctcgtaacgggcattagaactgcttcctggattcccggcctcatccagcacgttctcaaagttcagtatggaccaagtcagcctccacgttctatgggtaagttatttgcacgattattcataacaattgggcccagacccaaactataacgtctacgtaatctgaacacgacaaccataacagtattaattattcttttcatttatacctctaataactatcgttgacttgcatcatttccaacaaagaagattaatagcatgttaatatagtaaaattgtaactctctcatatatttattagttttttttgtgtataaaaaaatttaggacggtaattttaatgggacatagagagtattaattattatatttactaaatacaatatatggtattgaattgaatttaataaatataatgctaatatatatcaagtataaatttttaaatgaaactatatatataaataacattattaaatagtgtaattattacaaaaattaatcttatatctcatacatatatttattaatttttttgtgtgtaaaaaaatttaggacgataattttaatgggacatagggagtattaattattatatttactaaatataatatatggtattgaattgaatttaataaatataatgctaatatacatcaagtataaattttttaaatgaaaccatatatataaataacactattaaatagtgtaattattacaaaatttaattcttatatctcatatataaataataaagtaaacattaaagtaataattttttaatgtgtactttattatatatatatgtatatacttaataaattaatttaaatttcactatatattttagaggatgttgattgagagtgtaaaaatcttaagaaaaatgatatttagtaggaatagtttttgtcaaatatgtaccaaagctgatttctattcaaacctgtttaacaattttgtaaatttttaagtaatatttattttaaaaaatagtgttaagcattaaagttttattcatgtattttgtatgagtaaatatagtcactttagtttctctaagtacttatcgtactgattcgtgaatagtattgctcaaattttaattctaaaacctctaaaataaaataagactagggagtggtaagattagaatttttataattgtcataaacagcttagcttctgatcgattgacattcaagtttcacgcaagtatgatatgcaattcttttactctcctcaatcaatggccgtcattggtgtttgtgagactgtccatacgtcattttcacttgtaaataagaatgtccaaacgaagaaagacgtgtttctttctgaagaaagaattgaccaaggggaaaatggaacgcagaggtatatgttacttctgacaaggtaagtttttgtctactaaatacttttcatacaaatatgatttcgggttaagatgggtttaaaaacatttttctatttaatcccttattatgaagttaagtactaactcttttgcataaaaatttcatcttaatatataagttcagagttgcgcttctccagctccatcacctcctttcttttgttgctccatcaaactataagagacttcaagcctgaacctaaacattatatattgtcaagatattgaatagtcaagaggttggaaacggatcattgtagcttagttttatactcttttgataagttttatatcatgaataccattagttccaacgccaacaaacgcatgcatgcacgtaagtaaaacgacctgaaaaaataatcacaggttgcaacttaatggaatctaaccaaccacatatgactaacaacaaagtcaacatccccaacacatgatgtcctgctgctgcagctgttgttgttctgttctctggtaccgtgtggtttcaccgttttcaattcgcaccagtcaccaggcttccaaactccttgcttaataagtgtttaggagtagggagcaaagtggactttcctaactaagatctaagaattgtaattaaattaagaaattttttataaatgcatgtaggatttaactggtaggaagaaaagaaatacaacggatagaattaataggaaaaacagaaataaagtaaattttaaagttgtttagtttaataaaaataaagaagaaataaaaaagataaaagaaaaagataaaaaaaatttgcttgatatatttcatgattactaatttataccatttctcctcacttctcccagtttcaaagctatttttccttacttcatggatgaaatttttgtacatgagacctacaattctttccttattatttcattggtgccaaaccaggatgagttttaagttttaactatccactctatttccttacttctacattttcatggtatttcaacccaaccaaaaagagtatataggtaaagaaatctcaatcctcatctttttaattagtatattacctataactaaatattacaaattaaaatatataatttagagattaaaattttcattctcttgttctttcaactagacattttgaattttttttaaaaatgcgtattttatacactatctttataattacttaaaaaaatctttacggataaaagttagaaaatttctttcaaacccatccttgctcaattattcattttctcctctggccaaacctaatagtaatagacatttccacacttgaagcagataaagaactgaaaatgtacaagttgcaatagagtagcccgtcctttggaattagtgttcgctcaactttttttttaaacacagtataaggttagaatctaaaactttgtggaagctatccaaattctccattactaggtctcttctaacctgtaacagctagactagattgcgtgtatgtgtggtaagattgattaacaagaatggtgaggaagggaagtgtcatataaagtgccatgaagaactttcattctggtcaagttagaattagcttctaatttatgtgcaattgtaatccatgataaatattaagtcctcaaagtgtagctgaagacacatcacagagaaataaacttcatcagaacaagaacatgaaatgggtcagaatctccaagcttacacacaatagacaaaacgttaatcagaagctccacattaatgtctcagcagctaagcgacgacgtattgatcagctagcatacagattttaagatagaaatacttcacacttaggacccatctggctgtataaaggggttggcgatctcatctgtaccatcagttggggacacaagcatgacagcagttcctctacaaacctgcattgcaataaaataagttcccaggataatgaaatattcattgctaagccaaaatagttcctgttgaaagataatgataaaataattcaaaaaagctagtggatgaagtgcttatagtcatgtgaattatcaactttttcttttcttgcaggaaatgcttttatgtagtgataggttgtagaaattaaaatatactgaatactatcaactgagaaatcagggagcaaagctccgtacaggctacagctgaggaaaaaatgaaaaatcctctggtaatagaatactcaagaaaaggaaagaaatatgactgacactgttgtagtgcaaccaaccctcaaagaccctcaccaacatttatcctctcacctctgtttccccttatttaatactgattcctgaatctcctcactcccacacactcatgccgccagtcaccattcagttataatttcccctctccctctccctctccctcctctctctctctctctctcctaactgaaatttcccctttcggttattattcttgttcctctcataaaccagcaggcctttgctaccattgggcaaatcatattttcctatgctcttgtacatgtgttaagggcctatcataagtacatttactagaggcactgcatattttaaattctataaaatttaaacaatcagcatacacatctataaaccaaaacaaaaaaactgataatagagttaaagtacaacttttcaccctcgatgaacaatttaacatggccagaatcagtcaattgctttattatataagaattcttaatagaaaattacagaaacatattttaaattccttttcttgtagctctcctaatgcacttagatgacatgttcttaatgttttttagaaggagatgacatgttcttaatgttttgcaagagtatataattgatctctcctatgtacttggactgtaattctaattaattaacttgatatttttcttacaaatacaaaataaatattaagcttggtggagggttaaatccattagtagttctatgttccagtcatttccttgtttagttcttttcctcttcttttctcctttcaccattcttttattttaactttgtttctctcttttgtcctattttcgatttatcattaggttcatctaccaccaaccccaattaacttgggttaaaggtgttgttgatgttgatgttgttgatttattaaacttccctagtatccaaagaagcaaagatgcaaaatttcaatgaagcacgacatcagcaaagcaagctttttatgagccagaaggtgcaattatgacactcatatgatgttgaagaggaggaaaaaccctgacacagtgataaagttgtgccttggtgacttgtcggtcatgggtttgaatccggaaatagcctctttgcatatgcaagggtaaggcggcgtacaatattcctcccccttactttcgcatagcgatgagcctctggacaatgggatatgtagtttttctgaaagcgagtcctgacacagcggtaaagttgtgtcttggtgacttattggtcatgggttcgaatacggaaacagtctctttgcatatgcaagggtaaggttgcgtacaatatctctccctcttaccttcgcatagcgaggaacctctgagcaatgaggtacgtaattatttttagtttttatatgatgttgaagaggagagcttacaattaagccaagattcctggtctgatcggtagttttgaggggatcatcaggatctgcagcacaagggacaaataaaatcttctttcaaacaacagaaatgaaatattagataatttttaagaataagctaatatgttaaattttgttggtggagtttataaacaagcataatgctgatagtaagtagagtcacacaaacatttgaactatgaaattaaatccgttcttttgacacatagaaggtacaataatatgcatagttgtattgacatgccaagttcatctaagagtgttcaataattcggttctgcactatactgaacaaattctgaatggaaattccattttgaattcggtgctgaaacaaaaataagtaaaatgatgctgaattcattcagaaaattaagaaaatgagtaaatcaagggcttaatcaaagtgagaaaaaaatttaaatatcataggatcttccactccaatgcttatgttatttggaactaaaagttcagtgctaaatctgcacttggggcatattagggtaaacaacttgattaagcatttattcactaaactcttataaaatgagaattcccatataggcttggttacagagcttaatgaaataagctaaaaagtgcttattttgataaggatcatagttaagcttattgaataaactacaaatacaaaaaacatatagatagataaataagctactttcataagcttaaacaagcccttcagaacgctcccttaattatagaagcagtggaaatgatgataaaaatggcattatttagctccttagttgttattcattcaatatttcactctcagtcggtataagtccctttatgtagttttcactaatttgctaaatacccaaatagtgatttaattctgtaaagttaaagtataatcaagcagcttcatggcgtaaatcatcacaccaaaaaaacttcacccataatgagcaaataatccaaggaatcaaccaaaagtatagatgaaaactcaaatattttgccccctagccctgaaagaaattttttgcattttagcagattgtagcaaaattcgctgaaaaggctggaaaagcagtatcatgaagtcacgaacataataagaaagtaacaaatagagctactgcagtacatataccattaaaatgataaacagaaaaactagatctctgcgttgtttagttacctcttaaaaactctacagcttcatctaggacaaggttaagcaactgatcataccctttcagagtccctgtcactgcaatcaaacaaaacaaaacataacaaaaaatatacatgtagaagagtttatttgcattttaattatgaaagctaactctcaattgagttcttgcaattcaaaacgaaacgaatttcatacttccgccatcattttaaaaaatcaatacataaatcattaaccattttaaaaaataaaaaatcacaagagaagggaattgggtaacctaaccttgtctgcctccagtaagcttaacttgaacgcctttgtctacaaactttgcaaggtccaaaaccgtttcttttctgcccgactgtgtcaattataaaatgcacaaaaaaaaaaaaagatttacatatcataaagagcattcagaacaaaacgtaaatgaaaaagggaggaaaaccctaaaagaagacagagagatgaaatagttttgaaaattgaagatgtgattgggttttgctgaatcttaccatgcttaattcacgtagtgtcgggcttcgtttggtgctgatttgtgtctgtgcgacaatgaaaagagaagtaccgaagcgaaagtgatagtatggatttgaatatacagagacagaacttggaagagaggagtgaacaacggcaaaatggggaaccaatatatattattagagaaaagtgacggcggaaataactttgaaacaaaacagaatataaatgtttttttttacagaagaatataaatgtatttaaaaaatatactatattagaaaacttttaaaatttcaaaatgttaattactttaaattaaaattttaatggaaataaattttaaccctctttttttaggaaagcaaattttaaccttctctttatttcatgaaaaaaaaaatgaaaggaaataaataaaagttcatttattacacgtcattaatggacaaaaaaaatttaaaataaaaattttaatatatcataaatttaatataaaaagtttaaggatctaaaacaaaaatcaatttgttttaataatcacaaacaaaagagataataagacacaccaacacataaaaaaacttatctttatattcaaataacttctttgcttatgttatacctagagagaattaagaaattactccattattctctaaattaatgatacacttcattgtgagaatgaaaatcatattaagaaatttaattgtatccaaaaagggatttattataatacccttttgcattaaatctttgtaaggatgataaccagtatgagattatagtatgataaatgttaatgtttttctctaatactttttttctaagactttctatgttttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatttttgtcacggttaaaaaacattatcaagtcaataaaaaaatacattagtaacataattaattaaaattattacaactgaattaaaaatttattcttaagtcatcttaacataaccacacattaatcacataatcatttagtacaatcattcttaaatgtattttttaaatggttaaagtttataactatttatataataaaatttaataatttaaaaaacaatttgtaacgactaaaaataaaataaatataaggacaataaaatactatctgaaatgttataaggatgaaaaataaaataaatataatttataataacaaaaaaccaaaaaagttaaattgtaagaaattaaaaatatatttaaacatattaaatccaatttgcttattaatttttttaaaacacttattttaagtttaaaattgacccaaatataatatggataaataattaataaatgtttgtttatgggtcaattttttacttttggaaatatagaaggggaaaaattatcttgtatttgttatgaagtaataacacaattaatcttgaatatattttatattttggtagaaaatatatcaaaatataaatgatacatggattaatgttcaaaaaaggtggtaacattgatgaacatgtaaattatagaattagagcatgatggatgaaatggtggaatgcatcggagtttttgtatgactgcaaaattctccttaagctgaaaggaaaattctataaaacaattgtaagatcggcaatgttgtatggagcataatgccggtcaacacataggcaacatgagcaaaaaatagggatagcaaaaatgaggatgttaaggtggatgtgtggatatatgaaggtggataaaataagaaatgagaatattcgaaaaaaggtatcagtggtactggtatgtgaaaagatgagagaacatatattgaagtggtttgagtacgttatgagaccggcaatgctgtatggagcataatgctgaccaacacataggcaacatgaacaaaaatagggatagcaaaaatgaggatgttaaggtggatgtgtggatatatgaagatggataaaataataaatgaaaatattcaaaaaaatgtatcagtgtaccgatatgtgaaaagatgagagaacatatattgaagtggtttgagtacgttatgagactggcactgaatgctcccgtaagaacaaaagtttgttaccaagagtttgatacaaagaaaggtagagatcaaccgaaacttacctaaggaaaggtagttaaataaaacctaatagagtgagatatagattggtggacggtatgtcttaggacggagtgaaaaaaaattataagtttagtagagggttaaaccattagtagttttatattccagttattcccttattttagttattttccttctttttttcacctcttttttctcttttttcttattttaactttttttcccctctctctttctctttttgtctcttttattatttattattgggttcatctatcaccgatctcaattaacttagatttaaggtgttgttgatgttgatattttatattttgataaacaataatctcacttttaattaatatttaattccaacgaaaggaataaatattatttttcttattatccacaatccaactattctcttaatgctacattcatgtatatatgtgcttcaatttcatttatattattcacaataatttttaaaaaggtattctaaatttttatattattaacactgtaacctctgaattggctattttcttgaagttacttttggttttttggttgactatttgatttgcatcaagtatacatgtagttttgcggcaacaataagactggagttttaaagcatgaggcagcaaattaaagggaccatgatgagttttggtgatgttttttttggcataatttgtattatgataagagtaactatattttaagaattaactacgttttttatttttaaatttttatttgatttggttaaggttctttaatcttttttattaagattttaatctctaaaatttagtttgattggtgaagatttttcaacttttttctattttttttagtcccataacttttaaaaattcagtctttactccttaaaatcccaataaataaataaaaataatgaatttaaacttttgttgagaaactataaactgaaatttctaaaattttagagatcttaactagtcaaacaaaagtttagaaagtaaaaatctttattttttttttgtgtttgtctaaactacttcttcttaaaaaaataatttttctacttattttaaaaaataaatctaatttgtttattgaaaaatatttattaaaatacttatttaaacttaaaactggcccaaatataatatggataagcacttagggtatgtttgtttcatggctaaattttttagtcgtgagaatattggagtggaaaaaattatctcccctttgttacgaaataataaaataattaatcttagatatattttaggttaaattaacctataagtcgctatatttttaccaattttttaattaggttcctaatttttttcttttaattgggttattagtttttcaattggatccctcatttcactgttgttatgaaaaattaaccgcaaagactcaattagaactccagacaggaaaacaattcttcttgggtgtgttatattcacaattgagtctatgagacttttttgcaaagtttctatcttttaatgtcaattcaacctagatatttctttatatttatttggttttgcaaaaggttgaaactttataaaaaaaactcacacaattgacttaattgtacttacaacacattctaaaagcattagtccactatcagtacctataattaagtatttgtggttagtttttcataacgataattagatgaaacaattcaattgaaaaataaataaaagtttagggatccagttgaaaaaaaatgttgaaggaccaaattaaaagaaatataagttgagggacctaattaaaaattttgtataagtataaggtaccacaaagtaattaaacctatattttgtatatgagtaaataaaaatctcacattccatcaatatttaatcctaatgataaaaaatatttattcccataaaacataaatccccattagtgaataaaaatatacatatattctccttagtatccactactcaactccatttatatatgtgttttaatttttctgatttccacccattttttcctgtgtcaatttcatgtgtgttattcacaataatttttaaaaaggtattctaaatttttatattattnaaaaataaataaaagtttagggatccagttgaaaaaaaaatgttgaaggaccaaattaaaagaaaaataagttgagggacctaattaaaaattttgtataaggtaccacaaagtaattaaacctatattttgtatatgggtaaataataatctcacattccatcaatatttaatcctaatgataaaaaatatttattcccataaaacataaaatccccattagtgaataaaaatatacatatattctctttagtatccactactcaactccatttatatatgtgttttaatttttctcattttcacccattttttcctgtgtcaatttcatgcgtgttattcacaataatttttaaaaaggtattctaactttttatattattaacaccgtaactctaaattgactattctcttgaagttacgttttttttttttactatttgatttgcatcaagtgtacatgtacttttgtggcaacaacgaggctggagttttaaagcgtgaggatgcaaattaaagggaccgtgatgagttgtagtgacgtttttttggcattatttgttggaactttcctgtgcgttgtttatatttatacctatttggacacaattatatattttttaaacaaactttaacacaataaagatatttttagtaattattatacattcctaggataagaaaatgttaaacaaacacatgttttaattattcctatacgtataaaaatattttcaacccatttttaatcactaaaaaataatttcttataagttagttttataaaattgaatatgactcaaacttgcattataacaatatagttttttcataccatattaaaataaaataatatatttattaatattttaaatgttaaaatgttaatatacataaaaagtcattcgtatagatttattgaaagataattttgtatcttattttcatatcttattgtaaatagaaatttaaataagttttatgaaggttgtatcaaaccttcaatataaatttatatgaatgaaaatgacaaaattttgtgaaattatataaattcttactgttttttcaatcactataataattctcttaatnatatattaactaacctcttctaattgtttaaaaaatagggaagaatgatgtatatgttttaaaaaaagaatttgaataattttacaaaaactcaaaagtaattagtataatttaatcataaatatatttgaagaaggttaattgaatataaactttcgtgaacaaaatttaaaaaattatatgctcatatatttaaacaattcaatttcaatgtttaaaactatttttttttcatactttaatttttactttcatctttatatttctctttttctctctttttttttttagagattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctcttctttttggtcacatttttctttttctctttctcgtatatacttttaaggaatctaagagaccatttttccttattaaaccgagccttgatagcacttcaggattttgatttattttatttcatggtaaaagcataatacaagtccaaaaatccccactgcaatgaactcagatagctaaatagacacacttcgaatcttattgccacattatagttttttgtcagagtttctgatagaaggacatgacaatacttaaatttattcttagatggatataactcataactagtctcggccatcattaaacaaacacttaattggctattcaattccatcataattctgacaatttttttttttaacggttaaacctttaactttagaagtggtgggggcttcctgatcaaagtagcttgctcaaaggaataagcaatttcgatgagctttggttctgagcctttcaaacctccaaagataattccaaatggcgcacccttttcatatcccgctggaacagttattccaggataacctccccttgcaagtatactaacaaagaatgaaaagggtactaccaccgcgtcaagtttatttgttatcattaatttctcaaatccaatatgtgacaatcttgccatgtttaacactgcttccttcagttccctaactccatttgtcttttgagctatcaacatgagatcttggccatactccttaagtttctcctgcaatttccataccaatgttattatatctattccagtgaaattgttggaaatcgacaatcacacacaaatctaaaaaacagaaaagagaatagggaagagaaatatgacacagtattttaccctggtttatccaatgtaggctacgtccagtttgtctgtattataatctcctcaccgtcactcgttacaagtcactcagtttacaaggggaatataaataggattaaaagaccagttggctttctgctgaccccgccaacaagaagggttgtcatctgactgcgaaagatgagccatatccaacagaaatgagatttaagtgatcaattttcagttaaaattagtcttagtctgataaaattcggataatagtagagaacgtgttaaaaagaacataatgttggtatttctatttgataattgatgaatttcgccttcctttatagaatttaatatatttgaatgatggacgaaattcatcaacaagatgtattttgagcaaatttttttaccatatctattttaatcatcaacaagtaaataggaggggctttgttacatactaaccaattttgggtgtttcttgttgaaggctatcacatcggccaagcttctcactggggaagtaactaagtctctgaggtatgcgttcaaggataatttgaattcatatgccagagcaatgccttcactttgatcattaaagatttcctgaatgttgtttatctccaaattgtcaaccaacactgctcctttttgcctgagtttgaaaaatataagtatgatactgaataatgcaatcaataattaatacttgacacaaatagtaattttcattaccttaatgttttcaggtgcagttcgaaagtatcatgcataaaagtgtcatttccaaaaccgtagaatattcttacgacacctaatctctttcctctcagtccatctttctttagaaattgagcatagccacctcttgggagatactttgatgctttgattgttgccttatcattgatgtcgattcctgcaatggtttcaagaacaagagcagcatctgatacagtcctgcaaatcggtctgtaccagcccacaagaagtcacacatttaatgcaacaaaatgtattttgacgggaaaagtaataatgcttgcaaagtgcatatagttttgatataaagaaatagcaaattacattaatacttcttaagaatttttcgaattacacaaaatactattctttgtttaatgtttataacaactttcattataggagtgttgttttcaaatttaaatcattaagggagttggtgtaatatataaggagaatatgagtataatgcttttaaacattaaaggagttagtttaataagagaaaaaaaaatgatattgtatgtatttcggaaaaagctcaaaagattccagtgtaatttgttcaaaagaaaatggtgaaattaccatagtccatagacttacccaactgtgtcctgtaatggggagattggaactacccctgctctactagtgaggccaactgttggtttaatgcccactactgaattagaacctgaagggcataaaatagacccatcagtctcactaccaagtgacactgccaccaaatttgcggccactgatattgctgatccgctactagatccacagggatcacccattgtgtatggattctgcacaacacaaataataatataatagattactttactatggacttttgcaaatcatcaagaatagacagatagatttgagttgaaaagcaagaacaaggtcagattaaagtcagaaaaagcaagtaaatcaatcacctttccttgtccacctctgccattccaaccactgggtgcatcattcgacctataatgtgaccattcactcagggtggccttgcctaaaatgatagccccagcttctcttaacctggtaactacacctgcatctctaggcaccacagagccaagaagtgcaaaagagcctgcggtggtgttcatcttatccttggttgcaataatgtccttaaccaaaatgggtattccatgcagtgctggaagagtccctggtgcattagcctttctctcatggtcagctttgtcagcttgttctagtgcatctgggtttaactccaacacccctctcagaactgggttttgggtttgtatttgtttgtggtagaactcaacgagttgcctagaggttaattggtttctacggaaagcaagttggagatcatatacagttgcctcttcaattgagaatcccaaagtgactagagggattaaaagaatgagttggaaaaacaaagagaaacatcctactgtgttgcacgccatgaaagcaccaagatataatatttagttaactgcatttttctgtatctatatgtgcttcttaatcattatggccgtgaaaaataaaatatctagaaatactccaacgtgattcacaggctgtccacagtatctgaataaataattgagtaggggcagtgacacatttttattcctgtcatatcgctttgttcgatgattctctttttctctctctccttttataagatttattcgataattttgaagtgaataaaaattgaggagatttctcaatttcaaaatgtgacgaggaagttttgtggactcaagtgtgaaagaaaatgatgatattgtgaagataattattacaggtgagaaaagtattcagcatcatgggaataatgataatcattgtggataaatttcttgtctcaagcaagaaatgtgacgtgtaactaaataaatataggtaaatattaacaaatgtttttagagtattgattaaaaaattaaaagaaaaaaaatatttgaatgtgtgaaattgtgtttttcataatttttttatattttacataatgaatatttttaaaaatttcttaatcaatattttaaagatactcgtaagtataaacccataaatatatgattaaaaagaattgtataatgaaagactaggggaaaaaaagaacctgaaaatcaaaataaaggataaaaacttcgggagttcgtacggtttaagactaatataaactaaactaagagttccattatggttaactgtgaataaaatgttcttaatcaaaagcacaaagtatgctaatagtaaatcaaacaactaaacaataataaaccttcactcttctcttctctctccttaaagctgctgcatagttacttgattaacccttcctcatatgccttaatttgaccttctcaactcgataaatgagacacatagttggcttacaatatttgagtctttctccttttagaaaaggaaaccgcacccaacaagaaagctatgatgaagagcatgggaaactcaggaaattttggagggagacgttcactcacatatctttggaattccacttataaagttggtgtacgtggtccaaccaatggctacacagggtctgtaacatcactctattagtaactccctgcatattccactgttgattcttaaaaataagagagttcttggcatactagagagaagccaccgtaataccaaacattaatctccatctgtgaagcccctttgccgtgttccccaacaaccagtcgacaagagacatagagaagaagctgtgcatagaagggaaaaaaatccctgccaagctcttcccaaataggtttgacatcagaacaatctctcagaatgtgcaattcagtctcaacaatagatttgcataaagggcacagaggatcatcaatataccacaatgttgccttctgacattagtctttaaggcctttattagcaatcaaccaaatgagagtccaaattctatgaggatctttccactgccaaatcgtctgcaacctgttagagccatgaatactgtgataattggttgagattgaataagttgatttcacagtaaaacttccattagtagtagctcccccaaaccttccatgagcagggagaggggtaggataagcaagaatctcctggataggccagtaaggaaggaagtcctacaactccaaaactttccacccaccagagctattaacatactcgatggaaaccaattgtctagccagaaattgacccgggaaccattacccacaatccacgtaatagctttccaagtttaggaatcatgcatcccacaattaacaaccgagataatggttgatcagcacttatatttggcccttaatacctacacccacaactcctccggctgggcaataagctcccaagccatcttcatgataaaagtcttattgtaaagatgcaacttcttgaaccccataccaccgtccacctcccatgtagtggtatgccaaccacgagcatctccatcattccaaaagtaactattgaggtgtgaatagtaaagctcatactccggacctgccgaggcccaacaatgttagtgctgggctcatttcacttgtcagcaacgggtaaaactaattacattaggaaatataatggtatgggaagtgcagtaaggaacactgggaatgcaggaagcaacaaccgtcagtaacatatggccttcttgttcaaaccttggcaaatgagattgagaatgagaactagattggattggtgatggtgatggtaatggtgatgggtactaattggtgattggggagaacaagggtttgttattgttaccacagtgagcagcaagagggtccaagacagaaggagcaagaagaagagggttcaagacctcgaagtcacaaccgagaaatggtaaatagcctccaaaatcatctacctaatggagcttctcaagcaagatcccgaaatggtgattcccgttcgctccctcgaccaccaccgccgccagatcaacctccccaagccccatcatgtctccgatttcctccgcaaaactcccaacctcttcgaactctacaaggaccagaagggggtgctctggtgcggcatgaccccaaaagccgagaacttgatggaacaacaaagggtcatcgaagaacacgccgacaaagccgccgaacacgtcacgaggtttctcatgatgtcgctggacaaaaggcttcccttggagaagattgcgcatttcagaagagattttgggttgccgtggattatagagtccattgggcgcataagtatcctcagctttttaaggggttgagtttttggagcttgtatcttggaaccctgattgggcaatcactgagttagagaaaaaggtggtgacagaaacaactgaaactaccgaaagtgaaactaccaataccccaggaatgctttcaattccatttcctttgaagttccctgcgaactcttagagggtgtatcgttactatggtgaaaagattcagaattttcaggagatgtcttatttgtctccctatgctgatgctcgtggacttaaggctggatcattggagtttgatataaaagggctgttgctgttatgcatgaactgcttagtttcactattgagaagaggttggtcaccgatcacctcagacactttcgttgggagcttgtgatgcctcagaagccgatgaggcttctgctcaagcactgtgggatcttctatgtgtccgagagggggaagaggttatgactgaggcttatgagggttctgagctcattgagaaatgccccttgctgctgtggaaggagaaggttttggggcttgtgggttatagagggaggaagaagagaagcttgaggtatgcagtgatgatgagtctgatgtggaggatcatgatggtttggttttggatcagagggattctgaagtgggggacttgcatgtgcagattgagcctcggggtactttggattacgaggatcttttagttggggatgattctgagatggatgatggagagatttcatgaagatctggaaattttgaaagttgtcaaggtcggagttgtatttcagttttaccatatatatggttgattcactttatacttcaaagttctcgggaacacgcaattgtataacttaatgtaaatcaaattttgaggattggcattttactttcatagattagcaaatctcggttgcgttttaaatgtggggaaatgtggtttcttgacaaatgaaaggttaaaagaaaatgaattaacaataaaatcataataaaattgagctacaatgagtcaaaacaaatgttcgtaaacataaccaagatatatcgtgggcgttagctcaaattattgaaatttctgacaatatttgacatttctactaaaattgttatcatcttagttcatttgtgtacctctttataacccgaagtcctaaatggtattgatacctcacatagttcattttagaacccaagctcttaaaatgattcgttaatgtcaacaacccaaagtctgaaggatattgattccccgcaacagataaatgcaaaagttccccggtaggctaaatcaaaataggctttgatgtaaagaagagacaattgtgacgcaaatcatcatatgaacacctagtggaataaggcttttcttcttgaacaaatcatatgaacaatgaacacaaactggaagattaatctatatgttgcatgtgtcataagaagagaaccatgattggtctgccaaatttgcaagttcactatcctcttcgttacaaaataactcaaattgaccattaacattgttcggcaccttggtgtcatcacaagtaggcatgacaaggtcatccaaagtaggtcgtatttcttcattaggcaaatgtgttttggcaagtagcttattaagtgtgctaatctccttgtcatatttcttcttcaatttatcaatttgtttgtaggcctttgcagcttcatgctctgcatccatggcccgcttctgcaagttaatacatcttatagaattagctcaagtagaactgagctgacccagctctttcaaaaacatctccactaccaggttaaactatatgtatgcatcagctgtagcaaaataaaattgacctgcttctcttacataaaatttgctagaaattcatttgtgagagtgaaagacttcagcataaaagaataaaggtttattcatttggtccctatagttgtacaaactttaccttttaatctctatacttaaaaatcatctcttttagtccttatagataccttttaatctcttctagttcctatggagtttagatgatagagactaaaagagattaaaaatgttatgtatagggactaaaaggattaaaatggtatgtgtaaatacacatttgaatatacatactttttttaatctgttttagtccttatgagtttagacgatagagactcaaagagattaaaaatgttatgtatagggattaaaatggtatgtgtaaatacacattgattcttgctcagttgaaatttgaatatacacattgattctttatatacctgtgcggtaatgacaccttcttctgcttcattaagtcgcacaagaagttcacctgcagcttgcactgcttcagcagtatccttcagttgagctcgaagtcctctattttcatctcttaggatttccaattctttttctttttctgcttttaatgctgaaatttctgcagcaagggcatttatgaatttagagtctgcacctcttactcctcctctggaagctgcttccttgacatcatcaatgctatcctggatctttctatgcctttcaagcaattggatatgtttctcttctaaatcagcatactgttctaaaattcgtgcatggccttctatagccatttgcattgtttcattcagttcctcagcacacttcctctcagtatctagttcctgcttcctcttttcagctagtgacctgctagcttcaagttcagctctcagtttttcagttagagaaatccacctgctttctgcctcagtccattgacttttttcctgttcaagttttactttggcactgtcttcagttgattctggatttgcatttgccttagtgctagcctctgttaaatcaggaatggcagttaggtttgctgccaaactaggttcagatgaataagtcaattgcaatggagtatattgctttattgcggatgtggatgaagagtcaacataaaagtgaagctgatttcttaaactacatatctcttccatcaacacttccctctccccaaattggtaaaaattctgatactcttgtaactcatcttgtactctttttaactctatcttcatcttcagaacttctaaatgatgctcatggttctcctttaaatgctgttgaattttgatagcaggcaagtcctaaatataagcatcaaagatagtaatcataaaaataaaaccttaaaataatttatttctaccttgttttcatgtgtgagggacaccagctcttcatccatgaactccttggtggataaaacaccatcaataaggctctgaaggtgtaggattttatcttctcttgtatgtgttattgtggcattgcattccctctcttgcctgtacttttgcaactacaaatatgattgaaaatagtcacaatacaagacaaaacaatgaccacagatgattgtcagtaaacagaatcttaccaagcaattgagctgcattatatgagaagtctgcttcgcacagaactcttctaatgccatttctctccttattgatcctgccaaaaccttctctactgcctacattataatagaaagaaatgaaaagtaatagattgaatttaagctataccagaaaatgaagctgagatccttgcacttactttcagaatttgcttctttggtttatcagttgactccgggcaatcaatgggtaccagctgcacatttgagctattgtcaatctcattgacatcaagctgcattcggcttttacagttattacaggtaagcatagcataatcttccttttcggcattatcatcaagaatagtctggactccgacatcaactttttccacaggaataatgagcctggaatctttgggtctcaatgagagactcgataacgatgcaccatgatggtggctatcaataatttcaagaccatggtggatgcttactgctaaattttcagttttagttaggaaatttggagctgtctggctggagagagcagtagacaagcatttctggttaacggtgtttgtgcctaaatcactttcaccatgaaaattattctcagaaggagactgctttaatgaggtcctcaaacttttcctgctgctgctgattgttggtgaaaggctgggaggagggggtttgaggatgggggatgttttgcatttaaccatgccgccagcagggctgtcaccattcattgcagcactaggagaaccaatagatccagtaggggctgaaaaaccagcaaaacctccatttgagttgtggagaactacagcatgatcctcaacaccttcctcatcaatctccatctcctcatcaccatcctcatcaacatgaggtagtgataatgggtgattgagggtaggcttcagcaaattcaaacttcttctgatcaacgctgctgaatgacctcgacttccatcacttggactgtaaccatttgctttaattcgatgaagttcatcctgtttgattgcttacagttataagttatttgaaaaaaaaatgtactggccaggtataaagaaatgattgatcatggtcgaagagatattaccctgagttggcatatcacgtctcgtaattgattcacatcaccgtgcattacttcattgacaactgctttattcttgatagcctttacacattgtgcaaatctcaatgtactaaaagtttctctcttacaactgcaatgttaagccatgagaaataatccagcatacattaagagccagaagttcaaatcactaatggttgatatctacctttgtgctggggaaatagcacaaaccaaagctaattttgcatttccgccaagagactcctgcaataaaaatgtcaacctggagtctctatatggtatatgtcgcagctttcctgtctgagaaacttcagctagaatttttatcaaattcctgcagtacaattcaacctcagtaagtaattggatcatggatgattagaatttggcagtcaggaattttcagaccatggaataaatgccacctaacaacttccctttttccctttccttcacatctaggttttatgcccatttcatatttcatctatcatgggggaatgactagtatctattcaccagcttgagggggaatgttgaatgggaatcacaaatctatgggagattgtttggattgaagatgcaaagagagagaattttttagaacgagtaaacttcagtaatattttattctgatttaaaatggctagattacaggtacttatatgattacaatgcaattgcaactaatgtgatagcgaacattcatttaccgaatccaaaccgctgcgcgtagcttccagctgggttaactacctaaaggaaaactggtccctgtccattcccaatgagctagattgacctaacacactgtatcccaccaactaacatcccccccccccctctctctctctcctaagctcaaggttacattacataaacttgtcaaacactctgatcttgcctctgaaaacatgaaaatgcagtgaagagagaggcacgttgaaagcatccacccccanctgatcttgcctctgaaaacatgaaaatgcagtgaagagagaggcacgttgaaagcatccacccccagtaatcatgagttgggacatgatggagtagtaggctcttgcttagaacctttcccaaacaaaaaaggtatctaactccatttgtttaatgcaagagtgaagcagcagattgtgagagaaccactgaactcaaattgtcacaggatttttaggagtctgaaaaatgcaatgcaatttggtgagcaatgaccgaatccatagaatctcagctgaagtttgggccaagcttctataatcagctttggaatttgccaccaaatttttcttctttgatcaccacaaaatgggccatgtttggataaaattctccataggtatttataggaaaaaaataagaaagtaaaatgcattgagcttctttataagctaaaatcaacttgtatttgtatttaagctatttttcgtttgtgattgctagtaatttgtatttcaattccaatatcaaacatcaatgtatacacacattttaaaccatacccaagctgtgaaagggatctattaatattgccagcttcctttaaacggtctcctgctgcacccgttaatttttgtcgttctgacccagctagatcaacaagatttattttacttgttctaaatctgcttacaccatctgcagtactctgcaaagtgaaaatatggactcgcttcaatacctcttttctctttttacaattctattgtgaagctgaaaaatatcttgccaacagaagttcttttgaaaaacagaagaactgaaaagcaaaagttcattgctaggttccacatttcaatattgcatatgtagtttctcctaaaatttatctagttaaagattgtaaaatgtctgcccttcctatctaatattattaaaaactatctccaagccacaagagaagagtgcatcaccttgcatcgagattcaaccacacaagtaaaaacagtatgagaacgtgaactttcagaatttatactggttgcaccaattcttctgtttaacaaaccctgtataatgaaaggtatataatagtaaaaacacaagagaaaaggacaaaggaaaaccatggcaattatgaaatttggagatctttagaatgtgttaggctcttgagatctttagaaacaaaattataaagaatggagatagagaataggaaacaaaatatagctcttctgtattgaaaaattgaaatcaggggatgactctcctcaaaggaaatcctcttcctccacagagcaacactgcctcaggtgcaactcgacaaatatataatttatttctcaattacagctctctgtttatttcttctaactgactaacagaccaaataatacccactaactacctactcttcttcgtctagaatagatagttacattgggctgtattcatttacagaagagatggccctaacagaatggaaaggaaaaacttgataattacaagcatataagaatggtcaattgtctaaaaaacgaaaagagagagagctattcaagtcagactgagagaaattcagcatttcatttctcctactactgattaaatcaactggttctaccttaatggaaatttttgtttttatgtaatgagtcatatatgctcaaaatgaagctctgccacatttgttacaaaaatacttgttaaaaaaagtaatgaagtactcattcagtgtaatttcaaagatgacaaatttagtttaaacatggggtactcaagtgaggcatgtacaacatatgacccttaaatgttgtttttacttttcattctatggtgaaagaacattaaaaaataaatgtttcaacctgttgattgatggatgtttgacaactgacacgtgaaactctaaatgttaagaaaacaacacatgctaggtgttcatgaagcattgttgctgatgttatatgctgccataacctcttcaacttccacatatttaagaacctgattctctaatgcagtagtaatatataattctaatctttttctaatacttttgttgccatttagcgtgagggaagaaataaagacaaactagtccttgataaatagtttttggatcttattttaatcctttaagaaaatctattttatatttttattgacttctatagtttactcataatgaaatggttgaatagctaaataggcaataggcaacactgcaacagccaacagtgatagaagagggaaatggaaaccacaactgtttatacaagtgtgatgaagcacacctttatcaaaagctgagtcacatctttcttcgtacacacttgctcctctgtaagattttcaacatagacaccagatttgacatcttctctaatctgaataagcatcaaaagaccagttctagtataacctggttaagcatgatcgagggaaaactataatggaatagattttacctgtaggtttctttgatttggatctaatagatctgctatttgctcgttgtatatctgcaaaacaagttcacacatcaaaaggactagataacaaggtcaagcaggacagggacatagaaagaaattatcaacagtcattcaattcaacctcgagaaaagagcagtggcactgatacttgagttgcttgtcagaatgcctaatttgctcctgtgcatgaaacacaacaatgaaaatcacaacaaagttcatataaccatcaaaggattcaatcacaaatagaatagaactcaacactacctcatttatgcaagcaaagagtctttcaaaaacacgaggtgcaaggccttgttcatcacttgctgaattgtcatctgacaaagcattggcaggaccccacatggtataagttttcccactcccagtctatccaaaattttcaaaaataaacataatcaatcacgagtaacaagagaacataacggcacaatgcaacgcaaaatgggaagaaagtagaaacctgcccatatgcgaatacagaactattaaatccagccaagcaattctctacaagaggcgccccaacaagctcaaaaatatccaactggaggataaaacagcaacccagttactatcacaaaatcacgagagagacatggagaacgagttaaatgtaataataaagtaattataaacttgtatcatgcctgagtagcattagtgtgagcaacggaatcaaatgtgaagctctgaccgttgatggacaaggaatcactggaaatcctctgaactatggaatctccctggtccccgtcatcgcatgcaggcctcattctcacaataacctagaaattagaatataaaattataaattaactagttaaaaaagaagaagaagaaagtagaatttggaatggttgttgaccttgacggcggaaccagaggtggggggaacggaatggtcggaaagcttgcgcttaagagggttagggttgggaggttttgggggcaagggggaattgaaaggaggaggatggttctctttgttcttggatttttgctttcgcgtgggtctgggttttctgaaagcgtgtgcggaaggagtgtcccgacaccgaaagattggattttttggaagcatggttgcaattgcagagaacagaacggagaagagaagagaaagtagggtttgggttgagaagggaacggagaatgaagaaagtagccgttaggggggttgggaaatgggagggatttgaatgtcagcgcctgtacggttcttgtgtgtccctgagaaaataaatttattttctagtttctatattgagaaaaaaagttattgtcactgtaaaataatataaaattggatgagaccaaaattggttcttaaaaaataaaaaatttaaatttagtgaatgtataaaaagtataacacattgttattattgaatttgtgaaattattttatcttgtaatatttaaagaataatttaaaaataaattatatttttaaaaattaatttaatattaaattattattaaattatttataagattaatctatcataaaatattaaatttaaattttttattttttaatgaccaatttattgtgatctcacattttcaataaccaaaatgatatttattcaaaataattcttattttttctaatattattttgtttttagtgtttattattcttatttctattgggagaaaaaagaagacgcaacgtgtctctctcttagttttaaatttttaaataaaattaaaatataattaataaattattgtagatctcttattttgaattttttttagataaaaaaaaaagtatggctacttggctagaggacgatttgatttgaagaagaggaaaagttgacgaaatactttttatactcaaatgtgaaatgctatttgcactattgtaagaggtccttattatatctttcattaaaagttttatttcttaaaaaaagtttttactcaatgactaaataataaaatatcttcttatatctttcattaaaagtattataccttgtacaattttttgatcccctgtagttttttaccaaaagatattgtatatatcttctcagcaattcaataatgacagatggagaagcggtcttactcaataaaaatcttaatgcaatacaaccaaaatttagttgtcataaaaaataatcctaagctaagaaaacatttgttttacggataatttttgtaatcccacaaatatagggtaaaannnnnnnnnnnnnnnnnnnnnnnnnnnnnnnnnnnnnnnnnnnnnnnnnnnnnnnnnnnnnnnnnnnnnnnnnnnnnnnnnnnnntttttttatctcatatttgttatttattatgaagtgataaaataattaatttcaaacatatttcatttcaatgttaagttataattcacatgtaactaatatttaatttcggacttgataagatccaatattctaaagctattttcatataatccaattgagacattttggaatagatcaaatttttcttaatatcttgttgagcaataactaaaacagttcctaataataccataatccaattgagacattgtcttaccaaatttttctttgttgagcaataactaaaacagctcctaataataccattattatatctataaaagttattccgttcattgttgaatgtaaaactatgaaaattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttgtgataggaatctctttatgaataaaaatccaagcaaattctccttcctaccctctcaatgctcctttatgttacatactataattttctctttccacaaatttcattctttactacagtctttcattcctatgtgcccaattacattcacgcaaaataggcatatattggaatctctctctttatatatactcgtgaaagatactcaattacatactgaaaggtgttatgtgtatgtaatgggctgaaatgaaataacatattaatatacttttaataaaataaatattcatagtatacattgatatgtttctatttcagcatttctctgaatctgaacgaataaactatccataaatatccttattatacttatatctattttattttattctgtttttgagaggaaagaaaagtctgtgatgtattcagcacagaaattaatgaaaataagttactgacacgaaaaatgtgtcagtaatgacccacaagtatatttctgaccgatataaccgtaaaaaattttcatggtatcctttactgatccacaagtgtattttccgttgaaatttttttactgaaaatttcccaagactttaccgacagatatatttgtcaaaaatttccgaccgattaacttttcaagaaattgaaaattaccgacttcggaaattccagttttttttattggttgttagataggaaacttaattaacatttatgcaaagttagaaattgtgagatttattttaataattataatataattctcaagaaaaaataactcaatcaaacagacgtgttttatttatgagaatataaaaaacatttacagtcaattttaataattaactaaaaaaaattttgaccacatatataaggaacccaaaaataacattgtcattgtcacgttatattatgaggaaaaattaaataaattcccgagacaaaaagattgtccataaaataaacgtcttaattgaatacacgcctaagattctcaaacattctaatttcttgagacaaatgcattttcttactattacttcatgttaatgttgtttaacgtttataaatgataataaaagttagagaaatgatatttgtaaaagtatcacttcactaaaataaaatatgtccatagtaaattaaaaaaaaaaaatagagaaactctatattcaaaacaatggaaatatgtcaaactagtttattcatatctgaaacagaaactacaaacatatatttgtctcttcacaagatgtattggtattactacgattagaaggattaaagcataataaacaaattaagcatgttattatgagttaaataatagtagttgaaagggaaccgaaattgatcatatttcactgagtggaaggagcgaagttgagaagctgcttggaaccaagccacggcttcaccaccacaacggattcgaatattctggaatctccaacgtcgccaccctgcgtggtcaatatcttcatgtagtacttgatcccagacaccacttgttgttgcgcctccaccacttccacgaacgtgacttcctcctcctccttctgcgcctgcctcagcatccggttatgctcctccaccgagaaccgccctaaatcctgcacctccttgttcgccttcacgtcagggatcttcgaccttcccccgaccaatcccccgtacgacgccgtacacgcgatgcatgccgagatcgtcaggatcgccagtgtcaccgccggtgaccttatcaacgccgtcatcgatcgctcaattatgccgaacctgttagaattaatttagaacgatgatggagttgcatatacggtgtcgtttatataaagggagaaataggtgtttggatacgcatgaaaaactaaccgagagaaggtgaatggcatggggaaacggaaaccgcgtgcgtgtcgcgattcggatgcgagttttggacggaaatgagattgcttttttctttttagtttgttcaatgttattgccgtattcgagttgttggtgtggtgtgtgtgtgtgtgcgcttttgttgttaggttaggtttgggagcagatcacatcgtaatcgagttgtgttggtgatatgattgatatagggcaatgcgagagagagagtcagcacagtgcacaggagcaataacgaatctagtcatgatcgagtgtgccaagcgtaaaatagttggcttggtgtggtttcgacaaactgacacataggctcgcactaatctgagaggcttccacgtatactccacatgcagtttgcatacaattgagatcaaagttttaaaaattgatatgagctcatactttcacaacaataaatacatttgagagaaaagcatgcattagatttgttgttgagagataaatattaataatgtataatacttatttcatgtttaattttattccaatataaatcgttcgtagaactagaattgaacgaactagttagaacatttaagtgtacatgtgtaacctactttcgtctgagttcaattccacattatatcccttatcgtgtctagggtcattaattctgatattcccatgcgtgactatccacacattatcatctagtcgttaccttagatctcgacggctaccacctaagtaggtttgtaccagtaccataaacatgactttgagataagactaaagcgttgaccgttgctgtccttattaggtcaatcggtgattaggatggtacagattttaaaaataattatgagatagagtaaataataaaataagtagatgacttttttcgtgtatatatagactccgctcaagctttttgttgtggtggtatttttcgtgtcttttctcgtatcttttgtgtttcatccaatggttgacctataaactatcaaatataaagttagagtaaaattttgcatgtcatttgtattctgcctcactcttgtgatgaatgattactttataacaaagttcgtattaatacgaaagaaataaattaggtgaattttaatacgaaagagataaatcaggtggaaaaaggagtaatatttgtagtttttgctacttgtaacttgtaattctagcctaattattaatactttctgtaaaaacaaaccaatcattaatactactaatgattaatttattatcacgattgttaattctaactgaaaaaggctatagagacgtgcatggctatgttcaacaatactcagccaattccaaggggtacacgagccccattcctgagccagtaaaggggatgactgatgaggaagaatgacaaaaggcaattactaccataattttctaattaggtaaaattacctcaattgcttttattacaaagatgtattttcttctttcttggtacataagttttatataaattaaatgtatcacaaagatatgtgaaagtgtatgaacataagtgattacatttggtaaatgtttatatctcgtggagataaaaaagaaagtaaaaatcatgcaataaaatgtattaatatatagatatggattacaagatttaaaataggtttttaatcattaaaaatttgattttagttcgtgtcatttaaatcaatcaatttgatttctatatttttaaaaaataggtgaatttaacttttgtttaattcctcaacaaatcgatgcataaggattaaatttattataagattaaattgattgattttaaaattatcgggactaaaattaagtttgattaaaattagaatgaattgaatttgcaaaacgtcatatactcatattatagagcttcattgcaaacaagttgttgactcctatttatccttatcacccgataattcaaagctaagacgtgcagattattcacagatgcagacaaaagcttcttgagtttcataaccttgaggtgcgtttaatccgaacacaagcaaatcgggttcctcattctctcgcaaggctatcacgactgtattttaaccaccaccatgtttttgaatttattcctatttgtattaacacttttatcatggatgaaatgacataattaccttttgcgtaaaaaaatatgttacaggttaaatatttttttttgtatattctttatttaaattattcaatttaattttttattttcaaaatactcattttgatatttaaaaaaaaaattaatgttacctttacatctgttgagatttttgataaacatgtatttcctttaaagaaaaatagtttttcatttaaccaaagtcctataatatcatgatcaatgtatatgctaatgctggagttcttcatcaaatggagaaacttttccaggccatgcagaggcaaggttatttgcctcattctttcacatatctctcccttctccaagcatatacaaggagcctgaattattctaaagccgaggaaaccatacatgctatgcaaagcaaaggcattccactgtcttgtgtccattttaatattttactccacgccttcataaaagctggattgattgattaagccaagagggtttatgaggatctatatataaacttttggtttagttcctgatcttgtatgttaccgaacaatgccgaatggttacctgaaatgtggatatgtggaagaaggaatcaactttttttaaagtatttgtgaatcaacaaaaggcgacaggttcatcatgagtgcagctgtgcatttttacaaatccgttgggaaggaaaacaaagctaaatattaagttcaatgaacaacatggggatcccgttcctcaagaaatttgaagttggataagcagagagtagaaactccatgagatctaacctgcttcagaaatactagggtatttgaatggcattataataatggacaaaggaatttgtgactagagaacatataaatctaatcaacctggtaatggcgacagtggatactacatgtatatttgcttgcgattatgattgggctcttagttcagaaggactttgcctgttataaggaggacctgatccacgtttcatatgcagcttttgccttttggctgcttttaacttttgtccgaccttcctttaaagatgaggttgaagaaagaaatgcattatatattccatccagcaaacctttgctataaatgatgagaagacagttctcgaagctcatcggaataaggtggcccctacttccaaaatttcagcggcagagcattttatggatgaagctcaacagtagaaagcagtttcgaaggaacgggttgaggttgaagaaagaaatgcattgcagagactatcgggtacaagaaaggagcttgaaaatgtgaggaaaatcaaatcccatggtggaagatcatagaaatgttccgcaagaatttgagcacaacagcattgtcgctagaaatccaggagaacttgtttattgctttgctaaacggccaaatttattatgtttgggaggctacgtgttattaaattgtttactcaaattctacgtagattaacacttgactcaaaatggaagacttgaagctaataaattgttcagtctttttctattataataaaaaaatactgtttagtcttttatcaatttgattttgagattttaataatctttttttggatcttatggtgtcatcttttaaattttttactttaatggtaactattattttaagatcttaaacttttttgaaaatctaaaaaaaactcatcttttaatatttatttataattattttaaaataattaaaaacaattaattatataattttttatttttaaaaatttataactaaaatacaaaatttatttttaattaaaatatttatttatcaatataatttctttttctttttttatttctattttctttcccacacacttcgctatgtccccttcaatccacatttctcgcggtgctctggaacttccgatcaggccatggaatcgtcttcggccatcacgaatcaaccaccatgtctctatgcactgttgaattattttattatgtattttgttttaaaattatattattatgtactttcttctggactattcaatattccttgtggttgttgatccacaccaacccaatgtccttttttcttccgaagttgtcacggttgtgattattttattgttatgtgttttattttaaaattaaattattatgtactcaacttttttctggactgttcatggttgttgttgatctattcccttcttcctttttgttgatctatttcttcccatctttttgccagaattatttagggaaagagaataataataattgattttcttaaaaagcatagagattttcgaagttatcttataagaatcaaacctctaatatatgaagattttgagaatgtttgaaagaacaaaatcttccccttaaaattctctccaaaatcacccattgaagatgacctaaatttcctcacaccttggtcttcgaaaagtttcacataaaaccacttcgtctcgtgatgtgatcgcaaaagccctgtatatgacttctgtggtagacaagacggttgcattctgattttgtagcggtagaagaagaaggagctaataatttgtttacaaactaggcttagagtagcgaaaagagcctatagtatgttactcaagctgcctcctaaatttttgaatacctattatcaagtcctggagaaaaatatatgatacgtagctacgagggcttgccgtgtcagcgtagttgattgcattgcaattttagaaaattcttgacaccgaatcctttgtttaataaacaataacataaactaaactataattgaaaatctcagtgattcagggaacaaggagacatttagaattgccaaaacttgcttcacttcatttcttattagccatcagtatacatagcttgaatacgtacttcatatgaaaatatgcttatgagccatcagtagacaactgacaacctagaccatatgcatttcttcatatgaaaatcacacaagatatgagaaagctatttatgtgaccaagacttcagacgacacaacaattggaatacgtactattatggtacttgtatgcagagacgaccgcagacagaggtatcttccaaatttaagctttgctgtcaatagtcattggcacaggctcctgctttgctgttgctgttcttgcttgttctagtttattcatttttgcaaatatgctgccgtaaaactgcgcgtccttcttgttatgttctctcaccttctgcttcaaaattttgtactccatcttgacatccctgataatatccatcgaacagtggttaatacaaaaagaaattccatgtatcagtgttacctatttagaactaaagtatatgaactgtatatattcaagttgataacacttgagaacaaaagcatacctattgtctggctcaatctcaagggctttcttaatatccatctcagctagatccaaatccacaagatgaagatacgcttgtgccctccgatacagtgcttttacatttctactatcaagctctaaaacctgcttgataaagcaaaagtcagatgtcaactattttcactctattccctttttgaatcccgctaaggctaaggctaaaatatgtttccaatcattacaaattatataaaaaataaaaaatacaataacataatttgtgatatttttaattgctataaattataaattaataataaaaaaaaaaacaagtcaccacctgaaccatcaccaccacacctaaaccaccattagcaccacacctgaaccaaatacgtaccacctccaagccaaatccctcccaaatcagaaatccccacccccaatttgaaatcctagcccccaaatcagaaatctccaatcatgacaacaccaggactttgccgcactcgtcggtggtgttggtggtccggcgaggctatggtttaggaagagggtaagtgaggtggcgggagggagaagaagaggctttaggagagagaaacgggtagaagagtttttaacacgtgtctatatttcattgtctaataagtcagcttacttgcaaagtcagttcacatgtaggcttggagttaatcgaatccaacttcaagcaaaaaataaaaaaaaggcattcataaaatacgaggacaaaaaacacaacataaatatcgtaggaaagaaagtaaatctcttaggacggagtatagggtgcgtaaatgaaaagtttcgtctgatgcaaaaataatttagaccgttggatttaaatatctcatcaatatcaagatgagatgatgaagtggttatcggatatgttgggaaaggtagtaatttttattcagttgtcaaatgcgcataactggacatcgcctacaggctacaatttttcgggaaaggtagaaattttatttgaatcaccggacaaagcaaaatcaacaaaaaaatgtgaaaaatactgaaaatttaagtaacttgattataaaaacacaaacagttttattttgtcaaatttgtatacttttttttttcaaatttaaatattcacacaaattaattgttactacaagtttgaaagttattttactttttcaaaaagttaattagtagaattttgattatgatcatcatattattatcttttcttattctattgataagtctaacttacattgacactgtcatatcatataacaaaataaaatcaaggagacaaataaaaactaaatatgaagacatgagttaggaggaaggaaaaaccaagcacacaatgttccactttggctcactctctcattatgtacaaattttactaattatttcatctctttttatgttaattagacttaaaataggaatttgggtcaattaaattaaacgcagggtcatatatattctaaacttttgacataatcgaaaacctataaacttttgacataatcgaaaacctatatgaccctacgttcaactcaattgacccaaattcctattttaagcttaacaaacaagaaagtataccatcaacataagagactgagcaattagtaaaaatagaataatatgtacttgacttttccttcatcagaactcatgttttcatatctaacttttatttgtctcctttatttattttagtatataatctcaacgtatcttagacttaccaataaaataaaaaaataataaaatgatcatcataatcaaaattctatttattaaactaattaactttttggaaaagcaaaagaactttcaattttttagtaataattaatttgtgtgaatattcaaattcaaaaaaaaatataaaatttgacaaaataaaactatttgtgtttatataattaatctatttaaattttcagtgtttttcacatttttttttttgcttttgctttatcaggtgattcaaataatttctacctttcccgaaaaaaatgcagtccttgactctgttactgtagcatgtaggcgatacgcatttgacaactgacaaaaaaattattacctcacatcacactaaacttgtttcgctcacgcaccctagactcagtcatcttttaggttctgaaaatatatttagccttcagccaaggaaaaagaacaaatttaggctgaatcagacaaagaacctttgtgcacatcttctctgcctgcttgtagtcctttagcttcaccttacaggctgcattgttgaggttgcatgtgattttcaatgtcttagtctgcagtttctcctcatcactgaaggaggaatcatactcgacaaacttcatggcctgtcaacaagagaaaaagaacacctattgttagttcatttttaccacaacataaccgtcagtaaccaagttacataaataagatcttttggaatttataggtataccttttcatatctctttgaagctctttcatatttgccaaccttaaacaaaacattcccttcttcctttttcttcccagctgcctcaatcttctcttgtgtattcagatcccacgattccttttcctgcacccccattttcagtaaatggttttacatttcaaattagttcaaagtttaagacgaagaagacatgataattctctcacttctcacctttacaaaggaaagcagctcaacttcatagtacacagtggaactaggaggaacattagccaattcctgagaggacccagatgggccaaaagcataatcaggctgtatgatcagcaatgcaatttcccctttcttcatgttcttcacagcttggtcaagtccatcaattacttgctctacatggtcgatcaaacatacaacttagtaactagtaatagaaaaagcaagacttatgaagtttaaatgattgttagaggtaccttcatcaattttgaactcaaatggctgttcatcatcgtagcccttcttaacgaaaacagttccatcttgcagcttgccaatcagtttcactgaaacaaaagaaataatgaaactcttcagcatcccatccagtatatacaaaacctttaaatgaagaaaggaagagaagggattgaaaatattgtaataaaactgtaccttgaactacagctccatcatttggtcgttcatatccctccccttccttcaaagtcttcttgagaacctttctatccttggtaatgtcagacacggtcttccacgagaccaactcaagatccacttgaagagaagcatttggaggtaccgcaccttcatctcctgaggctggccttccactctcaccaaatgcatctgcaaaaactttgaatgtcaataaacttgcacaagcaaaacgtgtagacataagtattgctgataacaacagtcttactcacattgtggtttcacattcaagagaactttttctcccttcttcattgtttttacagccttggccatagcaggacaaaaataccctgcatgataaaagaaaagaaaaaagtcatattattgttacttgcaacgagaatcaagttacacggtaaggacaaaattcaaacttttgaagcatgagactgaccctcttccacagtgaactccaccccatcagattttgaaatgactgtcccatcttcaagcctagcttcaaacttaactgcagaaaagagagaaagaaggaaactttaaacaatactgaaagtgttgctaaacagatgaatctcaaagacaatacaggatagagtttcgtaccaaacacttcatccaggtccttaggattgtcccatttctccccttcagtaataatgttcttcaagattcctccatccttgcatatgtccttcacacttgtccaagatagcaactccacatcaaactgcagagttgcatttgggggaatagtaggaggagacccagactctccataagccaattctgggggtattgtaaaaagggcattctcacctttcttcatggttttgatgccttcatcccatccctttatcacttgccctgcattaatcaagtcacaaaacattaaatactatagttattcattcattcatcattaatcactttagtttaattttcatgtccagcataaggataaattaaaagactttcatcctgattacatttgtgatttattatgtatgtaaatataacattaacaactatttttttaatcaatgaatgattattcatctacatacagagtacagacaataccagtaacaaaatttcaacttaatacttcatcaattactcaaacctcccataactaaattgatcctaatcaatttttcacttttaagcaaagaataatatcactcagcaaagaattttatatagtcgatcaattgaaatcctctctatataaaatcaataatccgcctctacaaaacaaaagaaagaaaaaagaatgcgtaccttggcccagcttgaacttgaagggggtgcccctatcgcggctggaatcaaatttggttccatcaagcaaggttccagtataatgcacttcaacttggtctccactgtcaggggtgtcccaaccttcaccttcctggagcaatttcttcttcagccccattttcccaatctccttctcctccccgacgttcaggatcggactctcaaactcttcctcctcaggcatttccatgttgccagcacttgggaactcgaagtcttcgtccatggcttcccacaacaagcgaataaatgagtacgaaagaggtgagttcttagaactcagaaaaccacacgatcacagaaaataatttttttatatttctcacacgatcacaagaaatggtttacggttatcatgtttatataggtaggagtggaagaggagagtgtgtctagagagttctataatccaaggttgtcaagatggttccagaattatcgtgttcgttccatttattttttactattattgtggttatgatgaccaggggtgcctctttatatattttaaataaataaaaaaagggttaaaagctaaataaaataagaaaaaaaattaattaactaaaaataatggattaatcattaaaaaataattattgaaaaatagaattactaaaaatatgtatattaaataaaataatttttattattaatatagttataaattataaaaaatataatttatgttctaacatttataaacaaattttttcatcttttttatcttatttacattttttttctctttctttatcctatttttatctataattggattcatttattactaattttagttaacttcgaattaaaaatactgttgacgttgaatctaactaaaagttgagcaagttttttctttattttatttttattaatttgatttggatatcagaatctatttatatttaaattctatttttcaccgggaagttgtaagtcacacgatattattttagtttgataaatatttttgtgttaaatctttattatatagttgtcttaaataactatttttgacatgcctctttccccctccttgctgatacttgaatatattgatcatgttgtattgcagttaccagagcccaaacggtcaatcagtgcttcgagtcaccatagtaactagaagatgggtagatgttgctgtttgctctgaggtagtttcagttgtttgtttttatatttgtggctaaatgttagtttatttctcattgtcaaaagtatagttgtagcttctacatttatcataatattctcttgactctttccttgctgtcacttctgattctaaactttggcatagttatctaatgatttacctctacatgcatctataatataaactgaatttttatgtctaataccttatattatatggaatttgggaccatttttttgtgacaatttaattgttaaattgattaataaataatgaccaattttttatatccatttaatagaaacagacctgtttcagttactgcattttgtaagtattggataaaaattcgtgtataacaaaattggcatagaaataactatagttggcaaggtcatattgtaatgtgatagaactggagcagaaatagctgaatagtgctgcattgtcactgaaattctactgctgatgtcagaggactacggttgcagagaaacttgtagaaactcttttcctcacttcctcttcagagaacagaaaagaaaatacaatatatctaggcaatttgagaggcctggttctcccatactgtccttactcctttctcaccactttttgttttccctcttagctgaagcccaccataactttccatgtttgccacctgttcagtgggtagttacatgaggtcatacctgtcacactacctaggtgtgggattaaattaaagttgcctctctttcctttctcaaatacagcttaaacttaggatgcctggcataatatataactaaaatggtgtctccaagcaagtgtgcgtgcattgcacacaatgtctgcattgcccacaacaaacaaggaaggacaagccgaaaattgatgaatatatatatatatatatatatatatatatatatatatatatatatatataaaaaaaactaatgtatcctgatgccagaggctcctcacatcgtggatgtatggtggagggtaattgtatgcagccttctccttccacaaaaattgttgaatatatgtgaaaaaataatagttttagggttatgcttttctatattgtcatttagcatgctgctgtatttcagtccattaatgcattttcatcatttaagaagaatgcagttattagaaaagagaatatatattttatctttaggaattggtccaaggatatgaccaagagactgctgcagtagtaatggccagacttgcatctcttaaaatggagacaggggtatatctcaaatcatatttggagagcgtttccctgttcctagattggtagtatgtgatcaacatggttctcaagtaagtacatgtattacattgtttccttttcctgaaatttactagtattgtgagtgttgctgatgtatgaaataccactttcataatgtatgagcagaaaattgtttcattaatccattttgcttggtaggtttagatttttcttgatgagaaccttagttgggtttcactgaagttgaaaaggctagattttttttattagcaaagctgaatccctcagcaacatacaataacgcacatgagatggctgctggttcagatgtaatcttcactgacaacgtgagccttcaagttgtctttgaggctcgagcatctgcagagactggctgtccaatcctgatagtagtgactgacagttacgggttttggactttggtttggacaatgcaccaatgacgtattctacgttttgctgttccattcagttattttcttttctttgttcttaaaggagagctggtcgtagcccatgcctattgaggaataaagaaagttgtgaaatgttattctttagggctatggtcggattttgttcgtggagaaataaaggcatcgaaagtataccctatgtttggttaggaaggaaaaaaatggaaggaaggaaaatggaaggaaaattttaaaatttgaatcggaaggaaaatggaaggaaggaaaaatttaaatttttgtaattaaaaaataatttttctttccattttctctccaaacaaacagaagaaaatgtttcgttaattgtgttttctttcctttcgatttctttccttttattttctctccgaccaaacggactcatagagtttggccctatgtttggttaggaaggaaaaaaatagaaggaaagaaaatggaaggaaaattttaaaatttgaatcgaaagaaaaatgaaatgaaggaaaaattaaaatttttgtaactaaaaaataacttttcttcccattttctcttcaaacaaacagaagaaaatgtttcgataatcgtattttattttcttctgatttctttccttctattttctctccaaccaaacggacctcgggtgttgcagaaagaaaggataatgaaatgtaagttgagagctacgtctgtgacagcaacaaagcaaatgagggtagtttgatcacactaggttgcagagtaattaaagtcattttgtgatgttgtggaatttgatagaattacaacaatatttgcaattctgtatatgaagttagcgttacaggacacatcctggtgaagtaaatactttttttttcccacagtgaacagccggtctcaaaatgtgatctcctttatatgaaggattgcttactgattgctgtgcaataagtcatttttggattaaatcattcaatggtgaaaaaccaaaagtttttaagtggtttaggggatctttaagctgacaaaacccccttcgattagcgtattactcttttataaaacattcttttttagtttttggttgtcaaatgcatgtggtgaaattcaatgttgttctataacaacacgttataattaattcaattttttaacttttaagagttgtcttattcacaataatttataacttatttttctctatcaatttctattaaattattattagttacatctcattttttcataatttcattccctattttaaattttgttgtcaaattgtacagataacatttaatggcctttggatttaccatgatgacattgtagaacctatttggtaaggaaagtgataaacttttactaaaagtatggacaccagtttctgtaccaattaagaagtaatgcattataagtcaagtgcaaaactttagtgaagcaaccttgagtgtggagtttttctcagattcatattatatttggccatttaatgattatgctgtgttccgggcattcaatcccggcctcaggtttctacatgaaaaaattactggcataactttcatattacttgcagtggagcattccagaatcatgttcctggtcacaaaggcacatcacataatgatgacatccctatgcaattgcaggggcattcagcatataagcaaactacgataaaattcaggtcctcacaagtgatgagcataaattgatcaatcaatgatctatcatccacaagttaaattataacatgaaatgaatagttcagatagtcaaagaagcaattcaactacaatcgcggtcaaatttcatcaaaatccttgttgccaatattctcacagggaaaattgttaggtcttcaaatacaatctagagaacctaagaaagaacagattgatgtaaataattgcagaaattaaaatatccgcaaaattattttttgtccaaaaatacaaaaggaaaaagaatcacttctttttcttaagttgtttaacatttttggcattggcttgttctctggtcttgcgtttcctggtgagagcaaactctccaaacttatgacccactttcccctcagtgatcctacaacgaatagtggttttcccattgtaaatcttgacagttgtatcaacaaattctggcaagacagtggatctccgtgaccaaatggtcttgttcgacaaaagatttgggttcttcttcatcttgtacaagaatgcatcaatgaatgctggtttgcgtgacagcagaggaggagacgggggtggcttcttagcgacagtgtttgctgcatcgcctacaattccaagaaactgcttggttagagccctaagcatcattgtaggcctcattcttcctggtcaaaccaaaaaatgcaaaccataatattaaactacagaaaatcaaaccatcgtgaggtcatttacagatatactaaaggaaacggaatgcaatttttgcttcaattttgttttatccattcaaacataatggccatttggagaggcttggggtttttttttttttgtgccaaaatctatttttcttttccatataaagaattaagtaaatagtcaaattagtccttcaatgatatagcgtaggtcatatcagttcctgaatgatagaaattatgcttaaaggttcttgaatgtgtatttcttgggtcaaatcagtcctcatatcacaaatctcagagactaatttgactctgacagaacacatatcgagagatcaattcaacaacgaatagtagcatgtttggttccctgctggtgcactttccaaagcaattaagcaagaaagcaataacagagttgctttgaggccaatgtaagttaaacaaaaagctttaaatacatatttggggaccgtgaatgtaaatttcacaattctatattactgatgtatcattttggcactaatttgattatttactctttcaaaataaaaaatacttcaaaataaaagcaatatattacgttacttgtttatttcaacagaaaacaaattgagtaacaaatttgacctaacaaagaagcattgaaattaaaactcaccccgattcggtctccaatgctgaaatccttctgctcgctctgaagaaacacgagaattaactgaggaaaacgaaaagaaaaataaacgcggttaggttaaatgaaaatgaaagcaaaatagcgtcagaaaagagaaacgcaaaaatgaagaagtgtgtgaatggcgagagaaatgagatgataaaacgcgattcccaaacacaactccgttgaatttcccgttcgagagtagtacaaaacccgggaacgggaaattgggaagacagactcacagtcgcagtaggaactagaaagcaaaggcgagacagtgtatagagaataccgcagataacgaaatagaagaaatcgaaagaataaggacctgatcagaaaatggaggaatggcaatgagcggcgacggcggaagaagccactgaaatggttgccggcgggaagaaccaacggcgttagggtttgggttatgaagggaaaggaaaggcacattttgacgtgctttgtgtattatataaggttcgtgttcctgactttcttctctctcctttttttagtggtttggtgtgtggcttaccggaagccactaaagtatcctcctattatttatttacttttaaataggttggtgcatataatttttatttttattttatactgatgcatgtaactttctagaaaccgcgtaagaatattttattaattttcattttattatattctttaacctacttatacaaaaaataacacatatcctctttccattccaaaattatagtcttttaagattacgacatactctttccattccaaaattatagtcttttaaggttacgacatactgattaaaaaatattgaattgatagaaatttagataaaatacgcttaatttttcaactattttttatcataaatcatctcattatccaccaataaaaaatacattctactacttattacttatttttatgatatatatctctttttaatgcaaatattaatggatcttcttaattacactatccaggcatatttttagaaaattaattttaagaaactattattttggaataagaacaaaaagctataaagaaattattattttggaacggaagagtatattaacagagaccgtgtcttcttgttttgttacgcaattaatttaggttcttgttctattttagagtcacagctatggaatatttgacatgggttaaagctggcttagagtgtaaaatttcaaaagctagttgcttactttgactacaatgccattaatttctttctaaaggttgcggtgatttctattcttgctataatttggtgatgtctattcataatattcatcaatatgtcaagttgtgaaatcatgtttatagaaaagcaaatcaaattgctgatatttttgccaagcgtggtgatgttgttcataactttcctgttaacgccttatggcagaatcagcttgtatttcttcattttcttttttaggttttcagttcttatttttttttcttctttttataacatattttgtggcttatgctaatatatttacttcacaaaaaatatatataatcatagtattatgtttttgaataaaaaatcatatgcacttatcaaaatttagagttgattgaaatcaaaatcgacataataaagatagattttataatcttttgcattggattacatctaccctttacgaaaagaatataaggagggacatgcaaaataaaaaacaaaaatttcggatacttgattgtaaatattattataatgacataataactcttctacataattcattacttataaataatttatttctaatagataaataagtatatacaatttgataaatagcttggataaaatttgtgctcttatattagagttgacgaaaaagactaacatccatattttaacataagttcttgtcatgttaattttatggactccaaataatacaccactaaagaaaaccttttcttttttatatttttccacacatattacattatatactaataataacaaataaacacgtaaatttatagtactctttcattaaaagtcaagctaattaactgacttcgttcattttttattttattttatgattgtagtccttttttatgattagttagttcataatttcgtattcaattcttaattaaatattagaagcaatactatataaggttgtatattacattagatatatnnnnnnnnnncacaatatccatattattgataaaacaatttatttgatacgtgaaaaattcttttgaattagattaactagttatattaatttctaaactcaataggtcagaagacacgtgcgtttaggaaaaaaaaattcaaatactatttttaatttagaaggaattataaaactattaaataagcatttaaattagaattcagattgaccaaattttcaaaaaagtcgtgctaaacgttaaaaaatcttcaagatgacctatagagtaacagattatatttaaccatttttattttcaaaattaagtcagctgcttggcggtgacccaatctattttttcaatttctccccccttaattacgataaaacaaagcaataaaaaaaattaaaaagtatacaatgttttaaaagaaaagaaaaatcaaaagacaaataattagtcaaatataggatgcacaaacatatgcatgatgtgaaacgcggttctgaccgaacaagtcgacaataatattaaaaaaagaaaatactaagaaacggcactgcctcagaaaggcagaaagtggaaatggcaaggcaccagctatatatacgtcaatccactctggtttttcccataacacaacaatcaacaatcaagaatctctctttttccattttcatgtctcttgtcttcatgtaacacaccctttctcttttctcccctctaagaaattctgagagaagaatagaaaagagggtgaatggttttttgagttttgaagaatagctgcatggggaagctggttgagattcttgaccaaggggtccggattgctgcaaggtttcactctaattgcccccaaacaggccgtaagtactaccaccctccatccttctccgacaagcacgaccaccactaccatggtggtgccaccacaagcagagtccaagaggttgtggcggcgaggagcgttgacgtaattctttattctgtttgacagatccatatttgtttatttttttggttgttcgattcaatcattgtaaggcgattcatacatgtattttcgagctcaagttgatgcctagttaaaatattacaaacacttttctatgttatacttatacatgttgattttaattccgtatcaaaaacattaatcgaactttcctataaaatctctatatagatctggtgattttacgcgtatgacaaaaatcacttagaaatttgttgactaaatgtcttcaaaggcttacaaatcctcatataggtcgtattgattaggcaaaaaaattcccataaactcatcaagatttgaaccccagtaaaggtttcttattaaaattgaaacattttcgtactgaattgaaatataagctcagtttgcaaaggtcaacgtttgattgcaatggttaaaatatgctgaaaattcagacaacttccctgttgataatgataggactaaagccgtctgcaaaaatattcataagtcataactatcattgtttgacctgaaaagaagttcggctcttacaactccatgtctccatccaacataatagaagtagtaaaatgttctccccaaggaaaaaaagaagagggagagagagaagtaacaaatggtgcagggaagactatatcgaaccgacttaaaaaatgattaaaatcaaaatggaggaaacatcaacagggtaaaatgtctgttggtgaaagccatcactactaccctgctgtagcctctgactagattgaagttttaaatacaggttgtgatttcatcacgtttcttgatattgctggaaattgtggagaaatacagtcattgcaatagcaattacagtcacagacacccccgaaaactttgaagttgtgactgaaattgtggtcatggactgttttttaaaaccttgactacgagcatatatgaaaaaggtacaaattaacagaacgacacattatgagtaattctcataaatatttattgtagcgttttgtgaaaatgagcaattacaaaatggtaatgtaagtaaacactttttgttgctaaaacaggtacacttctatttaaatattaaatgcatatttgccaccattttgtcactgtgataattgacaatggattgcagactcagaagtgtagagcaaattggagaaacagaagaaaactagggagaagaatctgttgccatcagaacatatatctcattgcaattggaagggtgaggggataactgaaggaggtgaaaaccataagcaccaacatggtttgtggtcccgaaattgcccaaggcttcctgtaaagaatattcagaaacagaatttgaagatatgactatgcttccagataatgaaccttgtatgctactaataattcctctgccttttctctggactgtgatatatacttgtccaagaacacctcctcactcctcagacaagcacaacaaataaatatacctgggaaccttcctgcaaagttttttttttttttttttatcgagagctggaagactctatatcggggaagcacgcgatccttcatgctatacattaaaacccttggctgatgaaccaggactgacttgggcatcataagtgtatgcaagaagaattccattccaaccttcaacttcttccctgatgttctaagcaaagttgggggatcttctaaacattgcaggccttcctcattggaaaaatcgaaacaaataattagctccagctttctcctaaatgttttatagctcaaactacttattgaatggattacatggacaagcattcttgaattttcatggaaacccatgcctacagtgcgcgaaacatagtttcctatagtagactgctgtgtgatgagaatacttggctgttgtttgagtagcattgcaagatgagacccaacaatgccacagctctccaagaagacaacattggccataatttttttgtactttgggagtatatatatatatatatatatatctttctcatgtacaaagattattattgatcaataatattttctcttcattcttttctttcatccttgtatacttgcgtcttccttgctgcttttctatgtgagcctgatacctttcatgttatcagagcacatctacgatccatggactccatccttgattctcctcggtctgagacaagcaacatgagcacaccagcaacaaaaatcatcatgaaatctttttcaatcccaattgcagacaaactggatgaagagagctttctgccatggcagcaacttgccttagcctccattcatggtcacaatcttcaagaccatcttgataaagacaaagtccctgcacagacattagaaaaccaagaaagcataatggaaaatacagcatacacccactggcatcaacaagataaccttcttgttcttggctcctctcatcaatgaacatggcattcaaaaacagaatggtaggatgcaattttgctcatgaaatctggacaaagctctagacttatttttcttcacacacacaggcaaaggtcaagcaactcaaaaatcaactaaagtctatcaaaaagaaaggctcagcttcagaatatcttctccaaatcaagaaaatagttgactccttaggagctgttggagctcctctcactgatgcagaacactctgaggctatccttgatggattaagtgaagagtatgctcctctaatcacatctgccatgtccagatctcctcctttctctataattgaattggaagcattcctattggctcaagaaaatatgcttgaccgtttcaagaaaacagagattacccctgttcaagccaacttcagccaacgaaacactgcacaagattatcctggaggtcgtttctcaggtggacgcagaggtagaggggatcgtaccttcagaggtaatagaaacaaaggttctttttggaatcaaactcgattacaatgtcaaatttgtggtaaacatggtcatcctgcattaagatgcttctaccgctatgacaccacatatctaaacacccctcaaggacctcagcaacagtatcctcaaaatcagaatcagagaactccacctccacctccacctccttcttttcaccatcccacatcctatctagcaggtcccgcatctctcattgacacagcttggtatcctgactctggaactactcatcatctcacgcatgactttggtaatctctcatctggttctgaatacaatggttttgatcaggttcatgttggcaatggtgcatgtatgcctatacaacatgttggtcattcttctttcacaacttctcactcacccactatttttaaacttgctaatcttttacatgtgccttccattaccaagaatttaataagtgtctcccaatttgccaaggataacaatgttttctttgaatttcatcctaatcattgttttgtaaaatctcaggtcagcaagaaaattgttctcaagggcactcttaaagatgacctctatcagttcaccaatgtccatctaaattcacaatcttcagttcaaaactcacccattgccctgttttctgcatgtaattcctttgatctatggcacaaaagattaggccatgctggccctaatgttgttagaaatgtattaaacaaatgtaatcttccttctatagttcaaaaacaatcttcagcttcctctgtttgtgaagcttgttgtttaggcaaaatacaccaattacctcattttcactcatctaccatgtataattctccacttataatattttctcttcattcttttctttcatccttgtatacttgcgtcttccttgctgcttttctatctgagcctgatacctttcatgccacatctgagcaaaacatgaataaaatctttctcactgcagagaattttcctaatagcttccacagaagggaccaatgttttcttcaaactaaaagtcaaaatggaggaattcttggaaatgaacttgcacaactccgaaggctcacacccaacagctgaaagagctcaattttgggcctcaagatttgtcaacatcaatgaacaatatctggggtttgtgacggatcaaaaacagaatctgggcttcagaaaatccaatttgtttgaaaaaaaaaaaaactgagcacaaacaatggattttgtgggaatctgctgattgaaacatgtctagagatgtagaaggattgagttctcgagaattcgaacttggcatttagataatcaacaatggaagtgctttccttgagtgttgacattgggttgacaaagaagagagaaaggatctgacagagtaagaagagaagtgattggaaagggaaaataaaagagcagggtgtgacttgagggattgcattaagttaacaaacaagacatcaaacactaaagaaggggttcttgggttgtctattatggttttgcagcttctaaagttgtctactttggttttgcagctaccattgttgagttgaggagactcactcacttcgctgctggtggaagtggttcggtcaatggttgcggagttgggtgatagggtttgggtttctagactttgactcagccctacgccccacggctgggcctggcccgctgggtacctactacctattcaaaaagggccaacttaatgaagggaaaaactttatacaccgctttattacaggcttcaaatataaggatttgctaatccttaaggttttaaggtttttttttgaagttaaaaaatattttttcaaataatttaaaataagagcacacgtaagtttcaaacctgctatcttcacgttattaacatgctccaaccaattaaggtaataggtcaattatgctaaaagtcaattaatgttgatacatataatattaaattttttaatgtatatttaatacacgtataagtttacataataaattttgtaataattaattttgatctaatgattaaagtattttttttacatataaaaatcacaattttaaataaaaatcataattttaataaaatttgcaggtctaataaaaattatatttgtatttacatgttaaattaaaaattatatttgtatttacagtttattaaacctgtaaattttttattaaacttatgatttttatttaaatctatgatttttatatgtaaaaaatactttaattattagatcaaaattaattgttacaaaatttattatataaacttatatatgtattaaatatatattaaaaaattaatgttatgtttatcaatattaattgaattttagcataattgacctattagtttagttggttggagtgtcacgttgataacgtgaaagtcgcagtacatgtgtcattattttaaattatttagaaaaatattttttaacttacgacaaaaacttacttacagatcagcccattggtactaatataattgggtctattagattaggctgaacttaagaaatataagttacatattttaattggacttattttaactttatacttttaaaatttttattttagatttttataaatttaggtaaaaaaataaataaatgcaccaatatgggctagtctaataggtcattgggccttattggactataaaaaaaggaataccatataaaatatgggtaagtttcatccaacctatttttcacgtttggtccaatggattggatagaactaactcgttcattttgtcagctctactataaaattgatactatattatcattattttagagggggaaaacattgttgattgttagtatgcctccaacctactaacattcataaaaatgtttgtaatatacattttctttatgatgcattgtttcttattaaatgaaatttatagagctcaattaatacataggtttcatttttctcgttaagtctcatttttaaattaatgagacatggatttcaattaatagaagaaaatgtgttacaaagagtgttaaaaaatatgacagtactcttctaacatttgtgttgttaatgtattgactaagaatattcattagtttgttatctttgacaaggtcattacttccatgtgactttaaaataagtcacataatgtgtattttgtatagtctaatcatgtaatgtcatgtggaatatatagtcacatcaaccaataaagtttattttatttttttgcaattcaaatctaaggacataataacaaattttatattttggtttttaatttaataatttattaaatgttaattaatctctaacttcctaaatatgaatgtcttcataccttgagcttccccacacaaacccacaaagaagctacttttctgataactcacttgggaggagcaagtcaaagtcaaccatgcggagaaggagttaacaacattttgatgtttttcccaatgttgtgaaaatcaaattagtcatcggtctgatcgaaaatctagattaatggatcaatggtcaaaccagtaatcaccaattggtttggtttgatcttatatatattaaaaatttatagttaacattctttgattaatccatattctaaatttaaaattattattaggataaattatctaatatatcaaataacaatagagtttttaacaacacaagtctatattccaaatttaaaagcattatcatgataaacattagttgaacccaataaatcaatgtatattaaaaacataaattttatgtgttgatactctataaaagttaaatttgttatataattattgactaaagactttagctcagtggttatagtaatgtttatgcaattgagaaaaatgtgtttgaaccatgtctttgccaaaagttgtctttttttattcaaattttaatactaaagaaatgcatgttttaaaatgttagtctattatctgtattttttttgtgtatcactttttatttatgagaattggacttaattagaaattaaattatacaacaagcttcagaattgttttatttatttgtgtaccttttgaaatattttgaattttttttcaaaatatttcaacttttataaataaggcattatttgatttcgaaattggattattatattcctaacccaaaatcttcgttgctgtattcataaaaagtaatagttctctcttcgaatcgtagcgattaatatcctttcaaaacaaatttattttcttcatttgaattgacagtgaattcttttgatttcttattggaaaatgagtgtttacattgagccacatgacccttgtcggaaagcatggttggagaatatgagaaacaaaactgtttcaagaaaggaaaaaaaaaaaggtgagctcaacccaggtcaacgcgagcgatactggacagcatacataagcgatccaaataccagcccggactgacctagacaacaattctcatctagaccattttaataacattggtttttcctaccactctcccaggaagtggaggagaaagtaaaccgtagcagcaacaacgcgattcgaaattcgaagaaaatatattgcttctaggcgtgcacccactaatgttttcaccatggacaccacaaattagttattgaattagaaagattaaagataaagtgattttttttaataaaatactaaattaaaaacaaaatataaaatataaaattttctattaggtcttcaaatttaaattgcaaaaagaaaatgattaattgatatgattatataatccacatagtgttacatgattagattatacaaaatccaagtcaatgttacttattttaaaatcacatcatcgaagtaatgatattatgacaaaatctaattaatcatcattaataagatttttatttacaaatattttttcagcctacactcacatatgtaaaataaaaaaatgaataaatttaattataaatatattgcatatttagtgactaacataaattaaattttaatgtgcaaacaacgtatccttattcattagcataatagatactttaaaaaactagaataattacaatatactgagagcgcatgttcgatttcttgcaatgcactttgctccttttctactccttaatccgtatctcttcttctcttttcaaaaggtatactacttcccgtgacagaaataaaatacacaatctacttgacttaaaatcaaagacttaaaatatgatatatcaattgaatgtcttccttaagtctaacttattaaagctcgggtaataccacaatgcgacgagattcctccctactgaattttaacatatctacgttctaaaaatttgagaccaccgattaactaaaaataaatcaaatcgtccactaattgatccacatgtttatggtcattgaacttttttgagagtcaatttatactcccgcctttaacaactatttctgaaagtaaattccttcttcatacacacatgcatgattgagtctacttatacaggcattaatgagatatccttaaagcagaatctctcaaacccatttctctccttagggcttctattatcaaaggatttaacaagaatgaatccaatgtaaaaggcagaaaccgcaagttagttattatgagacataatctcagacaaagaccatatttccccacccttgggacaaaaaaaattcaagaactaagtccggactaaaatatgggtccaggccaaaataatgatacgttactatatatagtaaaaatgtatgattgcagggataaaataataactgaagatggtcaacatatacaacaaaactcctaggaggctaccaaaatgaacagaagacacatgatcaaaatatgcacctaaagacaaactaaaaacagaaaaatactgtaaatagcatgtcaatgaccagaatccatcagagtggaagcattatcagaacctagtaattttctaccttcgctgaggaccgacagatgtgcagcataccaattgtatccagtatggtctgctcttaactttccttttttctctcttgatgtcagcaggatatcttgctggagagttccattcttttgcagcctctccttttaccacttgagccacaggggattcaggacccagaatggaattaacagttgtcaacccagaaccattcttttccagaactttaccactcttctgactcactgagttttcttccatttttggagatcttgggttgctgctatgggcagcctcacctaagtggctcttaagaggagtgtgctccttactagtgctccagtttgtcaccttggctattatttcttcattcttctttctcccttgagactcattgacaacttgtgtaagagtgggaaaccaagcagcctgtgaagtggaatctggctgtcgtgttttctgtcccttctggacttcagaagcagtggcttttgggctaacctgactaggatcaaccaatgtcattaaagatggtgcttcaaacatttctgattttccagattgctgtgtgtcaggtgtagcttttgagttgttgaagtttgatttccctgcttctgttgatgccagcaagccagttgatggcaaggtttcagcatcaataacagctgttgcatcggattgcattgacagaactgtttcacggatcatgaaacaaaaagtaaaacaaatttttcttccaaaaaaccattaaaatattttagtttaatttctttatacaaataatgcaaggcaaggacacaacaaaagagatggatcctctttcgactttcctctccacctttatacaaagaaaaacaatcctagaaaggatgagagagaaaactatatggatcacgccaaagcaacaggtgaatataattggtgaaaaacattaagagacaagatctaggcatgcatcttcgcaagcatgcaaaaatcattaccaacgaaactcatttggaaatttcagccccaggcaagattcagggatgcacaattgcacacaggtataatagccagtatgtatgtgtctttggtgagaataagtttatgcaaaaagatctcacccattctaatcaactatgaaaagtgggtaatattgcagtatagcacctggatctacagataacttctctttaacaagcactgcatcacattacctggtttcattgactaaccctagcatattacaatagccctactatagaatgtatcaagacagtacaaatgttttctattaaaaacaacaaatgtatatatacctgaaaaagagccccagttgccttccaaactgtcacaccggctacctgagtcaactgaagcatcaactctggatgaaccaagtttacccaagttattaccagcttgatcttgaacaggcactgcagtaagtccagacacttccctgtcaggctgagcagaaggttcagtagttaaaggagatgtatactccctagcaaggtcttctgcagccttcactaatagtccagcatcttgtgcttgatgtgacttggtagaagtatcaacagacttgttatattcttcatttagtttgatattaatatagacttcatcttcttttatgtctttctgggcacctggtagtggatttatatttctgcactctgtaccatttgacttgttcacaggcccatcatccacaatgtctaaagactctgaaatagctgggctttcaaaatgactggtagcagatttgggcaatgaagtatcgctcacaatggacctttccatgcattgagcatcaggaatatcatgttcatttttacccatttcaccagcagcatcactcttaccagtgctgtcactcttaaataaggcatttgattgtttgacttcagattgcaagatgtcactgggttgaagatctttcaatataatttcaatatcattttctacattagatcctacaaccttgccatctgaagctacatcatttatttcagttatttttacctcatgatgacttgtgctgtctatgttaattgccctagttgtttcactaaaggattcatccctctgactctcgttagaagaggccattaaactaccttctggtaaacttatctgctgggaatttttacacacatcatcagatccatgctcttcagaaaggtgaaccatacgaatttcatttgtctcagttttggtagcattcattgaggcatcaatgtcatctgatctttgatgacattcaactgtgagcttggctggagaaactttggtacactcttcggcatgcatttctttaggcgtaggctccctgttgaccagctccatcttcatgctattatctataacatccatatctggagagaggatgtcacttttttcactcaattggtttgcgttgaaatgaaatttattttcctcagtaattttgtccttcaagtcatctccctcatatttcaatgactcagatgattgtaggaaaggattttggtataccactccttcaagatctttaaagtctccatactcactctgaggatgcacttcatcagatctatcatcacatgtaggaagaggattaacattaacatttccttctcccttttcctgcaaatttttgttatcactggaagtagcaaactgtatcatacatgcagagtctccctgagcatcatttgtcattacaactgagtttaactcaagaggaaggttatctgggggcaacaaagaaaggaactcagcaccattcttttccttcagatgaacagctccatcacccacttgatgatccaaggaaactacaccactaactgctattttagacacttcttcactcgtttcacctacaactttatcagatgattccacaatttcaaccacatctctgtaggaattaagctcagcaccattattttccttcagatgaacagctccatcacccacttgatgatccaaggaaactgcatcactaactgctattttagacactccttcacatgcttcgccgacaacattatcagatgattccacaatttcaaccacatctacagcagaattaatctcatccttttctttaaaattagtttcctttgcaacagatatcaaactgcaatctgtcacattctcagcagcatggattttcttttctggcaatatatcaggcatggcttcagtttcaccaagaagtgagtcacttgacaaaccaaaaaaaacatcactatccacaatagttgattcctcagtcctcaagtctgcaatggaacttgacaatgggtccacagtagggcctgacaattgaccttgaaactccaccgcggttcccacttcaacactttcattttgaaaaatattagaattttgaatttggctgtcatcagttgacttgtcagttaactgacgtgcatctgcagctgtgaaacagataatcagacatgaaagaaccacagagaagaaacaaagaacacagtaaaagggagatattgtcataaaaaatgcctattcaataatttcttagaaaataattatgtaggttatgtcatgtgtgcgcatcaatatacttgtgctatcctggatatttgcatcaataaaaatcaaaacaacatatctgattttccccccttttaatataattttacaacagaagttaacttaaaaaggtatagtttataacatatctgatttttcaaaagtttctaacaagcaaataatactcaagttaaatttcattgaacaaaacaaagcaagacgaatagtgcacgtttagtttattgatgttcatcatgtagcagtcatgtgaaaagatgcaaattttgctttcatcagttgagcaatccaatcaacgtatacaaattaagtcaataaactgctttagagatttttttgcaatcatcaagcttaatacctgtaaatcatgcaaaaacataattatcattatttttaattaaccaggccaaaatgttttaccgcacacaagtccatactcgttgaaaaaactaacaaggcaatttaataaaaggaaatatgatgtaaaacactaaaacctatcttcgcaccattgaaatctttgtcctcagtagaccctgaaaattttgtttcttttatgtcaaccctttccacattagcacctgagtccaaattatcttgcaaccgttccttaatttctggattcgatccactttccaaaaagtctgcaactgcatccgaaaacacctcatcttctgatctaattaatttttctccatttccttcattgcccttctcattgttgcctgtctccaaggattttggacctgacacaaccaaacctaataaaatagcaacgaatcagaaaaaccttttgttttggaatgtagtactaatttcaaagtctatacatgaagaaaagtaattaaaattaatctcactaagtcaagatcagttagatttacttcattttctagtatttctcagcatcaaagttagtaagatttacttcatctcctagtatttctcagtattaaagttaacacactacatataagaaggaaatccacctggtgttttgtgatcatcatcagaaacatgttcatcatctgagccattcaaatggggttgtccctcggaggcagacagtttgtaaccttcaatggttccacagatcttcttgtgagcacgcctgtgcttggcactcggatgtggatttggaaatggccatccacatttgtgacacaaatgaactccatgactctcgtgtccttcaacatcaaatttttcaacaaaaaaaaaaataataagaccataaaaatcttcacctggagaaacttaaaacacttcaaaaagaacacagacacaatttccaaaaccagacaccccagaaagacaaagacttttcataagaaaaacaccgaaccaacaaaacccagaaagagaaataatataataatgaaacatggaaaggaaaagagagagaagaagaagaaaagggagaaaaaaggggatgaggatgagggcagtgaccctttaaagagaaaatgcaaaagaaaaagcacctgcagtgtgagttcttctttgatcctggttatccatcgaaaatgaaagacagtaagaaaatccaacaagtgaaaacccagaggaagaagaagaatggggaggctagaaaaatcaaaactttactggaatggaagcagaacagaagaaggcttggggcgtgtgtgtgtgtgtgtgttagattaagataaacagagaagctgcagagaaagaagagggtaattacagtggaagtggaggagtagtacactactggtttggagcaacagcataaaaaaacaaaaggacccgcacccatgtggacaacgtaagtcactcactgttcatggaaacacgaaacttccgtttccatctccattctccgcttcaaacacttgtacatttgtacgtccaaaagggtatttcggtcttctcacgttcttctcaggggtatacatgtcgttaacgtacaacacttcttagtgtgcacatgcgctgcacgtgcctctccccgtgacgacctttccaccgctgcggatagtggaagggttacatggctgtgacggtggggagaatgacggccaatgaggttggtggttggagtaaaatctttgtgatgtgtagtgtagtgtgtacggtctatccatgtaagcgtccaaagccaaatgagaaagtatgtcccctgcgtacgttgcaactacttctaacagttctattactatttttttgtttgtatctgagaaacgatggttacgctgcaattaggtttcggtctttggtgcatttcatttactatttctcacttatttgtatttattaaaaatttatattcttaattaggcgatgggaggcttttattgtgagctcgtgcaaaattatactaacatggaagactatatatggtacgattatattcacgaaaatagtaaaatttatgttgttatttaggttgtccaaattgagatgtaatttaataaaacatggtataaagtataaactaatgtgtttcatttatttcatttctcttttttttaggatgatttctcttctaagtatataggattaatctaagtgactgtctgacaatttatttatttaatctttcttaattttatttcattttaccagttattaagtatcaaacataacctcctcaaaaaagaagtatcaaatataaccacttaaaaaaaaaaagtaccaattataaccaaagttgtcaccacaatcaatgtaatttctgttttaaattggaataacactattcggcaagagagcacattgatcttaaatggaaaaaacagtaaaaaacagttattcaaaagtcaacgaacatatcagattattataatatttttcagtttactttgtagcagtttgttaaaatcatcgaagataggactagtacttcttaaccaattttctttaagtttcaatgctttttaaacgtacaaaaataattataacagattaaaaataaaaacttctgggacgttgggccatctccaacatatatatgattgttgatgtacgctgggtttggtttcgtctcgctttcgaaccaacagtatatgtatggagtagttcagtttggattcatacacattacacagttcacaaatcattatcatgccactttatctgcagaacttttttaaaatatataaaaaaaacaatattaaataataaatcacgtaataaactgtcattgcaagtttaagatgaattaaattaattttaaaggtcagttcaatatatcttaaaacacattaaaaacaaacaaacttaggtgtactgatcctaaatagaaaatgttagtaataaatagtttattctctttaaggaggcaaaatattggtgcaccaaaagtagtgtaaacttgaagagattccaagttattagaaatggagaaggagatggtcacaataatttggtgagttaagtggcacaatggtggggcccttagcaagtgctgtgttgttggagatcttgtggataaaatcatctttgcccaactggcagatctaagaaattttagttaaggtggttagtgtcggaggagcgtgccttagaagacaataaagaagtattataatcacataacaacaaatattggtattttaattgcgttaaatgatcaaatgataaggagagagaaacctttcacctttgtcctattactaacgagttaaatgagcattgaaaatttaaagaacacactagtgttgttattattattaagtatgatgaaattatgtgttttaaaaaataaaatactctataatgggatgtttttattattaatacttggtgtctctctgtaaattttaaaaaataaaaaatataaataataaaagttaaataatcgtgggtggattacaatatataactatcggtatgggttatttgaaaaatgtaataaaatagatttatgaaggcagttatgataataaaaaaggataaaaaatgtgtataccaaaactttgcattttttatatgtaattataggttatagatgaatatttcaaaataaaaaacaagaaataaattcaaaagaaaacttttaattcataagagatggtagtacacgaaattaagtaagatactgtatcaactttttttgaagtgatattttagttcgtccattgaatacaaaataaatatttatttatataattaaaatttataataatattttttaaaatattgttcatactactactagagaacatatgtaactagaagtgttaaacttaattaatttgcttatccaatccaaaaattgttagggttagtttcttgaacatgccccaacccgattaagaccatataaatctgaaacaagatcattgaccttacctgttattgtaatatatcaaccttattattgtgtataattaaattgtataatgaaaaaataataaaacttaaatatgttatcacgatctcactttcctttaccttcacttcctctctattcaatgcacgcataataactactttatctttcaaccacatttggtgtcgacacatacccaactaattcatctaaaactcatttgacttgttatccgacataatcgacaatataaatggatggattttatgttaaatagtaaatatttaattcactatggttttagatttttaagtttaatccgactctaaccgagtgacgctcaagcttggtctagaatatagaattcttattggcaattgatatatttaccttccctatttagtaattgcactttttttaacatcttatcgttttttttttcttttcaaaagtattccttttctgaaaattaactttttggagagtatttgattattcccacataagccatctacagtctaagacccacgctaacacacacacacacacactcactttgatgtcacgattcacacacattacaacaacgcaaaacttgaaccatatattaggtatcactcttaccgagcacatatggtcatgttaattatggccatgcctagtttgggctgtctggatgctttatggttcgtggtatcggtagagatcatatggtcacacacatggcatttgtgcataacaagaaaagtggaaattgccaattggagttgcaaatcggggttcccatcaagctttcatctcgagttcctcatgggtttcatcactttcatggcacatttattcataacaaggatttgaggaagcatacttgatttattggtgttggattgcgtgtgcattcgtgcgctgcttgcaaatacacctccagaatctactccctcctatattgtttaaggatgctaatttatttttctgtattttttttcctttggggagagtgaaaatttaatttcaatatgtgtagcactggaatttgatggatccccaattcacactttctttttttgggcaaaatggtgttcatatctttcttcctcttgcccctaattttgcttctggaaagtaaattatagaatacgtttttttatggaaagaaatgcttactgattgaaaaaaaggggtgaggggagaaaataagttttaagttcaaagaacaataaaaaatagaggtgcaaaaccagagtttatgattttatataaaagagtatctgtgcaataaaaatataaaaaaagaaggaaatatatttagcaattgtggagatataatagcaattgccattcctatttttcgttttggtctataggaatatagttatagaatccctatacccacacatattatggctgttgttgggttatcaatatagccttagcctgctgctgttctagcccaaaaacattcacaacatacaacaataggggattataaaatccttttttttttttcttctttttaaagcgcacccaatattctttttgttatttttcatttcaataatgtgttcatacatagatttgatttcattatttcgaaatctaaatctcaaagcagtgttaaaaaaattggttcccgtattttaaatttcgaaattgtataaaaaatttaaaaaattcagaatttaatttctagaaatatttattttcgtagttaatttcagaacttaatttttttctacgtttggaaaataagtttatcaaagattttttgttatagaaattaaaatcatactttgagatatttcaagggacagaaaaaaaaaaaaaaaaaaaaaantaattaatattttttgttatagaaattaaaatcatactttgagatatttcaagggacagaaaaaaaaagaaaaaacacgatactttccttgcgaacgaacaaagcgtttgaagattcactagtgactcactcatcatcttctttctctgcaatctacaaagaaaagaaacatgatgaactttgacggcttccagaaggctctggcggagcttcagggtcgctgctccacgctgctgggcaacctgacccgtctccagcccaaccgcgcgaggccgccatgggctcggatagcccagccctggggaggcaggcccatggccatgacggtggaggcaatcgaggagcgcttagagggaattcccgtttacgccctcagcaacgcttccgaggagtttctcttggtctcgggctcttcctccgggaaaaaccttggcctcttctgcttcaacaaggacgacgctgaggctctcctcaaccaggttacgcttatcgacccccacgcgcgccagggctctaaagttgtccccgttgctttgaacaaggtgtttcagctcaaggtgaacggcgttgcgtttagattgatacctgagttctctcaagtaaagaatgccctgcaagtgagtcgtttctttattattactattatcgtatgccaaatgtatagttggatacgctcaaacgatgctctgcgactctgcgtactgttataccgaaatttaaaaccttgcacactcctaaacccttcaaaaatcctaaggggacgtttggtagggaaaaagttttttcatgtccgggaatcatgaatcctgggaatcatgtttactgggaatgaataaaattagtttggttgacattggaaatctttagataagttttggaggaatcgaagagttatctatattttaattatttattatattatataatttaataaagaataatacgatgtttttactgttgtaaaagaaaaattaaacttgggagagtaagattactacctccccatgggaaattttcgattgagaaacattttcaggaaacatcctttcaggaatgttatttttttaaaatacataccaaacatggaaaaccaaaaacttctctcctaccaaacactccctaaatgctaccattagttcctaatatcttaatcaaacctgattattgagattcttttatgattttaatgtgtcatttgaaattaccttggggagaagattgaacagaacatgtgccactgttaatggttgatgtacgatatgattgttagaattggagtaatgaggattcaaatatggaccacttctgtagtgtctcggatatatggcaaagaagcaattgaatgaataatttatgctactggcttttcaaacatggcaacttgaatcatttcactgttcttctttgctttccacctttaacagataaataggccttattcttcactcttcagtgtttgtattaattcgtttagcccaggccccttggtactctcggaattatgattggttctgatatgtgatgttgtctaatggaggaaggtagaagtttctctttgagctagattattttttagtactttgtgtgcaatttatgttgacaaagctttcttgggggaaaaattactgtgtggatagaaagcttcttcacaaatttactatgattttggattggttctcaccaattaccagaattagagcttgactgctctggtgttgtactagtcatttttctattatgttggtctaattagctaatttgataccattttcttaaaattcgtcatgcatagttgatgtgaagtttgaaaatttgcttgtaatccctgtattatctatttaccttgctattggtcattgagctgtacagtaatgataatgtacgctcatgctatacaggagagggaaaaatctggctttgcttccagtggcttttctggtgttcccgttttccaggttcttctcccagctttttaagtctggacattccatttgtgtcttaattcctatgttgcgagctatttgaaaataggggattcaatgaatgtttcacaacattttaatactacataaattttaaggaaaagaagggtgagccaatgtttgaggctcccacccagtgtggtctcagggaggtagatgcatgcaaccttatccccacccaggggagtctgtttttatgctgattatctgtttatagagagaagcagaaaccttgcaaaattggatgaacaatcaaggacatgcatacaaacatatatgtataaataaatatatacaattttagaacaaaaaaaaaaaaagaaaaataaagtgatcttatgtcttagaagtacatcattataataatgaaagtccttgaatttcatagctgtgtaggtaacatagtcttcacttgtgaaacatcattaaacaagtggcactgagtggttgagtgtgaagttctattagcaacgtgcatgctttttgtgtatatagattgtatgtttgattttataattttatttaagagaaaaggggaaagaaccagctcaataaaaagaatgagagtgagagatacactccatagtcttttattctgatgcagttatcaatttaatattagttcataaatgggaattttggtttgtgaatatgatattgataatactccccaatgttgtcaatggcagatggtcattgtggcctatggcactgccataatgggcctcccttcacaaattgcctatggtggttggcaacaaatcctccccaccatggcggccatgaccatttaacaacatggttactccctctgtcccattttgtgtgatgtttaaggttttggcacaagaactaaaaaataccattaatattttaatttcataaaaaatagtgttatttcctaatagattgtcttttatatgaattgcattctctctccttcatacatctcttttattttctcactccataataagtggttaaggatataataggaaacaaatatttaaggattcatagatatattaaaatgccaatcaaaatgggactatttttttttcttaattttgctaaagtgtcaaagaaaatggaaaggagggagtactttggtagcaagaggcccacaattaggaaaatatattgctagttaaagtatttagagagttgttgttagttgggactctgatgctgtaagaggtaggatataaatagtgggagagaatgtaagtggaaggagttagttggttagttagtagtgggtgggagagaccaagctttcgattctttggagattactttaaatttaaaaagccattatcctcattctgggttccattgatccagagtaggaggctgcaggatgctgctcaataaatttgcctttctttcattctgttaatttctacattcagaaccagtatctataatactcatatgataggaacccaaaccccaagcccctcaagttccgaaaacctctacaggtttacagcctaaaccactattctatccatgaattcctaactatagaccatctaaaattcttgtactttactgctactcataaattgctgctagcacatgcctggagtcctgtatctttcaaacctcggattagccactccccattaacaaattcattcctttcttcaaagttcaaacctttgacggaagcattggcgaaggcagagtgggccgacgatggagatgacagcgagggggagcaaatggaatttttccgagaggggtcttggaggatcattttgcttctgaaaatagggtcttctatttcatttttgaactgggtcagcaaacctggcccgaatagcccatcatatttgggtttttttaaacgtgttcaaactgggccacaaaaagccaccttcgggaacggaacagttaacattccaccgttctcgtgagtaaacccgctcttgatgaccgttccgcagtgtctccgatctttcctccaagtttgctcgatggagggtgcaaaacttgtaactcgtacgagtcaacgagtaaactcatgttttttacaacattggacacgaggcacctatacaatacaacatgaaatgagtatcaaactttaaaaattatgggcatataacacaaattaagtatcaagtataaaattaaaacgaaatacacaaatcttgaatcaaaagagagaattggtgttttacagttagcacgagtcattgtaggcataataaaaggctatcatgtttctagtttttgtggcatttccatatgtattggtaaacaatttaaatataaagtaaaaaaaaaaagaagctatttgacacgaatatgtgtctaacacacaggtaaaacttatattttgaagtacctgtgcttccttgtttgccagtttttttaacggatttgttatgtttatgttatgaagaaacttgattgagttgatactgtattagagacactatgaactggacctgttctactgttctacaagtatatttggagcactaattcttataatcttgttatcatttgtgattgcactcatttctattgatgctatgataccttaatttttttcatgtgtgaatcccttaactagtattttgagttgttatattggtaagtttcagtccagaagtctgatattgaagagccaaaataagagatttcgtccacttttcttcagaaaggtattgttgatttgctcgcattgagttacctgagattagatagtcagaaatcaagctgaatttttttaattctcaccttacgaatttttcacaggaggacttggaaaatacacttaaatcggcagcccttgagcagaacaaattaaatcctactatgagaaaaggcgatatccaggtacagaccacaatgattcccttcaatgtatgacctgttgtttcagaggaatcaccatgatttattttccaggttgccactctagaggatgtaataaaagaaatgaaggtgagtgtcaaagttacagtagaagatggaattcacttaaccctttgtgtttgttactcccctttttgagggaagggattttttgcaattatctatattccttaatctaatttgtaaattgagactaaataaaataattttgcaggaaaattctacatcgaactgggatgatgttatttttatacctcctggatttgatgtttcagacgactccaatgagcagtagggcaggatgatgatcaaattcatgacaccttttatgcttatggtattagcttttaatccatagcacatgtcaaacaattatttaggttttgtgcataggacaaacttctgactgcaaactcttctatccttacattgatcatctcacttccaccagcgatgggcataacaaaccatcacatcacgttgacaacaatgaggtaatacagtggaaatggaaaagaactttgattctgaatggattttggttgtcttcaatatgaaacgttattggaaagtttgggttttgcattttctaatttggttttcattatcaagtagattttagcagacttcataatctttattactaatgtacactaactgaattctgaaatatcgtgtaccacttggaggtgcttcacttgatcgtgagattgctattgattgatttggagcggtggtaagatctcaaatggtagttatctctgaccttgtttacgtcacgaaattgttcatcactaacatgtagtttaaatgtggtctcattcatttttctgttcaatttggctatttcgttaacctttcgagtggtctcattttaacttcgaacttatctagagtaacttatgcacaaagcacctttagcacacgataattttttaaccaacatatcatcaactatcaaggaagttcctctatctagtacagttgtcttggctgcaggaaaaagatagcacaccctacaatttcagcaaattataatcttccttgatagcatggacaactttaaattgacaattgccttacaaaatggggtatagtgccgtagtgaggggtacaagtcaaagaaaaacaggctgatatccaatccaaaaggcatagattggttggtcctccatttatggatgataaatattaatttttttcttttttggtttcctgatgaatgatgattgctgttgctcacagaaaaatcaatttcaagacacgttgtattcataaagagatggcacaaatttgttccctttctcgtttactcgttgctttactggagtttgggaggaaaagaaatggaaaagagaaatagacaacagatatcaaattctcacttattgtttaagaaggggcgtatgaataaggagattttttttgtcgtaggatctaaaaaaaaaattcaccccctccccccaaattggcatgaaggaaggatctcactttcctgtcgtattttcttaaaaaactaaatatttttttataacaaaagattaaaaaatatcaatatataattttatgttaagaaaaaataatagttaaaaattaatttttagattaaatttagtttttaattacaaattatttttatataattatttatttttctctttcactcttccaaacaagtgaagagaaatttctttacttctttctttactatttttatttattcaaaaaacatttttattctatttctcttttatttttattcttttctatttctttctttcttgtctatttcatttctaattgaaacaaagtattaggctgatagttacctccatttattcactaatcatctaatatattcatgtacaaatttatccgcccaattataagaataaaacatgatggtttggatgatggataaaccatctatcgtattttataaaccaataatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactatttttatttattcaaaaaacatttttattctatttctcttttatttttattcttttatattatttctttcttgtctatttcatttctaattgaaacaaagtattagggcgatagttacctccatttattcactaatcatctaatatattcatgtacaaatttatcctcccaattataagaataaaacatgatggtttggatgagttataccaacatattggatggataaaccatctatcgtattttataaaccaataatttaaactattggatcaatgatgatcacaataagagcatatgctcatagtaggttctcaaatagtactcacaaggagagaagttttgttgacaaataaaaaaataattttaaatggataattagatatccatctgtgaaaattattggcaaataaattagatgttttcttttaaatgattaatgtatttttaatgaattaactattaatttgaatttattttccacacgttattcatgtaatattttttaacactgttaatcaacaagaaataatctcaaatatgactatttaaataactagtataaagcttaacaaaactatcaaacaacgatttataattaaatgacacattatactattaatacattttaaattttaaataattttttaaatctattaattttaatccaactcaaaattatccaaaccattcattttacccgaaatcattgaaatcacgcgtttgatatgataagagttggtgagtccccatcccaaaggaatatctcaattctcaaaccccaaaaatatgaatccttatatttagaaagcattttttcatatataggacccacctcaacaatgcacaatgtgacgttgcgcttccttaattgatggattttcatttggttttcggtgcactctcctgtgttgtgtagaggtctctttctattcaattgcccatcgattcagacttggaaaccaaacaaaaatttgttcatcaattactaatataattataacatgcatgcatgtacccagaaataataataacaattaacatgcatgcatggatcatggattttgattttttatttgagcattcaacttcttatttcgtactttccaatattactgtatgcgctgtacataccagcattttttaaaaatgtttttacgtctgtcgaaattattttgctttatatttctgtcttttagtttgtgcttgattttgattcactataaaataaattaatttcaacacctattcagtgtacacttatgttaatttattttaaagatttttccccctacaatttcttaagttaaaaaaaatgtcaattatttcttcaaacatgcacttatagtgtgtttgtacatctcttagaagttagaatcgattttaacctctaaaatcatgatgaaaaatttaaaaagttgaagtaattgtttgttgctttggacttcaacttaactttagtagaattgaaacttaatctaaacacattgagctagaatcttaatattcagattaattcattttacaaagaaaaaaaagcttgtaatagaagttttttttttttttgtttccttttacaagaccacgggtcaacaagagaaaattttactcgacatagagtatttaacatagttatgtgctctaaaattaaattagaaaaaagtttataccaattgattcatgcattcggtaattataatttttcctaatattagtaaaaaaacatacacgttaaactttgtttatgctaaataagacggtgttgcaaaggtcttagattctactaacttctacttgagaaaagaagagtttgtgttgaaataaaagatccaataaacatttctcttgatgagttgttgtttttttttttacgggagttgttttaattcttctaaattaaaaaaaaatgagttttattaatcaccaaatcaaagagacaaaagaaaagaaacaaagtttgagcctcctgcaacccaatatatatctaaacaagtatcacatagcctcgcatagcaaaatccgctgcattgaaaccaaaacataaacttatcaaaccaagatttgctagattcacgagaacagaagctgaattctagatttgttttctttttcatcttttaaccagaatagaagctgaatttcaaaatatctccttttcttttttacatgcacggtttatttaaatgaatatgggtatgcctcgttattgatttttagaatttttttttttaaactaaaatataaaaaaatatgtttgcatgtttatttnnnnnnnnnnnnnnnnnnnnnnnnnnnnnnnnnnnnnnnnnnnnnnnnnnnnnnnnnnnnnnnnnnnnttattattttaaaatttattctccataacttaattttagattaaaaattaaaatactttttacttgttttttgttctcttgttttcatgaatggtctcatctcatctcaatttttagctttttccttggaccttcaagttatatctcatttagtatatatttggtttaatttattatgaaaaaataatcatttacttttataaatttcttgagagagatgttaagaaatgattatttattaaattcaattactaagtatgcatttactatctaaaaattgttccactttacaaactaaacaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttacttctgttgacactagttagtttatatattattaatcattaaaaaaaaaagaaatgaaatataaaattgttaaaaatattattataaataacaaaaacatactattatagcttctaaaatcaaagttggaaaacgaatcacgtttattctatatcttatattataaatttaaatcttcttcgtggaacaacttatatatctatgccctttctcgttttgttacacacatcttataagctttggttttaaatcaaatcaatatttgtctccttaaattattatctatttaaaagagaccttttaattttcacagttattttttccaatacttaatttttttacaagaatacttaaatttattcaattaacattaagcataatatatataattcttataaatgatcatttaagtactattttattaattgattaatttttaatattttaactataaattttttaatgtgtatattttatatcttaatatatatttttaattatcatttaaataatttttctttaatttttctaaatctgtagttttcttttcgtatttttgtgtatcatgcaatacgagaaatatttgttagttttctccaaaatttatttatttgaaacaaatttgatatatatcccattcttgtatgcaaatacttgattagtataatatgaatgcgggttaatttgacgagccaacttaactaaggggagaaaaacgggacatagctagatacagatactcggtcattaattagatatactcatggataactcaggaatgtgtgtaaaaaagttctaaattaagtaattcgtgcataaagaatatgcaagtttttatatcttcaatttttgtacgtatacttgtttagtaccatttttctaaattaactgatgcttcatttggtataaaacaatgaatatagaacctgcttccagagattccaaattccatttccacccatttctggtttttaaacaatcaactgaccctgtctgccagcgcaacctgcagtcatatgggaaactaccattcaaaccatttttcattatggtgagactgttagctcaaatttcaaatacagcaacagtagttgcttttggtttggtttgtagatcacggattcacggataaaagttgaaactatggctcaatttgtttatctggaatcaatgtccccccttcttcaaagagaatattgtggttactaattaaatattattatgatacgtccatgatatttaattccacaattattgtcactaattagtggcgtataccaaatttaatcttcaccaaaagcatatgctataaaagattgttagaaggaacctcatcattgagctatggggatgaaatcacactttttttatgatctttcctttgcttttcatgaaggctgccatttgatgaggaataagtagttttaattaattaatggacctatatatcatatatgtgacaatatctcaaccatcaatatcatcgtgaccaaccaatttagttgaattcagcaatttcactgtctataaattctatagtcacattcatctcgttgttttactcttttgtttcatttgaactttccaagtaacttgcagcacctatgattccatgtattggctttcccaaatctactttatatgtagactcatattcaaccaaacaaaggttttatttaaaaggacgcaaaacataaattgccgaaagcatcaatcatatgcattatgcagtcgatttgtataattgtactgatatgtttattattttgttagcaaaagaaaacatgctttctgttttgattagatagaatttagaaagaagtgaaggacactaattaaatttccccaactatatgtattcacattaaaatcaggtccattctgaggtgctatatacattctcacattcattaaaatagtagtggagtactttttaaataaggcatcatcattttagttactttttgcaaggaaagggtggagattctgatagctggttgccataagttgattcccactgaccatatatctccttataagttataaccaataaatttgcacttttattccaataactagttagtggtgattaattaacattagagggatgcaaggctacacttcaatgatgattggcactaatgaatagtttttaagtatccaaatactccaactcttgatcttttttttttttttcagtctccaactcttgatctagtttctgcatttcctgaataataataataactataatttgtaacgcttattagtactttagtaatgaagcgatcattcattgccatactcttcgttactgtgccattatggatgcccttaccctcatttcaaggttgattctgtagaacttccttattaaatgctcggaccatttatcaggaaaaaaatctgtggttattgtaacaatgaagggtggatgcaggtaggaagtttgttcattcactaatattttttctaataaataatttgtcatacaagtagatattaatataattgtatatgcaccgtactcgtgagaaataaatgcatattggtttgaattatttttttatttgttttgtcattcacatccaaagttgttgtctgcattggaaaagacaaactaaaactcaagcaatgcaacaacccgaaacaaagcaagcagaaagagttatcagcatggccgaagtggataaccatgccatatcattggcaatcttgtgactattttttttgaattttaactccaacatcaaagaatatgtatatctatatgtcacaaacttgaagattatttaacagtgaaaatttaggtgttggtttaggcaatatcctaggggcaataactcagtacaactccgccacatggcaccatctaagtggatgcataattgatgattgatggtactaagaagtggtaaaataccctcatgtctttattctgcttccacatcacacccagttggcatccatccatcacctaattttctctctttttatgaaagaaagggaaattttgttccaaatcatacaaaaatggggtccacccctatatttccgggattaaatccttttttattatttatttttcatttgtgagtaatatcatggaaacaatcattgcccatactgaataatactagcatcctgtgcacaaacccaaaaaccataactcaaaatctattgaagtataaccaatggccaaacaaaaaggcaccagctttcaaaacttgctaagctggcaccagcttttggtcccaccagccccagttattgctccttcacgcgtcccaccatagtctcatacccaaatccccacctccatatatatatatatatacccctcttttgaacacactccctcacatcacaagaagcacaatttctctcctttttttgtgtccaaaatggctactatttctactcacaatattcgattctatgttattatgctagttgggataatggttagcactatggttgctacctgtgctggtagcttctaccaagactttgatctaacatggggtggtgaccgtgctaagatattcagtggtggccagcttctatctctttcccttgacaaagtctctggctctggcttcaaatcaaagaaagaatacctatttgggaggattgatatgcagctcaagctcgttgctggcaactctgctggcactgtcactgcttactacgtatgctcattaatatttgcaatacattatttaatttcattactacaatattttatactacaaagtacaaacaaaaatttcaaacacaatttaaatatgatttcttttgatacttttagtgttatttttcaatcaaaattacagttttacctggataatttgggtaatataggtttgtaataaatgtcaacagacagattagattattgaagtaaaactctgattctgatcacagaataatacttttagtgtatttaaattttgtccatatttcaatatattttctattttttccaaattaaaaaattgtattgtgctattatcatgtttcttatcttctttttttttggtatactcatttacccttgcttttaccataagaaaaatatactaattcaaattattagtttctttccttcttcatgagctaatacagtgatactgtagacttttttgtatgtgtgtatatgttttttcttcttcttcttttaggttgctttagaattgattcttcatgaaagaacatgataaaatcctgtcttcaaatacgactactattgaccgcttcttcacttaagacatcaacctttgtcaaactcaactgtacattcacgagaatgctattgtagcaaacccacaaaaacaagttagactacagaattttactttgtcaacaactaatgctttatttattcactccatgctgctttctgtttcaaacattgacgtatacattaatcaacttggtcgtttttaagcagtgaatttaactagcgctcgtgacaggggaaggtggctaactttgacctagtccaaaacattactaacttttaatattgaaaacttcggttcatagcataaactaatgacaaattaaaaaaaaaaaaggctcgtgtaatattaatgaactacttttatcataatgtactttctggttttgaattgataaaaaaaataaaaaatctaaggctttttttagttgataaactcatactattcctatgcatgcacacaatttaaattcctgttaataaacaacaaacatcacaattccccaaaatgaggtccttttctttgtcgagttgtttgtgctgctaccacacacaaaggccatatcaataactatagtaattccattttctgcggtgcagttgtcatcccaagggccaacacatgatgagattgatttcgagtttttgggaaacctaagtggggacccttatattctccacacaaacatcttcacccaaggcaaaggtaacagggagcaacagttctatctctggttcgaccccaccagaaacttccacacttattctatcatttggaagccccagcacatcatgtaagtgataataaacaaatattcaaaatacaattttttgtttattaataaatagtctatcaactaatattgcaatcaaccataatcattatatatgttaagttcattgactttgacatcaattatctttgaactagaagtcataccatttgaaagtgtaaattgttttcactgaaattgcatagaaatataactttgtttatctctatgctaagttttcaccaaaatccattaaccaaatcatgaattgggttaactgcagattcttggttgataacacaccaataagggtattcaagaatgctgaatctcttggtgttccttttccaaagaaccagcccatgagaatctattctagcctctggaatgctgatgactgggccaccagaggaggattggtgaaaactgattggtccaaagcaccctttacagcatactaccgcaatttcaaagccactgagttctcatccaggtcttccatttcaaattctggtgctgaatatgaggcaaatgagcttgatgcttatagcagaagaagactgagatgggttcagaagtacttcatgatctataactactgcagtgatctcaagcgattcccacaaggtcttcctgctgaatgtagacgctgaaggttccaagagatgaagagaatggccactttcttattggattagaatcgtctatgtaaaatatgctatgtttattatgtcttagattctttattgacttctgtctttttttttcttcctttgttttttttagtttctattttatagttgctaatgtatatgtatattaaggggtcataataataaatcatattctttgtaccactttaattttcttgtcaatatgggcagttagtctcatcctagctcgtccaccctgtgaaattgatcatgttggaatcaatttctatctgttcatataataaaaaggtgtagtcaagtttaatagcactgtagttctggtactgatcgacgtcactttgctcgtatggaatgttaataattaataatcaactgtcagaaataccacattgacataaaaaatcgtagaccctgggcattcaaaattagtaagatggctgcaggaaataagattaaacgagaggattcaaaatggggcattcaaatttaagcacataaaaacattaacatttgggataaaaattattctgtgcattattggtaagagatctaaagagaatatggaaattaaatgggtggcctgaataatttagagtaatttcattcgtacattatatatatatatatatagatattcttttttttgaaagtaagatatctcataaagtcataaaactaattttcgatatatgaaaattattaaattgaattttgtctttccaaataatttttttttgatatgcaagatatatgagaaattgaatttctcttaatatatttaaataactccatcattgtcaactagacagnnnnnnnnnnatatatatatatatatatatatatatatatatatatatatatatatatatatatattctcttcccaagcatgtatacatttcatcaattaaataatgtattaataagatggacccaaagagaatttttccctcaaatgagattttgaaccatcctctactatcagctatcccactttccaccattgatgatcctctatggtatctctctttccaatttttctccaaaaatttctagacaatgtagacatacatttacgtttaacgattacgataaaattaaattaataaagtaataaattggttaatataatatatttttttactgctggttaatataattttatgatccgtcaatcacatatttaagattgatgaatataattttaaaattgtatggcgagaagtacttgatagaatccaaattgaaacaaaacatcaatattctgcatgctcaaaaggtttcatatattttatattaacatgcagagcgcccaatatcgttggacaaaaaagaacaaacaaataaataaataaagagagagaaaataaccttaatcgtagggtaagacaaatgcatgcagacatattacatgagaaattatgtgaaatctctttctttcgagtcaacattaaaggagtttaattatttaagccacttaaatcaggggtgaatagcttcttaattaatattatcgaaaaagataaagagaaaaataaaatttctacttgtataacttttataaaaaaaattactgcatatgatttttacaataaaaagagacaaaaagggggaaaagcataaaataaaatnnnnnnnnnnattaaagtaattaaaagaaataaaataataatattattgaaaatatactgtattatctaaatgttactcccctaattttgaatataaaaaaattgtccacaatataaataaattttaattaattttactctatttaatgaaatgatccttcaaacatctttttcatttaatgatattgtatttctaatgacccttttatatcaaatttcaataaaggacagtttagaaaaaatattattttttaaatataattaataaaaataaataatattaacatattttctcaattaacgtaaattaatttttgattactattcaaaaccggaagaaagtatataaataacatagctgaaaaaaaaagaagcatttatcttccggaaaagtgatccatcataccttgactgagcaaatgttatccccttggccaaacataatcagactaacaattttgtttgtatcgacaattattgtgccaatgattgtacttagagatccctcttcttgaagagagagagagagagagaatcagacccctaaaaatatcttaaatgcaataaaagtgattgttggttatacgaggaattcattattttaggtgcgtttaagagaaaatataaataagaaaaacaaaacgaagataaattatatatgcgaaaaatataataaatttagggtatttagttttctatctcctcttttttcactttctacttttttatatttttcttttatttacggtggtaggaattaaagaatctataaaagacagttaagtcttttttttttacgtaagaagaatgaataatcatnnnnnnnnnnaataaaagtgattgttggttatacgaggaattcattattttaggtgcgtttaagagaaaataaaaataagaaaaagaaaacgaagataaattatatatgcgagaaatataataaatttagggtatttagttttctatctcttctcttttttcactttctacttttttatatttttcttttatctacggtggtaggaattaaaaaatctataaaagacagtaagtcttttttttacgtaagaagaatgaataatcattagatcttatgaatggttaatattaaaaataccaaaatccaacatcaaatttcacatttgtccaagctagtgtcatatgttgtgcattttattctctatttaaggttgtgtttattttgaaggatgaaaataaaataaaaaaggatttttgtacttttttatgtgaaatttacattttttatattctattttaattcaaaaatttatcttctatttatataatctctatttctattttctaaatcaaacacaccttaaatttatgagtatcaaaatattcactctaagaagcttacttcaaaactcaagtaacttgaaatccttgttttttcacatctgcaatcattccaacaattttatagttattcatatttttgtaatggcatgcaatggtgtggtattcttctattattttttaaaagaaattattagtatttaatcacacgtatttaacaaaaaatttcatatttaatttctactatgtgaaaattttttaagctagatgaaattaatctttaatatagtggaatgaagatactaatgacatgaccaaaaaaagtattactttttaaaaaatgagatcaaataaaaaaaattatttaacttaaaaaaatagggcaaattagaatgaatcataactgcgaacaaaaggcatttacaataacataaattacaaaaaaaaaaaaaaaaatctctaaggttcttgtcnnnnnnnnnnnnnnnnnnnnnnctgtttcaaaaggacgaacatatttctctgatatttagttttccaagactaaacctgatttataatttatatttgatatcactcctaaaaaaaattccaagatgagaggataaatgctttaagaccgcaattacagaattatccgcctggttgaatgactttttcttcaacatgaaccgcaaacgtaaccgttggtggccgcaagctctgcaccaacaacttgaaataaaacagttgttcaaatgaaggaaccaattattggtgtataacaaccatgcacataccgttattctgcaatgagtattaagatcatcgtgcatctgactaagacggtcctttgcaacttcttctgctgcacatgctttcctgcaagcttctttcacctgaaacatacaaggggtaaaaagcctcagtttggtaagcattttgcctattatttttacgctaattgattgcgattttgcctatacagacacgaaaaaaggatggaattacaagttcaacggtaaactagattaagtccaaaaaagtttatgaaacggacaaggaaaaaaacaattaaataatagtgagaatgaagatatattttcatagctcaaatgtatttaaaaagaaagctactgagtgatgctgtcaatacaatgtgccctcaagatagaacatggccaaaattaactgaccaacaatctttcttcttaagcccaaagcagaatattatatacttgtgaagaatgaatactttcatgttcaatttttagtttcctgtgattttatcatgtgaaaaacttgtatatatttcccttttgatcgattcccaacaaatcttgatacactaatttaatatctattaagacttaaaagagatagacacaattttcagtcataaaattcacgtgtcaaactgaaagggcatcaaaagcttgacaaaataacaagttttgctaggtgataaaataatgatccagtgaccagatggagaaaaaaaacggaacagaggtaatgcaacacatgtcaaactctacctaacacattagagagactaactacaaatcaaggtagtactcacctggcttccatcaaaaacaggattgttgttgacattatcagcagaactttctaacatatttcttagatgaaatagttccttcataagattataggcaacctcttcggcatctaacagttgatttttagaaaattcaaatgctctttctgcgtgaaggcgaaaagaaacacagttcaaacatgtgcaaacccctctgcaccctcttgggtttctttttaaaattccttttttcaaagcaacggcagggactctaggttgctctacaacttgcagttgagacaagctctgacaatattcgtgtgtttctggtagcttctcattagaaggcatcaggaaagaattatttccttttacttcagagtaaactgataatgacatggacgaggtaggtgaagccttttcttctctgttggtaactttgttaatcataggcgccaaggttgtgattggtaagtctattccgtgaacagaaattgatgtatcagtgtagctctctggcttgcatagtccatttaatacaacctgttcattttgcagtagaatcactttgcatgaatcatgagatgactggtattcaggaatttgagatttggggcttgaactatcattgtttaaatcacaagcctgcaaccctgtttgttgctgaggaccagaattgccagcacaatgttccataggaacacagccatttgaatcatttacaggagttagttgtaagtttgaagttgaaattggcagaagaggtgtttgatccatggattccgcaagttttgggtaatgatcatttactgaagcacctagaagtattaaaggtttagtttagaactacagctgccgtgaccaagaaaaaaattgaaagatactaaactaaacaagtatcttccacaagaataagaaccaatacttacaagaatcatcgttcatggtattcaatagaaatggaagcaatctcttgtagtttaaagatccagcctgtttcaacaatttaagctgcggacagcgtttgagaacctgtttcaaaatcacataatcaaacatatttcagataaatacatgacagggacaaaaaaattaagtatcagttaaatcaatgagagtggcaagtagaatcataatgttgttcgttaatgcaagttttatggaaatataatttagcactagataaatttagggtcctcaccgacgtcatcttggattcagagccattttcgatttcactagcattttggttattactaccttttgaaggccttcttgaacataaaactatgccattctgcacagttccagctttgtcaccactatcccctgccatgtcagatttttctgaggtaatattctcagatggagctctaaatatatcatttgaaacccggacatgatttaaacttgttacattctcctcagcatctagcacattgggatccgattgacttaggctatgtttgggagttaggaggggaggggaaggaaagagattcaaggggaagggaggggaaggaaaggaaggaaaatgagggaagttccttcctccttgtttgggagttaaaaatttatgaagggaggaaaattgagagttaatgagatacttttatataattaattttaatagtaattttaaagtgtatgataaataaattttaattagcatcaaactcaccaataattattcatcacaaaacattgatgggtagaatagtaattttaattaattttccttctaaaaaccccccaaatagggggaactataatttctaagcattggagggttttggaggagttttaaaaatccccaaatcctttccctcaaaaattataactcacaaacaaggagattactccagctaaacccttcctttccctcccctcccctcctaactccctctcccaaacatagccttagggtctgacattcagggggaaatctgctgacagattcatgctcctccagattcacaaactgcttgctttcatcataagcaatagtgaatcctttttctttacttgaatgatgcacatatgtaagctcagagacatcaccgttgatatggagcatattttgatctttgggtggtgactcattattgtgttgtctggatatcttattctgtacttccttgacgccatcattatgcacaacattcttagcagagtgaaaatcatccaccattactgaacatggattaagctctgatgcactcaagcattcatctttagaagcaatcgcaaagttttctgtatgttcactgacagagggtgcagataaatccccacaaaccacttcttttgcgtccaattgtgttgacaattcaggcaagtcttgggaaggtgtcaattttggctggttgccatgagatatctcattagaaggattaactaatacatagttttccaaaccattagattcaactgtgccatgcatgggactgctgtttgtcttatgttcgtctatagaagcttcttcactttgagatgacaaagggagttgggagctctttgcatgcatatttgcctcatcttgatgatcaaatttggatgcatctgtaaaatcaactagctacttcatatccgcataaaacatctaatgaaatttgtattattaaagtggttgaatacacaaggatagttaccagagtcatctttggtaagatccattagaaatggaagcaaccttttatagctgatagaacctggggttttaaaaagtttccggtgcaaatgttgtctaggcacctgcgtggacatcccaaatcatacttaaattgcaactaaatgtaaaaccatattgttaatattaccaaaaaatcagacacatgaaatgctagaaagccgactaactactacatcaaaagttttttcttggaatataatatcataaaatatttcatcacttatggttttgagacctaattttattatgtaactaagttataattatagtttagcaaagatcagtaactaaatgtctaacccataaattggtagcaaacaagattagaaacaaggacagattcttacggatttactcttgagagaatatttccccttgtcaactttcagacaagacacttcaccagcattttcctgagtgtctctggtaaaatctatcggtttgacaatgacctctgaattaacacatatatcagcatcaggaggagttgtctgtatatattcttcattcaagacaccaaactcctgtgccgtactagcctcagcacgatcaagattattcccgtagctagacaattgcttcaagtcatcattgtgcaaatcacttgcaacacctttaacaccataatctgcggtggcatccgtcttaagttcttgtttagactcttcttgactttgagatgacaaaagaagttggaatccctgtctaccctcctcatctttctgacaaaaacccaattttggtgtacctacaagatattatcagaccaattagctcattcatcacacatacccaactaaatcatcaaccaatgaagtaaataaaaaataaggggtttgccgcacaaaataattaccagaatcatctctcacggtatcctttagaaacggaaacaaccttctgtaattgactgaacccggggccttgaacaactttccctggaaacgtggtctgagaacctgcaaacagatcccaatcaactctacaataataaaaccatgttctcaaagctacaataatatttaaaaacaagtgttattcactggaattttaacctagagcacccacaataactcatgtaacctaattacataattcgccataattaaggttggatctaacaactaaggatagaaggcctaatcaataaacataaagaaacctcttaagggtgtggtcagggcttcaatctccaggtacatgtgtatgaaattcacccaaaaaatgcataaataaataaccataaagaaaataaattaaaaaacatgtgagacccttacagatttgctcttgagagaagaaacattcccagtagaaggggtatctttgacaggaacctctgcgtccagtttccctacatcttcgttaaccttggaatttgaaccaccgcaaatctcagagtcgggtagagtcattgctccatccaaaccatcaattttctccgaacaatctccaccgttctttccctcgcaatctttctccgaacaatctccaccgaagccccgagcctcacaaaaaagccccaaatcgggactctcggttgcttcggcgcttcccttgggaaacgtgctttcgatcaaactggggtttgtagattgcggaggggaataaactcgcctagctcgaaggtccttggtcagagggcgaggaagctccttgtcgtcgcgcttcggtttcttgcaattgattcggcgaaagccaaggagttcggcgcagggttcgtcctgtgcgggaacaggatcgaagcggagttgaccggagcggttccggtgatgatagagctgtgatctggtgcgggtcagtgttccagaagggtggttccgcttacgggagcttgggacggtgtccatggtctttgcgcgctagagttggatacgcgaaatttggcgcaatggttggatatgagagacatttcatggcgggaataaaggattccttttggcggggattttagtctcctttagaattataatcttttgtctttattttttttttcgacttcattgtttattataccctatttcttatcaattgtttttcagaatagttaagaaaataataaacaataagaaagtactttttcatataactaaaatttataatagataaataaattaatataaaattatattataaatacatatttaaaatatattttatatttataataaaaaattatattatgatattattttagtaaaacattgtagtttgatttataattaaaggtgacaaacatataatgatcaaattaagaagtaaaagacttgacctctcgttctctccttccctctttttttttttttnnnnnnnnnnnnnnnnnnnnnnnnnnnnnnnnnnnnnnnnnnnnnnnntacaaggccatgtttgaaatttaaatgttatgattttataggtttcctcaaaattgtaagaccatttttgagatttaaatgttatgatttcataggtttccttaaaactgtaagactatgtttgaaattaaaatgttataatttcatagttttttcaaaatcgtaagattatgtttgacaaactgattgacaagataactgaaaatttgtaagttataagttaaaagttgaaaagttaattaaaaatttataagttgacttatttaattgaaaatgttctgtaaaactaacggataaattaacaaataaatatcaaaaatgacatatttaataaatgtcnnnnnnnnnnaattctccttcatttatttcaaaattcaacaaacttgtcacacctataaagtaaaaaagcatgagcaaggatgcttgagttcaaaggaacaatatccaccttttaaaagtcctcatttgcagctatttgagataaattcatatataaattataaatgaagagttttttttaaagaaaaaaactgacctagatagttattttatgacacaaattggcaatggtttttgtgattaggatgttcgaaatttaaatgttatgatttcatagatttcctcgaaactataaggctatatttgaaatttaaatgctatgatttaatagatttcctcnnnnnnnnnnnnnnnnnaaataaattgcattgatataataattttgaatattatgcttaccattttttcaaccactactattaatcactcaatgattactagtaatgcatttgagaataataaaaatattttaataaaattgtttcaataaataatatatttattgttgttcttaatctgatgtaaaagaattcattaaaaaattgtgtaaaagaaattcaaacataaaattatatatatggtaataactattttttcaataatgtttttatatatattgtttattgaattttacatataatagtttaaagattttaatttttaaccactaacaaacatgtgtcggctgtgaagggaattttttctcagaaaatctatcctttcaactactcctattgactaaaatgtaggataagggatgaagatagattgaggaagtccgctacgtattcgtcacctcaaaggtcacaaatgacaaactatgacaagtcgtagtctatgattaattgattatcagtatatatacattcagttttttcttatcacttcagttctcactaccttttcttcttcttccacccaccgcagtagttttctcctttgtctattccgaacataaaatcaatcatttcaaatcattaagctgcaattacaatatcacgcaccatgttccgccaccgcttcctcatcgtgatgtacccagcacaaggccacataaaccctgcattccagttcgcaaagcgtctcgttagtttgggcgcacaggtcactgtttccaccaccgtccacatgcaccgtcgcatcaccaacaaacccaccctccctgacctctcctttctccctttctccgacggctacgacgacggttacacctccaccgattacgccctgcacgcctccgagttcaagcgtcgcggctccgaattcgtcaccaatctcatcgccttcaacgcgcaagagggtcatcctttcacttgtttagtccacaccgtgctccttccttgggcagctcaggcagcgcgcgggtttcacctcccgacggcgttgctgtggactcaaccagccaccatactcgacatattctatttctactttcatgaacacggtgactacatcaaaggcaaaatcaaagacccctcgagttccattgaactgccaggattgccgttattgcttgcaccacgggacctaccttcatttctattgggttcaaaccctactattgactctctcgcggtttcaatgtttgaagagcagcttcatgatcttgacgtgcaagcaaagcccagaatacttgtcaacacctttgaagcgttggaacatgaggctttgagggccgttgataagttcaacatgatccccatcgggccgttgattccctcggccttcttggacgggaaagatcccactgatacttcatttggcggtgacatattccgcgtctctgatggatgcagcgaatggttggactcgaaggcagagatgtcggtggtttatgtctcgtttggtagtttttgcgtgttgcccaagaagcaaatggaagaacttgcacgtgcgttattagattgtggaagtcctttcttgtgggtcattagagaaaaagaaaataagtcactagttgaaggaaaagaagaggagctaagctgcagagaggagttggaacagaagggaaagatagtaaattggtgttctcaagtggaagttcttcaacatcgttctgtggggtgttttgtgacgcactgtggttggaattcgacaatggaaagcttggcttcgggggttcctatgcttgcatttcctcagtgggtggaacagaagactaacgcgaagctaatagaagatgtgtggaagacgggggtgagagtggataaacaggtgaacgaggaagggatagtagaaagggaagaaattatcaagcgtttggaagtggcgatggggagtggaaagaaaggagaagaattgagaaacaatgcgaaaagttggaagggtttggccagggaagctgtcaagcaagatggcggctcttcggataagaatctaagggcttttctggatcatgtttgcccacaataaatgcatatatagcttcatcgtatctgaatttttctatcctttctcatttaatttaaagaacaatacttgtgaaataaaaaagttaaatacactataataataaatataaataaattgtaatatatatatttgttactattcgagatgtttaccttgctattcagttgccttttgttttatactacctcctctgtttctaattataaaaccttgttgattaatttatacatttaaagaaagtttgttaaacttaggtattagcgttaattttttttatataaatataacattttttaaatttatttcttaatattaatattattgaaattctatttatcttctcctatctttataaaaatgagaaaaaagacaattcaaatcaacatttaattatgtaataaaatgaattagaatattttagtaaaaaaaaattaatgtacaataaaattaagatagagttttagagcatctttaataatagattttaaattgagattttaatctaagattaaagatctctcaatatttctcctattttttttctagtattagatctcaattaggaaaaaaaaagaaaaagaaaaaatattatctttttaatattatacatatcttaagaattcttctataataatttataaaaagtatatatttttattataaatagagatagaagtgatatactaatatatagcttggttatatttatgaatatgttgggtttattttgttattgttctaaatagtccctgttactggtccacaataaaggcccaaaagcattagccagagatatgatcaggcgtcactttgggactttcacagcatgcaaagtacacccctcccttctctttcttttatttgttaaaatatagttttgaaatttactttccagatttaaaaactatgttttttaaatacactctcttctaataattaaaatttaatagaaatcacaaatttgaatttatctccacatttaatgtgtctctcttcatctcatatgatctttgttctttttaattatttgtctttaaaagtttttatgtagaaactaagaaacataataatttctcttcatccttaaatataagacttttataattaattcataattattaagaaaatttattaatttagttaataccattagatttatttgtaactctaatatttttcaaaattgttcctaaaattattgggactaactaaattattttgcacgagaagagaataatagtagttgaattttaattttaaaaattaaattcctcaattatctaatcttcacaagatagagaaaaagacaattcatagcaattactattatttatagactataataattagggatatttttgtataaaaaatttaaataatattcttatatttagggacaaagacagaagttataggtttcctatttcaccctttatcattattactccataatccataatacatgtatgtatgtaaattaattgaagatcagataaaaaaataagaatataattgaaaaaaaataattagttatcttgaaatttgtaaatgataaataaaaaacatttattaaaaaaaattcgatactaaacaaaaatgaaaataatctttaataagtttcaactaataattaaatataaattaaagaatttgttgcttaccctccacttagcagtatttttgtaagattttatatatatataaaaaaaaaaaaaaaaacttaggagagtgcaattagaataaagggattggaaaaaggccctcctaaaagtatacgacagccgaagcggaaattgagatacagagtttggactgtaattagaattgcggatcttgtcgctcgttttattttattttaaaataaagaagtgctcgcatgacaactgcaattcaaagctgcatatctttcgtagattatgggccagtctgaaaaaataacttaattaatatcttattcgataagagcttatgttacaaatgcttaacatttaataagttgttgctatttggatattcatgttgaaaagtgctttcataattttatagtatttggatatacattcttgtataagaacttataaaatgtttcattttacaattttaaaaaaaattaagaatcaaactaaaaataacatttaaaagtaactaaaaaaataaaaaaataacgttgtataccatacaaatattaaaaatataaaatcactaaattattatttacctatttttatagtaaaaacaaaaaaataagaataataaatctaaaagaaaggaatatcttttgaatcatgaaattagctgaataaattaaaacattttcttgagattataaaatgcttgtaaaaagtatcaatttgtttttttgatagtcttatagacttgatctatcacacgagtagatgtgttaattaatttggaagaattcaatatatattcatctctaggattgtttggttgaagagaaaaaatattatttaagaataaattattaaaaaataacgtatgtctcacatttctttttctctattttaattcatatatttactctcaattttatttattttttctcttacacataaccaaacaacccctgtgtgaatgtttttggctagggaaagaaagccaacaaaattttagataaagccagaaaaatgaaaagctgaaagaataaaaatgttatanaagaatttggaacactcaaaggtgggtttcgaaagctgacccttctaaaaataacacctaagcacttgctaataagctactcctacaacttattaaaataagctaaaaaaatcttatgtcgtaggatctttttataaaaaccatcccaaacattcataaagacacttgtaacataagagaagctgttaataagcttttccacaaacaggaccataatgattactttttgttaaaataaaggattgctcatcagtgaaaataaattaaagaaggtgtaattgcataaggtgtgcaattttgttttctagttttcaattttgcgaattggatcatttaagtattacaattataaatcaaaatcgcacaattaaagtatttagtgaatttaatttcctcaattgaaatatgaaagaccaaaattacataaatgcaatacctaagacacctaaaataattaagctatatatatatatatatatatatatatatatatatatatatatatatatataaactactatcatatatcagagacggagcgaggagtactaccagcaccatcaaattgagacaagccaaaaaagaaaagtaccaagacataaagacaagccaatacaccaaaaccagtctagtagaggcatcaccacttaaacaccccaaattcagatacaactttaagcctacaacatcacctacagtaacccaatatgctaaaaaatggaagcacaccattccacaacaagacatcgaacgaaatcaataaatttaccacaatctggtcgctgaagccataaacctacacggctagctacaccaaacattggctcgaaacaggagcaaagttgtcaagtgagtactgacacaaggtgccctagtaggattgaatattattttttggcacacagagtctgagtaaatgaaacccaacaaacaaactacgctacacaaactgaatcacgtctaatacgctctaaaaacaaaatcgggaggcaagttccgcaaattaattaggattggataatgatgttgaaatataaatttctattaaaattaataggaaaaactctaaaaattaggctcgggaccgagagaatttatatattttttttatagataaaaatttaaataaggagaaaacacgtattcttgtaaaactacaagaaaagttatcaacatcaacaaaaatttgttataaaatttatatatcgcctatgaatatgcaaaatgcaaaaatcaaacctaaatcacagcaaggttttctagaggcactgtgcgactcaaagtttgagaagatggaggttttgaattgagaggagttgtaagagagagttgcgacaaccaccatatgcttatgcttggcaaacgacgttctttatcatgtgatgaagttgtcatctccaaggggaggtatgaaagaaattggagagtcaatacatgtcaaaaccgttgacgaacaaactatatcttaagtagaaattatatgtgttaaagatgtaggaggatttcgctcttcaacaacacatgaatgtcttcaatcagattatcaactaaccatctagcaaagctagatgtaaaaattgagtatgaggataaaacatgtattctgttgtgttctttgtcttattcttaagaacatttggtaataactctaatatatgagaaagactctattcatgtgaaggggaaacaaaaatgcataagagcataagacaaatgttatcgtgataagcatatgaagaagtccaagtctataaaacacaaaaaaacaactagtgttacaaatgtaactagaagggacattttaaaagggattgcctaaaattgaaaaaatttgttgaaggagtcaatctgatagagaaatcaatgattcaaattattataatgcgagaaatgtcaactaaagtgaggaaaatattattgcacataattttattttgaccaaacaatattctatttttttttaccatggttaatcgttaagaatattcttgacgtttccacattaaccttttgagaattgagatttgagactattcctaatggcatggattgccaaattctcaagaatgccgctgcaataaattgcattcggaaaaaaattgaatggtacatgtagtaatgttgagcctccttttccaccgaattttttttttcttaataaaggcttctatatttttcacaacatcaaggagatctcaggaaaattgacggtgtaagggcctattcattctccatcgatgaaaaaatatcaaatatccttggttccggttaaaaaaaggcatatttattaagttaaattacatctctataattttaaattcatctttctatttttaaatcaagatttttttaaaaatttcagaataaacaattatgtgacaagtggttatttaattaataaatttttaagacatttattttatttaattgattttataaatattattttaagtgtatcattagtgaagagttattattttttaaattataaaaatttataaattaaaataaatttaatatttaaataaatttaatatttaattttacatgtatttatttattataaaaatttattttaatataaattaattaaaatttgttattgttttattataattaaaagtatagattatttaaataattattttatgtaacttaaatggcataaatttaaaataatatttaaataatctaaaaaataaaaaaatattactttttattattaaaaagttgtacatgttacatcataaaaacataaaaaaattatgaacttgtttgaatataagtcataaatatttttttgagagtttttctattaaaaatataattttttaataacaaatccgttaaaaatacttctaattttttatccaatattatgtatctctacttatactttttttccctttctatgtgccagttgagtttattgatatgaaatgcaaggtatgtgcctatctgtgacctattttgtgtgagagagggagtactgagttgggctggcttaatatacaaagtaataaacaagattaattaaataagttttttgttggttacttagctatttcaatttttatttttagtttctcttaaaactgttgtttcgtttatagtctctcgtctatttttttattgtacaaaattagtcactgatcttggaatgggaataaaggataaaaatcaatctcacatatattaattctgaataatgaaaataaataagaaactaaaatggacagatttgaagaggaactaaaaattaaaatctaaaatagttgagagataaaaaaaattatttaacccaaaattaagatgacacgaagcatgtgggggagccatagcaggaaatttatttggagggtggtccccctcttcaggaagctactaggtagatcatacaaaattaaatgaaggcagttagctggtgagacttagcttttgatgcttttgagattagaatccacaaacgtcatgtcacacaattcttttttatgtataataacacagtgtgatcatgcaatctatggtttctatcatgcatactattcgaaacctcttacagccccaactgttataattataattataatgataatactctatatatttgatactagtatcccatcccatgtgatgcaacagtttttttttttttcaaatataaaaaaatatgatagaaaatgatgaaattaatgataatattcttgtattttagtagtcattgataactgtttaacattgatgtttgaattatcgaagaaaaacttgggtggaacagagaaattgtctaagagatgtatttcaatttcaaacgacatgacgaagaatttcacatttttcttatgtagtcaaacatacaagcattcacattggatgtccatatacgtatgaaataagtgcattttatatgttttggaacattttcttctagcaattaaactccattcatttttattctaaaaaaatcttgattcattttcctgtaaaataaaactatattcattttcttcaccacagcatataactgaccataaaaaaaatactgatttaaagaaaaattccagaagcattataatgataatgcctataatacccaactcctcaacaatagaaaaaataactaaaacaatatatattattattgtagcacattaaattggtcaatgaggctgtatatgaatgaaaaaaagatttttgtctaagtgtgaattcacagcaaaagagggtaactagccagttccagcgccaccatgctccaccaccgcttcctcctcgtaatctaccccggacaaggccaaataaaccccgcttttcagtttgcgaagcgactcactgccatgggtgcacgtgtcactattcccatcactctccacatgcaccgccgcatgaccaacacaaccaccgtccccggcctctccctcgcccccttctccgacggctacgacgacggcttccacgccatccgcggcaccgactccgattacaacctctacgcctcggaactcaagcgccgtgcctcggtgttcgtgtccaacctcatactctccagcgccaacgggggccaccctttcacttgcttactctacaccttactcgttccgtgggccccacaggtggcgcgtggactcaacctcccaacagctatgtactggatcgaacccgccacggtgctggatatcctttaccactactttcacggctacgctgattacatcaacgacgaaaccaaagagaaaatagtgcttccgggattgtcgttttcgctttcaccccgtgacatgccatcgtttttactaaagtcgaaaccgagtttgttgtcgttcgtctttcccttgtttgaagagcagatcaaacagcttgacctggaagctaaccctaaggtgctggtaaatacttttgaagctttggaagaagaagcgttgagggccgttgataagctcaacatgatccccatcgggccgttgattccttctgcgttcttggatgggaaggaccctgaagatacttcctttggtggtgacttgttacaagtctcagatggttatgttgagtggcttgactcaaaggaaaagaagtctgtggtttacgtttcatttgggagctactttgagttgtctaagagacaaactgaggaaattgcaggtgcgttgttaggttgtggttttccgttcttgtgggtgattagagtgaaagaggaagagaaggaagaggaggaggtgtgttttagacaggaattggaagggaaggggaagttggtgaagtggtgttctcaagtggaggttctgtcgcatggttccgtgggttgttttgtggcgcactgtggttggaattcgaccatggaaagcttggtttcgggggtgcccatggtggcgtttcctcagtggtcggaccaaaagacaaacgcgaaactgatagaagatgtgtggaagataggagtgagggtggatcatgaggatggcatagtagaaaaggaagaaataaggaagtgtttggaagaggtgatggggagtggagagttgagaaggaatgcagagaaatggaagggtttggcaagggaggcagcgaaggaaggtggtccttcagagaggaatctgaaggcgtttcttgatggcatggcgttgcagaatcgataattaatgcacttctttgccaaataattttgttggattcccgtcttctgaccagttttgcagttcatgctaaattattaattaatgctgttctttgttgttgtttttcgatctgcttcttttctttgcccacgagaccatcacagtttacgtggttaaaggactctgtgctgtgatttttcctgtccatctgtctcttttttattttgtttttctgcttcttttcttttttttttcctatcattttcaatgaattaattctaagtttaaaatactttattatttagaacagttaacttattattgttttaagaggtagtattattttaagtttaaatataaaattttttctttatagttatatctttatttaattttgtatactccttaatattattttatttaattataatttttgaaaaatgaatcaaactgtgaatccgcaaagggtagttcttcgttgtcgctgggttggattgctggtgtagttgttattgtgttgttttttattgcagtggtgctgtttgtcttggaagtgttttgtcaacaggcgacaggggaagttcagtagggttaatggtcgtgaaaatgggaaaggaagttttaaacctgatgctgtccatgtttctaatggatatggtggtgttcccagtgagttgcaaagccagagcagtggtgatcgcggtgaccttcatgctttagatggtccaacgttttcaaaccaagttcttcgacaagtgacgaataatttctgcgaggagaacattataggcagggaagggtttggagtagtttataaggggcagttgcatgatggaacaaaaatttgctgtcaagaggatggaatctgttgcaatggggaacaaaggactgaaagagttcgaagcagagattgcagttcttagtaaagttaggtatagacatttggttgctgttttagggtattgcatcaatggcattgaaaggcttttggtctatgagtatatgcctcaaggtacgttaacacagcacctgtttgagtggcaggggcatggctatgcaccttggacttggaaacaaagggtagtaatagctttggatgtagtgcggggggtggaatacttgcacagtttagctcagcaaagcttcattcatagagacttaaaaccctcaaacatactactagtcaatgacatgagagcaaaggttgctgattttgggttggttaaaaatgcaccagatgggaagcattctgttgggacacggttggctggaatatttggatatcttgcacctgagtatgcaggtatagaaagcctttgattttagttctgtacaattgtgccttaattgtgaaattcatattttacttatttggtggttatagttgtaggttactacttcgatggtgttcagcaaatttaagtagttcaatagagtaaccacacataaaaaaaagaaaaagttgaaagggaaagtaattgatactaaatccctagatacatggctacttcagaattctttgtggctatttctttgcaatgttatattttgcctgtttcacgtgttttttttcagttgggtaggggttttctgcatagttcttggtggtcgatgcctcaagttattttgagccatttatacagtttacagagtctgactcccaattatcctttatgatgtgatgaatactctggtttgcatcaaatcttggattgctgtatattgtcatgagcttaggtggtagttctctgtcgcaattaatcactgctgtggaatttatccttccatcccattgccttggtggctcagtgcattgacacatcttttgttaaaactagttaattttgagcttgttttgatccatttagcatcaagacttttgcaagcataaaacttcctaaaatgttgcattggatgtgattagatgcattttattagtgctagtctactctattcgtttgattatatttaatgttactctgtttcttgccagctactggaagagtgacaaccaaagtggatgtttatgcatgtggagtagttttgatggaacttatcaccggtagaaaggcattggatgatactgtgccagatgaaaggtctcacttggttacatggttccgtagggtactaattaacaaggaaaacattccaaaggcaattggtcaaattctcaatcctgatgaggaaaccatggagagcatatagaaagtggctgagctgccaagccaatgaaggcacttcctcaatatttaatgacatttccatctcacaaacccaatcaagcatcccctctaaacctgtaggatttgcagactcttttgattcaatggattgccggtagccaaattgataaacgagacaactatccaagggcatcttagtccatatgatagtggaaggtttgcttgagaatacccaagaaaaccagaggttgtaaagctgctttgatctattagcatcaccaatttctttgtaattgtttattattttcaaaatgtcatcttttgtgttcttaaaatctactcatctgaactaaacatggatctctgagtttggcgttctttattgattcttttaagccgacggatgggttttaaaggatggttattggttgggttacctgatccggctgattgtgagcatgattattttgtttctactttttttaggaatagaaggactatagtctatacatttattattttattaattgtattatattctttttttcccccttttgaatcagaagtatatttatcgcatgtttgatgtttcataatctttcttctttgcccgttatgcatctatttcaacactccatccacctataaggtctagtgtgtgtataaatcatttccactcgataccttacaaataaataatgatttaccaaatggagcaatatgttctctggtcaaatgaataatgagaccacctgcccggaatttatgatgtgttgtagttaggaaacttaaaaaaaaaaaaaaactttgtacgataacgaaatctacaaaattgtttaagcaattgagttggggatgaggtggttagatagtctttatgtaaatagtagttacaaaatttaaatcctttaacattgttggtaaagtctagctaaggttctatacctccattttggaaggagagaaatcaagccttcttaccgtacctttnagttacgaaactttaaaaaaaaaaaaaaaacactttgtacgataacgaaatctacaaaattgtttaggcaattgagttggggatgaggtggttagatagtctttaagtaaatagttgttacaaaatttaaatcctttaacactgttggtaaatctagctaaggttctatacctccattttggaaggagagaaatcaagccttcttaccttacctttcgtggaggaggaagcaccacttgaacaatcatctaattggtggcgatagaaagagacataaagggatttttttaaaagaaaatacataattgcattgatatactgaataaatttaattttttgaaaatggatataatcttaaaatttgggtcgtgatgtggtgattttaatttcacatgatgagagcctacacaatacgtgaacgcacatatggtgattcaaagctcagtcagtagatggatgataactttcgcaacaaagcacatgttatgtgttactgatttctgtcttctttattgtggttacgtatgccgtatccatgttaagttgcccaccacattctagatgcttttttttacctattggcaaaaatatagggcagattgagcagttgaaaataattgaattggtaatgataattgagattcaattatatatgaaagagaattgacccgaaaaaatcataaagaaagaaaattgcaattgttagataattacttcgttaccttttattttattgtgcctgctggtttttataagaacgtgaacaccaggttagcataacaagtgtggagtgtcatgtgcttagggtggtcagtggaggttccatggatcctccaaatttcaattgcaatattattgggtggactatgttccctgtttccaccatataaaatagggtttgtgtctcttttaatatcaccacttagtgtattgttatcatagcagaagttaattgatatatattaacaaccgctaatgatatcaacgaaggaatagtacgatggagggtaaaaaattcagctgcttcatcgcgtgtctgtgtatcaaagctgaattccatgggcaatttttttataaaaaagatacaaagactaaaacaaaatatcgaataaattacaatgagtatatttaagtctaatagaaaatagttaacttttgaaattttcctttaattttagaatgatcgtaatttatctattttcaatgattcaattgttattttttctttttctttttaggagcaatgattcaatggtttgactaatgaacttagttcatttttcgtttgagaggccttattattgatttcaaactaaagccatcaatacaagtgaaaaaaaatgacaggaattaaaagaatgacaaaaaggaattgacaaacaaatgcaacatatagcaagaatcaatgttttattctgcatttataatgcctacaaatcaagctatagtaaatggcatcaaggtttgtaagagaaaacttcttggatctacatttaagaacaagaaatctccgaagaaatgagatttaatggaaatggttggtccgaagcatatctaaatttgacaggaattccatatatggtttgaccaccattaacaagacaaacattgtgcaagaccttcaaaagtgaaggcttttcggatccaacggattgaaatcctttacaatttaatatcatattcttttgaacacacggacacttattggtgatagtcacactccattcttgttttccttgcactttatttcttgttggaaattagtgagatctttcaaagaacattgacgatagcctgatatcatgatatatggagaaattactaacaacaatatataaaaaaattatgtttcatacaatagaagaaagcatttaccttgagaaatgacagacaaggaacaaaactatgctaagaatcttgatggttgaaccagccatttcagaaaatgtaaatacaagcttcgattcttgaattgtatagctatgttatgttttgttatttataaacgaattattgcaaaacaatatgttttacgtttacatttggtgtgaaaaatattgcatttatgaacgattgaatttttaaaacaatgaaactgaaggtaaagaaacataaattactcactttaaaaaaattaaatacagtgaaattgtatagatttgataaatatgatttttttaaatatttgatatgattttattttactaggagaaagctatatttttgttctactatttctttcttggcatctgacaaagctaattaaaaaatatttcttgagtgtttaattgttttaaattgatttttttttaatttaaaaaattgttttcaatataatttttaaactttgttttcagtatagtattttttaaaaaaaattgttaaactttcaaaaatagatttattttataaaaaatttcataaaatatcagcatttatcaattacatgttgtatgagataaaacaatgttttatttatgaaagtatcataagatccaaaacaagagtaggaaagtaatttttaaaagacatttttttaagcagtgcaattgttcctacgaacaagttttaaaataagaatgtcttgaaaatctttctaatacttaatgaaaaatattaaataaaaataaagatatttaatgttttaaaactttaaaaacattcaaatactttctttatttaataagtaagaggaggaattattattattcaatttttttatattaaaaatattacaaatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttcttttttttttttaaagaaaaagaggtgaaacgcccaaaataaatcatcataaagaagataattaacgtctatcgactttgaggagaagaaataaaacaactttattaaggaaggagaaaataaatttaaataattatcacaaataaattttgtataaatacaaataaattataagataataaatatgatcaatccgtgaaaaaaattgtggaagagcaaaatttgtgaaaataaaattgaaaaagaaaaattcacaatattatagaactttatagataaaaaaaatataataatcaataaatttcaagataaataatatattacaattttaatatttagttttgaattgaatcaaatgagatcatatatgctaacggtatttggtcaaactagtttataaactctcctcgtctctttccaaaaatactctttgttgaagttgtagttagcaagttattatgcattagagaatttgctgcaagaactttcagtaactagttggattggaaaatgttgtatccagctgtaaatcacctattccattattggaaggaaagattccatgcgaaaatgacattggtgaaaattgataaaggtatagagaaagtggagctcagaaaggtgttattcttcacaaagaggagcaatttccaaagcagcgagtatattactcgtgcaactttttattttttacatatatattattgcttgggctactccaattaagagaaagtagaaaacaaataaatggtattgattgatgttacgtaagtcacataaaagtttgatgcatattgtaatttactcccacagtcatttattggacttaaagttgaactgtgtaggcaaacatgacttaaagtttgattgcagcctctgcattcattccaatgacccaagttttataagcttatagtattttattaactttttaaagtgggaaaaaaacggcatagattcttcttgcatttgctatctgattctaagcaatccaatttcaaggaaaatgtcgtgcattgcatttcggtatagaaaataataaagaattatgttattcatgtaccattttgagatgtacaacatgaaaagagaaaaagaaggaaatttatcctctgaattttttggttgtaaatgaaaggccgatccattcacagatcatgcaaaactgcaaccgtaaatttcaaaattgtcatccaaaaagtaatctataaaggttcgtacggattcgtaatccgtatgaatgatcaactgagctactagaccattcatgttaaaaactaatttaaattgctatatataacattataaattttaatgtatatttaacacataaatttacataattaatttttatctaataatatattttttacatatataaatttttaatgtatatgaacatctaattttataaaattaaattttttaatatatatgaacctaatattttattaaaatctataacttttaattaagccatatttttattttaatttatttttatcaaaaaatatattttataattaaaccatgattttatctaatagtatattttttatccaataaaatatattttttataacaattaatttttaaaaatatattttattggataaaaaatatattattagataaaatcatggtttaattataatatatatattttttaacaattaattttaaaaaatatattttattatgtaaatttatgtgttaaatatacattaaaatttataatgttatatataacaattttagttagtttttaacatgaatggtccactagctcagttggttagagtgcggatttgtaattaaaggttatgggtttgacacctacttggaccatttttgaaaatcattttaaaaaattttaacttgtacggattacgaatccaaaagggtcttatggattgcgaatccgtaagagctttatggattgcgaattcgtaagaaccttacggattctttgtttcgtcttatggattacgaatacatacaaacctttacggattgcttttagattacgagaagggcaaaattggtattgcattgtatatgttgggtgtattagaaaaaatgctggtataggaagttaatgtcgtcatactcgtgtactttatttatttttcttttgaaggggggtccaaatagggaccagatctctgcattccaaaagtaactgcagcaccctgcaatcctcatccaacggttcgaaattttttaagctgtatttctctttattatttaatatatagttatttttcatggtcaggatccaaatcagccaattttattgagattactcaagctattttttgctatttgctatgcttagaattttctctccggcaattttgctttgtataaaacttaagatgcagtttcttagatggcttttgacattatttttcaatcataatatgagttccattccatgttttatgttaacatttaatgcaagtttcggtttacagaggtaaaattctaattttaattggaagacaacactaaaaacactcaagaaactgcatttttttcccttttccttttgcattagaaaagactggctacagtccagtcccattgatgacttaaaagcaaaagatgggactcaaagtttagaaaaagaaaaggtttcaataatcgtgggatgatgatgggttttggactacattactacacaccactttatgatctgcatcatttcactataccccgaaaaagcattgatagctagagttgaattttacaaacaaaagattagagatgtataagcaatcagatcaaactgtgattaatatctatggcattaatgtctaactcttttttgtgtgattttcttgattgcttaatttaatcactcaaattaaagaagtatactaccaatgcctgttattccaagtggactctagcttgattctttttaaggttttgatttgattcttatgaaaaaaagggtactaatgagagagatttgtctccttcaatgagtgctaactcggactaggaatttaatttttttagacagacggattaggagtttaaaaactttgacattggctaactgtaagacatcatatggacatttagcaaataggccataattaacatcattaatttgtataacaaaactgataaaataaccaatttgatctaacataaatatttaaaatacagaagtgaaactttttaaacttaagagactaaattgaaacaaacaaaaataagacaagagaaagtatgctttagccataaaaataaaagcagtatactaactggcacatattcctccccaacactcgctgatgatgaagatatttgtgcatacttttcatccgattgggccaaaaaattaaaaagtgcactgcacaaaaggaaaggactcccaacttttcttattttcaaaaagttacattatatgcatcatacatactttgtatgtttttatgcatttggaaagcctttgaaactctcctcctattagataatctgataatggatactaattcaagaaactggagatggtcaagaaaggcccaattgcttattgcttctgctcttctcttactgcaagactctctggtcaactctgctgaaacaagatctgtgagtgcaacttaagtttctagttctgctttggtatacatgtaaatacatgtcattgagcacaatcaattattaaataaatgcttctaggtgcacattgtatacatgggagataagatatatcaaaatccacaaactactaaaatgtatcaccacaaaatgttatcatcactcctaggaaggtatggcctgtgtccctcacatactcattttctaatggagctgatattctattactttaataagagtcaagaaaaaaaaataacttttaagtgttttctttttgttctgaagcaaagaagctgcaaagaattcgattctttacagctataagcatggtttttcagggtttgctgcaagattgacaaaatatcaagcagaagcaatagcaagtatgaatgatccttgcattaattaggcttgttatttaacccagtttagaacatttcaaaagttatattatataccatgtaatgcagagtttcctgcggtagtttctgtcattccaaatggcattcataaacttcatactaccagaagctgggactttatgggggtccatcattccacttcaaaaactgctttctctgacagcaacttaggtgaaggaaccatcataggtgtcatagacacaggtagtactagtagttaattttccttttaacaaaaataactaagcagggcattggaaagtggcaatgtaaccaatgacaaatatgatttcttgaaggcatttggccagagtcaccaagtttcaatgatgaagcaatgggacaaatcccatcaaggtggaaaggaatttgtcaagggggaaagcacttcaactccaccaattgcaataagaagataataggtgctagatggttcatgaaaggaataagtgatcagactaagaaattcctccaaggaaacaacactgatgaatatctctcagcaagagatgccattggccatggcactcacacagcttccacagcagcaggttactttgtaggaaatgcaaattataggggacttgcttctggtttagccagaggaggagcaccgttggcacacttagctatctacaaggcttgttgggactttccaattggagattgcactgatgctgatatcctcaaagcttttgataaggctatacatgatggagttgatgtcttaactgtttctcttggcttttccattcctttgttctcctatgttgatcaacgtgattcattagcaattggttcttttcatgcaacttctaaggggatcacagtcgtttgttctgctggaaattctggtcctgtctctcaaaccgttacaaatactgcaccatggatcatcacagttggagctaccaccatagatagggcctttccagcagccatcacccttggaaataaccacactgtgtgggtatgctacaactatttttgaatcaacctggtcaaatatgctaacacttaatacaactgtcttaaatgtgttatatatgtatgtttaaaaaaaataagactttacatggttttggttcttcaacaagaatttccactaattttagttcttgcaaatttttaattaactttctttaaaatgttcttgtcattattaagtggtgacgtgacatgcaaaaaagtcatgttatcttacattgatcactaatgtaacatgattattcgtatttcatgtcacctccttagtaatgtcaaagaccattgctaataatctgtgtcaatgcattgacaatgtaaaaattattgtcattcaatcgcaaaatattatgtaggttaagtttgttgatttttacaaaaatcatatcaaaaacaatttttgattggttggcaatacaaatttttacactgatactgcataaaaattaaactcattttataggattaaaatcacctgaaatcatatttatgagaattagatacatatttaaacctgtgattattgttatatagggacagtccattgatattggaaaacataatcttggatctgttgggctcacatattctgaacgcatagctgtagacccatcagataatttggcgtgagacctctttttttttttctttcatttttactgttttttttatatcaaattcctgtacattttatatctactgttcgtgtctgcctttcaagcaaggattgtcaatctggaagtctaaatgcaacaatggcagcaggcaaaattgttctatgcttttcagtatcagatcaacaggacattgtttctgcagcacttacagtgaaggaagctggaggagttggactagtatatgcacaatatcatgaagatggactcaatcaatgtggttcatttccatgtatcaaggtagattatgaagcggggacacaaatactaacctatattagaagatcaaggtgagctaatatacttagattgacaacattggcttataaaatgttcattgagttaaaattaatattatgcttatctggaaggtttccaacagcaagcctaagttttccaaagactgttattggaaaatgtacatcacctcgagttgcatctttctcatctagaggacccagtagcatgtctccaacagtgctaaaggtatatctggacctcatttgcagacatgattttgtttttattcaatcagaccaaacttttttcccggaaattttgagacaaaagcaattaaatatagttcatactttattataacaacaaaggcaaatttgatttgagcgtgcttaaaaaatgtttatctagtgtgccatgatctgtaaattgtagtcaacaacttaccataaatatttattgctcttactccgtttttaattatatgatgtcatcattaacttctactttgggggatgattcatggaggtagcctgacatagctgcaccaggtgtggacattttggctgcatttccaccaaaaggcactacaaggagtagtggatttgcattcctatctggaacttcaatgtcatgtccccatgtggcaggaatagcagctctcatcaaatccaaacacccaacttggtcacctgcagccataagatcagctttggttacaacaggtgagtcagtagaaatcattaaatcaacaaattaaaattacatatttacattattacatataatagtctgtatccaatgtatctaattaattgttacacttaaaaattgtagcatctcaaactggaactgatggaagccttatatctgaagagggttccacacataaggcagcagacccttttgatattgggggtggacacgtggaccccaataaagcactggatccaggactgatatatgatatcaccactgaggattatgttcaattcctatgttccatgggtcacagtagtacatccattagcaaagtgaccaagaccaccacaagttgtaagaaaggaaaacaccaaaaactgaacctcaaccttccttccatatcagttccaaacctgaagagagctgcaacagtaatgagaacagtgacaaacgtgggaaatattactgcagtctacaaagctctagtgaaggttccatatggcataaaagttagagttgaacctcaaactttgagtttcaattcagatgcacgaatccttaactttagtgtcagtttcctgtcaactcaaaagtttcatggagattacaaatttgggagcctaacatggacagatggcaagtattttgtgaggaccccaattgctgtgaggaccatacagtttgaatgaataataagcggatgtgatatgtagaaatgagcttaattggtcaacaaaatatttaagttcttgtttggagtcatactatgaacttagtatattctttggtgagaatatgcagcacatttctttggagaaagagaactcgtcactcagggaatatactgttcattttcaagattaaaaacgttacttgattgcaactaacaattgcttttaaatgaaatagatacttgacaccgatttcaaactgtgaagagcaaatgtcaaatattagaaaccaaaaaaacgacactgattttgacggtatcttaaataaatatatgagatatagaatttaattagaccaaaataaattaaataaaacttatataaaattgaggatttgattcgaattgggaattttttaaaatatgaaaattaaaccgggaatcaaaattataattcagtctattattatcaaaaaggagaaagtatggtactacattttttaatattcttttcaactttcctctaaaaaaaattcttttcaactttgttttattagttaaagtttatgtggattatactaattttggaatgaaactcattaaatgaaaaatgaaacacatatttaaccagacttgcgtcaattatgctccaaaaaaaaatgaaacaagaatgtcaaagagtctggtgctaatatgaatatatgaaacaagaatatcaaagaatgtggtgttaattttttttttatttttaaatactgatggagtgacggaagcaaaagaataaaaagtagttcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaatgaaaaatgaaacacatatttaaccagacttgcgtcaattatgctccaaaaaaaaaaatgaaacaagaatgtcaaagagtctggtgctaatgtgaatatatgaaacaagaatatcaaagaatgtggtgttaatttttttttttatttttaaatactgatggagtgacggaagtaaaagaataaaaagtagttcaacttccatgaataaaaatggtctttccatgatttgcacttaatctaaataaccaagcacaaaatatatgaaacttgtgcatatttcagtttagtattaaactattaataattattgattagcgacagaatttagatttataaagacagtacagttaattaaatatattttagtaattattttaaaatattctttcaataatttaatgattaaattaattactcttttgtttttacattgtaagtgcaagcatctactacgtgcaaaaggaggatacgatactcaactatagattaaacttgcacatcatcatcagtcttttttttactatagattaaaaaggctgttagcgaagttgaaaattatattaattctgtttacttccgttcctttacaatataactcacaaaaaagggtaatggagttctgttccattcccttattattcttccagacaaaagataagagaaacaagcctacattacaacgttataagcagcaaataacctacaaagaaaatcaagataaataaatagatgatacaaatttgcatgtgtttggatatccaatcgacatcatacgtttcgatcaaaattcacgttttggacataaaagcaactcttcgttgcttcagataatgtgtcacgaagcagtggatgcgaaaccaaacatagaaaattatgcttgcagaatgaaacttgtgagttatgatggagcaccaagatatgaggcaagtcgtaaaatatcactaaatattccaccagctgtgacttgagcaccagctcctggcccacgaactatcagaggttgatccttataccttcgtgttgtaaatgcaataatgttatctgacccagacaattgtgcaaacggatgatccttcttgtatcttcgcagctctaccactccttttttattagtcacgtccaccactcccacgtatctcaagaccttcagagtgcaaacataacaatctcagagttgtatgtggaggacatgaaaaatatacgtatatttaatggacataatatacatatacgagagatgtcatcatgaaaaatagacgtttatatatatagtcaaggacacaaactggagaccgcaaacccaacataaatcaattgtcatacttttacttgaaatcaaggtctatatggaaatctaggttgcttgaaatatataacaagcatccttccatcaggttggagagagagtcttcattaaccaaccaattgaagatttgatatgcaaaactttggcgttttggtatgtcatcagtctaatcagaaaattcctatcccaccttctgtgtctcaaataagtactatatgtttctgtgtcatgtactatgcagaattaaaataaatatataacaaactaagggtacctaatttgtaaggattttttttcccttttcggttatcactaaaaattataaaatgcccccttttcaacattacctgtacatatctttgaaaatataaaagaaaatgaaaataaagtagcagtttttttttttttttttaatttgtatggaaacaaaacaaaccctaagatattccatgcatgaattatgcatgtatgaagcagttggtagaactattctattagatactttaacatagaattaatacttatttttttggaaaggcacatagaattaatactgtcttagaatttactcacttccccagcattctcagcatcttcttgtttctttgtgaactcctgatcaaattttggtagctcttgcataaactcctgagctgatgcacaagcctgcacagaatcatcaaaacatctatgtcaatcaaaatactacatattaaaactaaaaactgcataatcaatagaaataggttcttactcgtagtggttctggcacaaggctttcaactggaatattagacagttctagctttaaaccagactccctagcaagaattatcacctgtagagtcaaagcagcttcaggatgttgattttaaatcagattacatgaagcaacaaaatgctaacatgaaccaatatcgacattgtgattagcctacatgatccaattagttgcagaaacaagcaagccttccgattagttacaacaacaaccaaacattttctagaatggggtggtcaactaaatatggatttcacaataaataaattaaaaaatacttaccaatatatttatttatttctacatttaaaattaaaattaggatatttgctcaacaaaatttgtgtattggcaccaaagaggactattgataatattaatttcaattgtgtataggcacaaaagaggaatattaataatattatcaacttttgatttgtgtttttaaatcattaaatgctttcagcatgtcaacaattaaaaatatcaaatttgagcatgaatcgaaatacttgataactggataggtagatgtatatcaaatttaaattctagcctgaaaccgaattcaagcttcaaaatgtttgatcaaatgagcctcaaacatataaatatttaatttggatatagtcttttagatcatttagattacagcctactcataaatcctaaacgaaatccaaattcaaaatatgtctgcagcataaaggaactttattaacatttgacaacaaaatttggtaaacatataccatattataaattgtacctttctggcaacatctgttccagacagatcatctcttggatctggctcagtataacctgcttcctttgcttcagaaactacctcactaaaagcccggccatctttaaagttattaaatatgtaactcaaagtcccactgcagattcagaggcaatactcatggtgaatggtcgagattaatgaataatcgccatatagtcattaataatcctcaaaataacattctattttttttttttttggctttagaatgggaaaattgcaagagggtggacaaaggagactgaatgcaagatctgagaattgacagtgtcaatccaaaaaaaaaagagaaataacacatcaaagcaaacctaaagatgccttcaatttgcagtattttgtctccagtttcaaggaggccacgtaaagtgctaacaattggaagaccagctccaacagttgcttcatagaagtaatgtgtataggattgcctttgaagagctcttaacttcaaatactggataaagagagcatagatgtgaaaaagctagcatgagtactaagaagcaacaactgctgaagcttaaagaaaacactttcaaaattatgaaaaatattattaaaacatgtcttcaagttcaaagtacttgttctatcagaaaagcatgaacccaagccaatgcctactgttgttcagcgttccagtttatgctaaccatgaaatttgatcgtagatgttaataactaaactatgaaacatcacttggtgtataaagcaataaatttccaaattgctaaataaaatggaatgacaagagaacaagttgcagactggttgacatcaacatttaaatgtaacaagcttatacttataaatcattcctgttagaacaatggtaccactagtcaacagagtccagtgaacctgggtttagagagagaaacagagaaaagagtgagaaaattgtttaaaactgaaatgatgcattgaatcattaattttgttggctccatagtcttgtatagtgaactttagcttgcacttcaataaccagcttatcactttgaaatttagccaaactgaatactatgctgagtctgacgcagctaactacaggttagtgacagccatataactgctggacaataaaattacaattactctggtactagcaaatatgatagctgcaaaaatgacacagaaactcacatgatgatattttgattttaaaaaagaaaaaaggaaaaaatagacagctgccagtggatagaggtatgaagtaaatgatagaaataagagtaaaagcttcctatccaaactccctaatattgataatgtgatgatgtgtatttccctttcctttaaatgaattattctttaatttataaaaaaaaacaaataaaaaattagaaaataaattaatccaaactaatgtctggaaatttccattttcagccgagtacttgcagaaaaaatatcttatagcattgattacatgagatacgtcaacaacaaacacaaacatgttatacatcaaaagaacaatatggattactttacctgatcaagtggtcctgaatttgccttcttatttggagtgactacatgtattcctttgcgcaaccagtcatagtaatagccagcaatgacagagtcagctgtgcagtccactaatgttgtgtttggtataaaatgatttccatgtacatgttgaacaaatttttctatattagccacttctcctctttcctctcgaagttctctccatctagctaagtcaatgcccctgcaaggagcaataatagtatataatgattgaacaaaaaccaacttcaagaatgcacatataaccaacaaatcataggatgaattttgttgatgtagctccaggaccactgtattaaccaatgaattcctcttgccaacagattaacttcataattgttagcaagagagagttgtcaaaccaaagtaggaagtccaaaaaccatccatatcaagaaacatggctccccaaaagcaatcaggtattgcctacattttgagtccattctatctaggagacctaatcatgttattatggcttacttaaaaatataataatcttctttcatccaaataacaatacataaatgatatataataaacaataaagctttccaaaaacagtaaaaggagtgaagtgtaaaatgaagtctgctttctcacataaaaggcctcttagttatacaagcaagaaatttaattatcattcaaagacatatttcagtcagagtggttcaacttacacatcactaagaagcatcgactttgaaccaagtatgcccattacacgcaaatcaatgttgaattcttctttcagggttgaggcctgcattaaaagaattgtcatgtgaatttgccacatatttcaattatagtatgttaacatgataaaatgaagttaccccactatagtataccaggaacatattttaacacagaaatgtaaaaagcttgacaggtatcaaatctctataaaaaaaatatctcccagatgcataacaatgttagaatccggaaagttgtgccttggtgacttattggtcataggttcgaatccagaaacagtctctttgcatatgcaagggtaaagctgcgtacaatatccccccccccttaccttcgcatagtgagggagcctctggacaatgaagtacgtagttttatttttatagtttttatgcataacaatgttagagttagacaagtaaataccccatataagaaacctattaatatttaataaaattctagagatagagagagtctgaatctattttctgttattgattaatgaatcacttattactatctgattgaagataagtttatatactagagctaccttgttctgcaagcttacaataggaatttcagctgtctacagccattaagaagactaactaaacttcagttaagccaattctaactgtgctttactatttaagtcctagtttacaatttctcattctttttctttcaattacttgttttgaaagcaatcatctgaattttctctatcttgtataatgataagaaccttgggagatttacaccacaaaagcgagtcattgtagtttggagagtcaacagtcttatacatcctaaacttcaaatatgagactcaagtctcataccttgcaattggatcctaacattccatcttgcttcccagccccgtgcccacatgggcaggctgcgcaataacctttaactagtccctagcaaaaactacaatgccagcatcaacacacatgtcactcatttgtagttgagaaacacagtggaaatatctgatatcaattagataagaaccttggaagaaccatacaacaaaaactagtcattgtagttggagaccccaaagtcttgtatataaacactacagtagaatgtcacatttctaatgtggtggcaccttttttacttacattgacaaacaaataaattcttttgaaaatgtattttaatccgtaaaacagttacaactggtgcagcgtcaacataaagaaaattacctgctatttaaaataaacattattcttcaattataggcattatttccttgaagtggaattttaaatttgaaaaaaatagtcaatttcacagcaaggataataaaagccaaattacacaccaaaacataaacaaggtaaaaccaaaaaaactattcatgcatacaaaatcgtctacagaaactgcacctgatcccttagctggtcaagtagtgtgctcccaattaatccaggtccaataatgcccattgctatgctggttcttgagagataaaatctggaatggacagctcgtaaagcctttatacaatcctctcgcttaacaacaacagtaatattgtactcagaacaaccttgcgctatagcacggacatttatattggcctgtttatgaaaacaaactagaacgtaaaacaagcgaaaatatataacaaaataagcaaaaatttctaacctaagcaatatcttaaacataatttcctaaccttagccaatgcattgaaaagggaggcactaacaccaggagtgcttgccattttctggccaacagcagccagaatgctacaatttggaatgactgcaacctgagagattatacataactttttttaatgcaataaaggtaattaaatagcaagctttaaattttaacatcatcagtcacatatactaatttaaacagaagaaatgaaattactcggttctcaagtttctacttcatgatagttaacaaacaaaagaaataagcacaaactgatggggaaaaagaagacgaagaagaagcattccatttaacacaactttcacatccaactatcttgtgaggaagaggacaagagtatattccaagagactgcatttccttttgattatcaaacttaaacccattagtagttctatgttccagtcatttccttttttagttcttttcctcttctttcctcctcctttcactcctcttttattttagtttatttttcctctcttttgtcttttttctactttttcttcccctctccctttcgcgttctttgtcttatttctgatttatcattgggttcatctaccaccgatcccaattaacttgggttaaaggtgttgttgatgttgatgtatcaaatacgttattgccatattttcagagcaaaaaagtagcaaatccctagttagtattttattgaattatattatgaacatccttacatccaagcatcaaatacaacaattggtgaacaaattcaaaggtaacacccaaactttttgtgataagcgagcaaagataactcaatgcaattcaaccatggcttctacgggcataatgatctattgttcctggaagactcaaggctcaagccttagtgttatttgatgtccttcagccttcatctttggcactttaaagaagttcccaatggatctttttgcttgacattttatagtaatccttgatttttatatcaatctagtgccaaaaataatagtcttagtcccaactgttgatatctgcatcaatgatgtttgcttccactgttctagatcataatgagtggactgtagcttgcatatttattttaaccctaatatgcccttgttgttaattaatattaagatgaaaattaaaacacttacgcaatgaagacaaattacatagaaaagataatacaacacttaaaaaaattaagagcatggcaccatggttttaaattgcggtctgctaccacaattgcagccgcaacataaaagttttttgactcatgacaaccacatcgcaacagcaatttaaaaccatgcatggcactcaaatgtttcatccagtttttaaatccacaaaatgtggaatgataaatcttcagtctgatatcactcaagtgagtcaaatcttaacaattgaacagaaacatgcatttggttttagaagaattggatttagcacctgagaaagacgcccattatccaaagcttgacgaaatctagattgcaatgcctcagcaactgcttttacctctttctcgggcacagcaaagcatacagaatgctcactactagcctacacaaatactgttactgattaatgccatttcttacaacgtgaacaactagaaaattgaaaaaagttataagtgcacctgagatatcatgataacattagctccgacatcttttactgcaccaaaaatagcactggcagtacctggaacaccagccattccagttctgcaaaaaagcatcagagaaaaattcattggaatctacaacttggacaattaatattggttaaagaaaaccttaaattaaatacaaatcctcatgcagcaaaaaatgccaactattcataatgtaacacagctgcaattcatgactcacccctcaacatttataagtgccaagttgtctatggttgcaaatcctttgacaaaattttgcaggttctgcatatcttcatgatcattaacagaaggatggcagatctttgttccaggagcagaaaggttgaaaatgttccttatcataatgggtatgccatatcgcatcacaggaataattgtgcggggatgcaagacatttgcaccaaaataagactgtacaacagacaatttggaagttaatctcctttatttttatgagcagaaggagcattgaggctttccagcatctaactcaccatttcccatgcctcttgataagacagtgtcttcaaaatcacagcctcactaactgcagaaaatataattgtttatatttaatcaaaacttcatgttacggaagtcaaacacaagacaaaagcatcatcaatatgtcagagctagaactccatctggttactaaaaaccaattctcatgatccagtccactcaatgtttaactcagacacaaagtacaaagcataacaaaccttttctaggatctgcactatacacaccatcaacatctgtccaaattgtgacctgacgagccttaaatagagcacccataattgctgctgagaagtcacttccatctctcttcagtgtggtaggaatgttttgaggtgtgcttgcaatgaatccagtagcaatgattaccttacatggattcaaagagtaccatttttcaagtctttgctcagattccaaatagttaggatcaacttgattagaacctgtaggatttactataaggacatcccttgtatccatccatttgcaatcagccccattctgtagaaccggaacagaagcatgatgcaatgagctaaattcatataaagggggaaaaagcatatctttctaaataaaacagcacaccataccttcgtaataactagagacaacatctgagcagaccataattctccatgtcccacaacaaaatctgtaaaggactctgttgcatgaccagctgcaagatattaaaaatgttagtcaggcttaaaatgcaattccttaacccaaattcattttaagcaataatatttatggaaaactaaatatcactttttgttgtggaaaaggtgtttacagagatcacactatgaaattatgggaaaaggtgattgagcatagactaagagaagagactggaattgtttgacttaatttggatttaagccaaggcagtctacaacagaagcctttctcaatcttaaccacccagcttatatcttgcgtgtgacttgttcattaacttcctcatcattctgtaatattgatcctatatgcttaaacttagaaatgtgtggtaagatattttctacaattttcacttctaaatcattttccttttgtttcaaaaattgcaatgcatatatattcctttctgctcctactcaagtgaaaaccattttattccaaagtttgtcttcaaagcttaagtttagaattaaattctttccatgattctacagaacgggactgattgcaaatatatggatacaagggatgtccttatcgtaaatcttactataaatgaagtttaatgaaactaatatcttattgaatcatctaattcctgataagaacacagtttcaactctaattcttcaagtaattattacaccaatccttttcgcaagtcactttaggtcttatactaccattgcatgcaggacaaaaaagcaccatggtggtaatctaagggttatcttcaactctagaatttactcaagaaacacattcagctgccaactcctctctgcccccatttcaaacttgtgttccaaccctgataaatggttccaaggaaacaacgtggtcagcaaatttaactttactattttcactccttatctcccttgtatatatctcttggtcaccaaccaaataaaacttgattggtgtaaagatcttaactgaacgaggatgcatagtgcagtgactagtttctgttaagatctatgttgaaccccaaacaaaataaagtcaaagctggtgaacatttatatatactttgatttttgacacatgaagaaacatgcataatacaggtgatgtgactaattgcatgtgtactacaggtcatctaaccagtagcatatatactacaggtcatacgatcaatacatgtatactacagaagtacagatcatgtgactaatagtattttccatgaaatacatctaatctgtcatgtgatattaatgaccaaaaagtaccatacattattattattgtcatactagtgtccaagacataagcaatgatcaataatataaaatagcaaccaagacatagctagtgcaatatacatcaacatcaatactattacaatgtgaaaacaacaccagaaagtgaaagccataaataccgacttataataaacaaggacaacatgaagatacatcctaggttcaaaagaggatttataaaagaaatagatataactgaacaagagaaaacagaacagagtatcaaagagaaagagagagttgatgagcttataacctatgtatattgcacgaagcattgccttaaggttactaatatcatgatgcaatttagacaagaaactagcaagattatctccatcaagtatgtcatgtgcagttgcactgtgcttctccaaaacagcatccaatgcagctatataagactcatcacgtgattgagccttgtggataaggtcatacatcatatctgtcacctttgacattgcagagacaaccaccaatttcctctccgaatcatccttaagaattatgtcagcaacattttttattctttgagaggttcctacacaggttccaccaaatttgtgaacagaccaagtttctcctttgggtagttgtttttcctccaaggacacactccgtgaaacatctgctagcaaataaagaaaaaaacataagttactatatttgtctatttcaaaacaaaaaggacatgttctatcataaaagtaagtcgcaacctgtaaatgaagaacgtactgtcgtacttggtgcctcccttcctcgtggtaaagtaagacccttcctgagaatcagtatatagcaaaacacaaaaatccaattaatttcatggggagaatatcatttaaacacgtatatactgccaaaattccgagaaaacagtttatgctctgcaaaggataaataaacaaaaaaaaaaaaggagagtagagaatatactgtgtgtggagtaaccaatcacttaaaagcttatttagaacgtatctgccaaacaaacgatgtttataacttttgttaatttgctcttataatcttattattcaaactgagggaatataccctcaaattcctcattcagctgataaacttaataatcaaacatcacgtttcataactgagattcgctctctcttctctgcttattctttttcttttaagagcaaaaacaaaaaagaattaaaaatagtaaagtcgcatcatccaataaggaatgttcaagtaaaacacaatagcgagtgactagctgttgtatgtgtggtcaaagttagaaaatccgagacatggagctacaaaagcattggtgtaatttgatctaaaaccaaatgcgaaaaggatcgaggaaacgacgttgatatgcgaaacctagtagtcgataggaacgtaccggagtgaatgggaagggcgcgagaggaagaaaggggggcggcatggagaatggaagagcctatcgtgagagtgagagtggagcagagtgtgagtgggtgaaacacgggagaactgagcgacggcggcagaaaacgacgccatgggtggtggctgctgctgcagagtaaaatgctacggaaataaaatgaaagcacgtgtgtatctttataaactacaatcaatgattactattgtcgtgcccctagggatgcaatgcggcggcgagactactttcctggtggcgttttactatttttaataggtctaggtaaaaatcacttacatttgctatttagtccctcacctgagaggaatcatatctacacagcctaaatagtccctaaaactgtgtaatacagtaatactatcaaatcagttaatgaacttttgaatttaattttcgaaagtaaaaaagtacgatatattaatatgtcactattttattatgggctaaattgtttaaattgttattagaatgaaccataattcatggcataacaaattttcaagttatcagaatatttgaaaaaacttatatttatctcatttgaaagaaacaattgaaaatttgaacatgtaacgtatcattaggggtgaaaataggtcaggtcagactttgacaggtatgagtctgactcgcattactattattaagtttaagactaacttattacatgataaaaataagttattaagatctgaatctagtttgtataaagatctaatctgacctgaaaacttgtatacaaatttaaattttgattaaataaaaataaataattaaaaataaaaaataacataatatatatgtttctcttatataaaacctatagcttgacctttttaattaaaaagacttttcccacccctaaccacaagtaatgcggatagagagaaagagcaatgcaagggtcccttgaattatattgtcttataaataggtcagtttaataggtttaacagactttttttaaagtttaagtctgacatttttatttaaacaaacttttcaaaaaatcttaatttagcttttataataaacaaactaggtcaagtcaaagaccacttatatccattttcatccctacctatcataagcaaagcttcatcttatttcactttattaatattttttttattagcaaatgttacttttgttaaaaatgtaccttttttttctcccttcacccttaaaactccattttcaaccattaaattaattttatatttttacttgactaatcccttatgagtgtttagtaggggagaaattttccaaaaaatgttagttagttttctatgaaaatcttattttcttgagttaaaattttctctgaatagtgtaaaaatataatattgcttttattagattatttattattgtaaataattaaagtaattgataaaaacattacataattatttgattttcagtaaacttatttaaatatccacaaaaatattgaatatcaatcaaatattattcattcttgaatatgaaaaaaattcttctcctagcaaacgttccgctaatgttaatagtgttgttattgtagtttaccttaatgacttgcattttttttttccaaagagacaacttgtatttatttacagataaatgttttttttttcagtttttatgttatagtattttcaatttaacttcaccgtgttcttgtctctactcctgcttttgtttcgattcctttgttggaagatgatgctattgttctctttgaatctttgatcatggcttttaataaattcgtcttggtttggggctgaaaaaaaacacacaccacaaactagttgaaatgaaaagtagcaaaaattagacatttgtagggagaataaagcgtagaaggaaaaaaaactaccacttggttttaataaaaacattttcccacaagcttatcttgcaaaattttaagaataaattacaattttagttcttgaaattttaggacattgttatggaagtatggactataatgataggagaatataaaatttaggaattataataataatactaagttgtacatatcgtagattaattaaaatgacaataattttaatttgaatgatttatttaatatttttaaaattttatgaactattataacgatgtctcatattttaaagactaaaataatagtttactcaaaattttgaacataacattacctttccctacaaccttcccaaatactgtgatcagtttgactcatgcttctgaacaaaaccagagtccataaaaggcaactacaattttttttcccttttgtttcggggctgatggggaattatagccattgtgagaattttataagctttaaattaaaatctacatattcataacaaaataaattaaaataaaaaaaagttatcacggatatttcagttataaataattcaaaatcatactttaaataatactcaatgactataaattttaaatttatttgtatacttatatttaccccatttgtcattttatgtgattaaatatagatttctaaagtaacatatgattgcatggtttaataataaaataatcaaatgttaaatatatactaacaaagattaacacaagtgatagtatcttctaatgattggtccaatttatggtcgttaccacccacgtaccaccaaacaaagctgcgtttagtaactaacagttggagaatttacttctcttcgacatctacaacaggtatagtagaatattgagttcaatgtaatctgtttagcatggaatcttaaaatttgtatatctatctgtcggtgtatgcacgttttctatatttttcatccattagagatgtgaaacaaaggacactgccaataaaaggaacctggtgtttacctgaacaagttaaatttgaaagctccctatactactattatttgaagaaaagttctttataatttacactaataaaaaaattcttaaaacatctggccctcgccacctacttgccacgtttttctttttaaatatcttttttaatgttcaataaaattagttttttagcacattgtgaagggtatcaattgattttacttcataaatgttagagtataagtctgagttaaagtctcacttcggatagaaatagaaaaatttaacactatataagtgagtagaagactcataaggttgagctttaaggttttgggtcaagatgtggtgtccaattcacttatatgactacaagtgtaaatctcctatatttatccctccttcccaacccataatatgtctcaaattttcattttaatgtatgtatacattgtatatatgtatctttgtataattgtattgcatttgcacgtactatgtaaagtacaattctacggtgttcaacatgtgttacatgcaataatgaatcataaacaatattataaatgagtaacaaacaagttgttcttaaaacacgaacgagtaagacaagatcctgttcttgaatttgtttattaagttgttgagttttgctcaaccttgtttttacgctggtttgatctcacctttggaaatcatagaagttccttgagtattaaccacttgttataataagagaaggtgaaaatgttgaaccggtggaaattgaagaagctgcaatgaggagtagcataattcaacaaattgttgttgttggccaggtgaattcttgaattctttcaatttctgatagctagctcaagcattatatataaaatgtacttcagatagtacaaaatgtagtgattatacttcttggtaataactgtaacttacaggataagcgacgtctaggaactgtaatcgttcctaacaaagaagaagttttgaaggtagcaaggaagttgtcaattatagattccaacagttcagatgtcagtaaggaaaaagtgacgagcctgatatataaagaattgaagacctggtaagacttatttcatttctgtttcttgtaatgaatgccggaaaaaagtttatgccttgttcagatatctctggtgtgctagtgtttttctgtttctgggggaaggacagtgtttgactctattggttaattagctttacttaaattttatgacaattaaagggagtaaactagttttggacactgttatggtggagtcactgaatgataaacaaattaaatgtattctataattgaactattcatcatgcaggacatcagaatctccatttcaaattggaccaatccttcttgtaaatgaacccttcaaggttagatttggaattcaaagcagtagtatcttgtatgttgttcacatcacaaaactgacatatttggtaaatccttttctccaatgacagattgataatggtctaatgacacccatcatgaaaattcgaaaagatagagttgtggctcaatacagggagcaaatagacaatctatacatgtaacctattgaatgccaatggcatcatcaaacacaagagatcattgaccgtatattaagacagtgaccttaaagtcctaatccttggttggcaattttttttcttttcttttctgttatcttacagaatggaagatactgttctcaacaatacattgacgttgatgtatttagaaaatttggctcgaactaagatgattgtttactaaaattgaagttaaattgcttgtaactgaaaatgtttgccttttattttgaaagtgataaaatgcattttccgtttgaaaataaaaaataaaaaacatcatgcgttaacttttaagtttttttagataaaaaaaggctaacgccccaaaaaactaagaattcaatcagaagtaggcagaatagtcaatttggttcttaaaagtatatgacggcttcaagttagtatgttaataaactaaaaataaagtcttcgaaagtagctttcctctctcacattcatccttcgtttcaaataggtctttgcatttacatgttatcattaaaatgcaatttagtcctgaaaggacaaatgtaaaagacaagctatcttcaagggctttatttcaatttatttgaattcaaggactaacttgaaactgctgtacacttttttggaccaaatcgaccattcaaccatagaagtaggatattggaaggtcctgtaacatcaacaaacattaatccttttaatggagagggagggtcgacaatccatgaacaccacaatattctctaggtccagtttgcaatcctacttaattgtggtgcctagagactctcttctctggagggggtactgaatttataaaattaatgttaaattccaaaagaaagaaaaaaaaaaaaggtaagagtctctcttctttggagggagtactgaaatgaactcctaaaatttgcatagtatcatatagattgattcaaaacatttgtcttctttacttgttttattttcagtttcagtaattaaaaaataatatattagtgcgtaaatatcacttttaagtaagaatatttttttcttctgctattttttcttagtcgacgtgtatttttcaattgaagagagtgaaaaagagacaagtaaaataaaagatgattttattccaatgtggatacaattgatttgagaaaatgtttgaaactactctatgtggtaaacaaattggaggttttctaaagctctgaattagtgaagtttcacattcgactgagttactggacttgaatcttagtataattaacgtaattagtatttcttcgaggcagtcgacatactatataataaatctatattttacggattggaatttgtaattcaaatgtggtgtgttaattttttacggattggaatttgtgtcacgtcttgggttttaatttacagcatgtctctgatggtctttatgggaggcatctacatgtatacagctggactggggtgaactgagacaaacattggaccttggtgagtcagggcttctaccctgggaggtacattgtttaatatataaatctggaattatttccaccagttataatgcactttatgtttttttttttttttttttgctgtaattgaagctattatgttaatgtacttgtgatttaatcataaatatgtttgtcctttgctacattttttctctctagcttgttcttgtgaagtattatgtgaaaggtgagataatttgtaagcaacttgtcctaaatgcaggtaaggtttctgcatgatccttctaaagatacaggtttcgttgggtgtgcattgtcaagtaacatggtacgctttttcaagactgaggatgaatcatggagtcatgaggcacataaaaagtatatagtaaaaaattaatccctaaattataggagaatcacaacatctcattaatcggaaggtttacattcagctattctatttttatttcattcctgtaattttgggattcctagttcttgaaatatcctatttatcatttcctttttttttcttcattttttctatatattgtatcggtgctcatatgaaataatagagactatataattttcttcataatctactctattcatagatatccatactgattttgtatagtcgtgtggttagtgtttgtgcagcttcaaccaacgcataatgatcaataatacttacagactagactgactttgcaggttgcaatatcagtgaaaccattgaaagtgcaaaactggattcttccagaaatgcctgggcttataactgattttctgatatctctcaatgatcggtttctgtactttgtgaattggcttcatggtgatataagacaatataacattgagggccctaaaaatcctgtactgactggccaagtatgggttgggggactacttcagaaagaaagccctatagtagctataactgaagatggtaatacttggcaatctgatgttccagacatcctggttagtgcagtttaacttttgaattagtgattctagtgttatgcttcttgcatctcacatgtttggagttgattggttcttagatgtagtagatataatagacgtgcattacattggtgccttaaatttttggtcacttttgtattttatcttatgtgatgcttaaacgtggtaaataattacacttataattttgacctttttgtggtctaaggtgaagagatcaaaaattgtaattttcagggaaataagttgagagctggccctcagatgattctgttgagttcggatggtaagcggctatatgttacaaactcactcttcagtgcatgggataaacaattttatccagagcttgtagagaaaggatcccacatgttacagattgatgttgatactgaaaatggaggtctgaaaattaaccctaacttctttgttgactttggagctgagcctcaaggtccctgccttgcacatgagatgagatatcctggtggtgactgcacttcagatatatggatgtgatagctatgccacttgaggccaggctacaagcaatatccatgtgaataaattccttagtccaagaatgaatagaggtgggctaatgttataaataaataatagttgcatatgtatgatgcttgcattgtaataaagttatattttcatgtagttttcagtactttctcatttacatcttcctaaacagaattctctgtaaaataaatcttgctcacctccaaaacttgggtctcctgatcgagtaaatctattagagtaacattctagattaatggccttaattgggattctatgattttcattcaaatcatgaatgtgctgcaccttctacgttgcttgttcccatttgaatgcatttgaaatcacaacccaaccaaatcatttcgttgtgaattgtgattgtcagatggtaacttgtagggcgccttggtcatttatgtgtttttgtagactgtaatgattcattctaattaggactccacctattttgaaaatgactggctcatttggattgacttttgaaaagaacctctgtttgctaataagtggaatcatctataagcttataacagttatgtcaacaataccatcacttaaacgccaaagttaaaataaatgagattgaacaacattattatagaatcaactttctagtttctagagaaaagttctgtgcaaaaattagttgaaggtgaacctattccttatgccttattccgtgaccaccaccaatggttctcatttctcatttttcaagttttagcactataaatggacagacttaactccaaaatcagtaccagaaaatgtaatgatttgtgaggaatgaagcagtaagcttatgtgaagggttgaaatggagtcttaaaatcatgctaaaaatgcaaacaagtacattattatggaagttaccaagcgcaacatagcaccatgtagcaaaaactgcttaccgccagcatcaaatccttacaacagaggatgctccaggataggcaacagcagaaattgaagtcttcagtccgttcaatgggaagaataaggaaatcatatactatgatgagtgctttcttggccatgcgtgttgttttggcttctgctttgtaaacacaagacaataatacaggatcaaataataaactgtataatgacatgaagttcaatatctttctttgaagctaagaaaaattgttatggcatgtatctacttttgttgtcccacaattgtgtggcatggagtaatttttgcatatattcgtaatatttattttgtgaactcgatagtctacatctattttatgaagtgtagtgaatccaacatcaaacccctttggcccactgtacaaaaaaactctgatcatttgaacctgataaatgcatacaaactgggtccataaacaaaaattgttgtgtcctacgtgcaaaaaaaaaaaaacttcactacccccattttgtttttatcatgttaaatatatgaaaaaaaattattgccaggtccaaattgcttgcaactattgaagcctgtatttgtcttgatattaaataggagtacttatccaaacacagtatcagtttgaaacaaactagttcatactattgataggaaatgcttccaagaatgctatgcaaggtgtgaagattcaaacctgtgcagtgtgtgccactttgtgtaattaaactaaaataatagaggaagaaattaagtaaatgcttggaaccatccttggctttacaatttccatgagtgcaataatttgagattggtgtgaaaggaactcaaagtcattgtcctcgttttattagagtcaaaggaaatcccgaaatccatagcccatagggaccccaccacaattgtatgttgaggtccattgtctgatagaagactgagagtttaggtggggcaacttcgaggaatatgtaccaaatattttagatgtatgattatatcaacacacaccttagcttctgttctctcctttttcttttgtcatgataacacccttcctataatcctatttacctaactccacatttgttcatttatactttcttaaatgtgtgtaaggattttcaaataagaaacttaaggtggcaattgattgatttgagtgttttttgtttttatttttaaagaaaataaaaaataagtgaaaatatatttgtttaaaatttagaaaatattttttctaaaaatatttttaaaaataatccaaaactgaaaacaacaaattaatatttttagtctcttttaaaaaagtgaaaatgtgatgacactttaaagtatttttttttcaaatacatattttctaaatctggtaaatttgaaaaaaaaatattttgaaaaaataaaactaaaaaataaacactcaaatcaaatatcaccttatctcattatttttggcttcccttttgcaaattttttcttatgaatagattttacccagggaacaaaactaggaaccaaaaaaatatcatcatattcaaatgccacaaaaccaaccacatgttttctataaatattttttcattttggggtactattatttggtatggaatttttaattagtctatttatagtatacagaatacttgggacatattagaattttatcttccgagagcaactcagttatctcatacatatgcaatcacttattagcagagtaaatcaatagtcttcacagaaaagaaagaaagaaaaacatctgtagcacatggcaaataacataatttccatgttgtccaaaacaaaaggtttggtgaagtgcgctccaacagcttatcactaatgcaacttgcaccttttcaaaaaggtggtgtcatatgatctaatattatctatatagtgcttattagtgggagagtggagggaagagtacatccaagagacaacagaagaatggcctcaaaatcatccaccgttagacttctttgtttctgctacttcatgctcttcagctttatgcatttcagcagctgcactgtgctctcattgataagtcatgcaagcacatgcaatggttccatagctgaatgcaatcaagaagatgagctgttgatggagtccgaaataagccgaaggtttttggagcagaagagatcatacatttccaatggagctttacagagagataaaccagtttgtaatggtggtggctctggtgaagcttatagtaaaactggagggtgtcttcctccaccctcaaatcctcaaaatagaggctgctctaagtattatcgttgtaggtctgactcttgattgcatcttcatgcaaacatctttaaggtttaaggttgttcatgaatcatgcctgttcacataatctttaagttgtccattaaatttgatgggaatttagttttgaatttgaaattatatgaaaatttccaaaaggttctctaataactaatactgtgaatgaagaattcttattctgtgaccgtaggtaatcaattctgaataagtgaatattaagtgcaatagcgaaagatcaactgctgtgattgtatcaataatcttttttctttttatctcccaactctttctttgttccattatgctagatggaatttgatttttcttctactttgtgggggggggtatttgtaatgcttataagacaaccataagctacaatgccatacggagtagactttgcaatgttataaacgtagacatcacccatcaattgcaatatacactccttaaaaaaaatatgtggaatatatatatnacatcacccatcaattgcaatatacactccttaaaaaaaatatgtggaatatatatatatatatatatgataagtgaatagaatatgaagcttttaattacaaataaaatgcgaaaatgattcagtaattgtcaagaatctgataactaacagaacattgaaacatgttacagaagccatacgcagcatgtaccataatgataagtggtgctcgaatataacgaatctaaacatatatgaataattcagcaactcaccttttccagaaagacacatgaacaaactcgcagcaacaacagcagtcaacgcactctcttgagaaaatttgatgtaaaaaatgagtgataaaaatgtatttatatttttacctaaatattattttccaatttttttattatttatttgcctcatgcaactcagtgaataaaaagtgttcaagccagtggaagatatattccgttcctcttcttatcttatttggctcaaatgtattttggatcttttatgctgtgatttctcaaatttgttcccctcattcttttttcacaaatttggtcatttaattattttaattgtgcaattttaatttatctattaatttgacattcaataattagcaaaaacatcaatgtgacgcttctgcacatccacttcagcaaatatcagattaacggatgaaattatacaagttaaattgtaggatcaaattgacaagaaaaaatggaaaccagatttaagaaatgaaaataataagagaccaaagtgtaatttatttcaatttgtcccttcactctttgatttatgatgcggattcgataaaatacgcccttctctcttgaactttgctcttttaaaaaattattctggatggacctcatatttaacttattagattatatatagcccaaaaaaattactctaatattttttggattaatataaatatgatttaatttgtcaaaaaactcctataaacaaacaagcagcgggttgaataaataactttcaatatgcccctttgttcagctagaagattatccaaacatggaagtttatgctacatttactagtgaactagtacaccaattgacaccatcaattcagtgtcactctcgtctcgggagttccagtcagtatcgaagttgcacatataaatgatcttagattgaaaaacagtggctcctaaagcatcaacataggcagcaatctcaattaaatcctcatagccagccagtaaaagtcaaaatgatgacaaaacaaagaaaggaagtcatagtcattaggctgggctggcaggactctaaatcagctatgattcattaactggggaagaatatccagataaactagcgccgaattcctgtcacaattgccttccatggtccacaacatacacgctccagccgtgatgaactactttacgttctgtttaagacagaacacaatcatacataggacaaggacatatctactctggtatttctccaaagtctaataactgaaaggatgatatcttcatgcatacttttgtaacttcaagttcatcgagattcccaatcctttaatttcctgcttcctttaggtttcactataggtgcgttcattgctgccattttgtcattatactttgcacgaagtggatcattgtaagtccacctgcattacaattcaacaataacaagaacatcagagcataatattgcagcagtcaatatataagcataaaaggctcattgcagtagtactaaagaaacccttttttcaggggaaggggttagttgcacattaagaaaattgaattcctatcatcaatgcattaacgaactccaaattcttggcaagggagatagatagatccgacacaagaaaagtaagatgcagaaagccaatgcaaaaatttctttcataatgcagagaatgctacctaaacatactaaaccccattattccaaagatgattatcaatatgtgatagcatgactgcaagcctatcaacccacaatgcatgataaaatccaggtgtgataaaaaaattgtgtagactcttttgttgtaataaaatcagaagaatggcagaatcaatttaacaagttacatcaacatccaacacaaacagaatcaatcataaaagtagtatttcagatgttctcagaacagagaatataacttaatctataaattaaaatagaatcataacttctatatgttatgttatcctctcaacttcacaaattacaagcaagcaaatgacaaaagtgaaacccaaaagtactatgaaaacaaataagcataactcatgagcatgcacttgtgtcaagatctcaaaccatatcaagggctgctaatatgcaactcgtttaaattgtgacatgcaatataatcccttcttactgtccagctaaattcacatagaaggtgaggttgtcaggtgaagttgagaaactaagaaagttgtaaacaataaacttcaagccaagtacatatttctacaaaatgaatgccaaaaaaataaaataggatttgtgagatggcataactatgcttactctaaatgaaacatgtcttttaactatattccttcctatcaactctccctctttctcaatctcacccacaatcaaattccttaaaaagcaaaatgataggtaccagcaagctagaaagactaaaacaaagaaattaagcatacaaatatttgtattccagtaacaggtcttaatcaatggagttcagatcctggtatcttctgtgtagaatggtacaaaatgaaaaaagattcctagacagtttcgagagtgtgtggtctctcccagcccaagcctaattccagcctaccttctacacacccttctcaggctaatattctctctctccttagaacaagcccacatgccctcctcccatgctcagctacagggttggcagttggttatatctctcctaaaattgatcatgtgaaccttttgcctatccttacatacaccttagtgatcttgggccttggggcctccatcacaaaaccgttcttcttaaaaatactcatctcattcttctgacgacaaatagcagcaaatattttgacatgagcatctcaatttcattccatgaacataaaagtaatgtccaagaccattttggaccagtgccacagcagatgaacttcataagtaaatatgaacagatatgccaaaaaaaaaattctcaggataaaacaacaaagatctaataccaaagaatagaacaaacaatctaccactattcttgaaagatatagaacataggagaaattgaacttacggattattccaatcagtagtatcctcgttgacaagatgggtccacttggttcttccactacgaccaaagtgcttgacttgcataaccttgggtaatattgtcttgtccattttatcctccccagttggggcagagaaatcacgagcaaaaataccatcagatccaacagtggcagctcggtcatcagattcattctggaagaaagcgcctttgtgataatatttctgcataaatctccacttctgctttggtggtggagcaggttttggattcctcctttcccactccctcctctcttcctctgtcatgtttctcaccttctcaatctcttccttttccttcaacattgcctcccgatcttccctatccctcttgatcctaccaatctctctccctttccaagcttcatattcttctgcctcattgacttcatcatcagtatccacatcagcaatgttggcctccatttccaagtttttctggatttcttcatcctttcggatctcctcaacaacaatctgcttcgtctcaatcctccgttcctccaatctccttttccttttatcctcgagagccagctcctcagcctcaagacgctcacgctccgcgatggtatctctctcggacttgggaacaaacacaggcttcaccatagccactcccgtatattcctcatcggagtcagtctcgtactcagattcctcctcctcctcctcttcttcttcctcctcttcctcttcctgaggaagtgcctcttcctgctctctttgaagcaacttctctttaatcagcctccttctttccgccagagcgttctcatcttcttcttcaaactccaaccattcctgcctcctggcctcctcttcaatggtggaaacaatttcagcctggcgaatgcggcgatgatcagctcggacctcctcacggttatctatccggctctcagccaaacggcggagcctacgatcatcttttctgacaatagcagcatcttcttcgtgacgaggaaatgctttttccagggcagcttccctggaaggtctaatatcggcgggggcagcatcttcgttctcatcatcagcccattcaggaactttaccaggccaataacgcttaactttagtttggccaattttacctctgagcttatccctaactgctatcacagtatcactaacacccgctgtcaccgacatcgttcttactcaattgattttcgattcccttcaatgccaaaccctattttacacaacacagcaacagatgatttcagattaaatgaaaagcaaaataaataaataaatgaatgaagaaacacagaaagatcaatggtgaatgataaaattcgatatgcgaaacattcgaagggtttgggttcaaaagactaacagttgaatagaagaaagggacgagagaagtttgaaggacttacgattacagcgaccggaaggaaccctcgcgtcgcccaaacccagcttctcctatcaaatttattttattaaatctgcaaatttttatttgtttgctttaatatgtttgctacttaaatatttttattttatactatgtaaatgacatgtttatacgaatattatgtttttattaactgttaactgataataataatattttttaaaattaaatatataaactctaacgctattaaaaatattgaaggaatatcatatttatttaaattttatattttggaattgtatataagatataacataaaatacatttaactttccccatttcctaacctaaagggttagtttattagttaaattaatatttttaaattttagcatattattaactaatatatattcatttgtttatcatacaagataaatattatttttgtatagttaaaatataatccttattatttttatttaggagtaaaaaaatattcactaagcagtgtattttgaaaaaatacgtcaatgaccaatctatcttttttcagctttttgtttatttgaacataagcataattactaagttttaatttcttattaaaaacaaaacacaatttgtccgcattttatttgattttcgttttatactactactaataataataataacaacaataatattaatattgtaccttattaacggttcaaaatcctaaaccagcctcctgacaaaaaaacctaaacccttgccagattctgcaaccaacaacggttgcagcaagttgtttccgacactgatggtgttcggaagcaaaagagtgagtttttaatgcttcgaagagtaccctctttctctcgttttcgtcttcttcatcacatgatgggtactttctctcattccatttccatccactctccttcttcttctctgtctttttcaaagcactgtcattgctccacaaacactgatgacactgagagccatagcaacggaacccagttcttgatttccatgagaaacctatgcaggtcagataaattgaagaatattgatgaagctttggacttgttccacggcatgtctagaatgaagcctttgccttctgtgaaggactttactttgttgttgggtgttattgtgaggttgaagcattacaccactgccatctctttagttaagcacatgttttcttctctaggcatagaagctgataccattactcttaatgtagtgatcaattgtctttgccgtttgaagttggttgcttttgggttctctgtgttggggactatgttcaaacttggtttggagcccactgtgatgactctcaccactctcattaacgggctttgtgtgcagggcaatgtggctcaggctgtgggactggctgatcatatggagaaaatggggtatccattggatgtttacacatatggggcgttgattaatgggttgtgtaagacgggagacactttggcggcggtaggttggctaagggagatggatgaaaggaattggaaacctaatgtggtggtttacagcacaattatggatggtttgtgcaaggatggattattatctgaggcgttgaatttgtgctcagaaatgaatggaaaaggtgttcgacctaatttggtcacttacgcttgcttgattcaaggtctttgcaattttggaagatggaaagcggtgggttctctgctggatgagatgatgaaaatgggaatgaggccggatttgcaaacgctcaatattttagttgatgctttctgcaaagaaggaaaagtgatgcaggctaaaagtgtgattggttttatgattctgactggggaagggccggatgtcttcacctataattcattgattcatatatattgtttgcaaaataaaatgaatgaggccatgagagtatttcatttaatggttagcaggggccgtttaccggacattgtggtttttacttcacttatccatggatggtgtaaggacaaaaacattaataaggctatgcatctgttggaggaaatgagtaagatgggatttgttcctgatgttgtcacttggaccactcttataggtggtttttgtcaagcaggtagaccattagctgcaaaagaactgttttttaatatgcacaaatatggtcaagtccccaatctccagacttgtgctgttatattggatggcctatgtaaagaaaatcttctttctgaggccgtgtcattggctgaggcaatggagaagagtaatttggatcttaatattgtaatttatagtattttgcttgacggaatgtgcagtgctggaaaaatgaatgctgcatgggaactcttttctggtttgcctggtaaaggtttgcaaattaacgtttatacttataccattatgattaagggtctctgtaaacaaggctcgttggataaagctgaagacttactgataaatatggaagtgaatggctgccagccaaataactgcacttacaatgtctttgtccaaggcttgctgacaaaaaaggagattgcaaggtcaataaaataccttacaataatgagagacaaagggttttcagtagatgctgctaccacagaaattattatcaactacttatctactaatgaaggagacaccagaattcgagaatttttgtttccagaaagatagcaaatgccaagagtttcactaggacatttattcaaatcctgactctcaatttgtccatgttccacaatcctataggaccccatagagagaactggcataggcttcagaacttaccatttgttaaatatataaaaccattaccattaagtgcttccacctgacaatttgtgtgattaggagagttggtccttaacatggtatcacaagcctcataaataagaaattatgagattgatccttgttgattctcttcttcataattaacttgtatttgagccccaaggtaaagtgggtttgtgcattgtccacacttcaaactcaaaaagctctgtttaagggggtgttagatataaatctttcttagctccaccaaacagcttaagctgtcaagagaattgttccttgacatttttagtggtaagtattttcacctctgcttgcacatttattttgataaaacctcaagttattaaaatagcttagaaaaaatagtcctatatacaacttagaaattgtgccatatccttgcacttttatggaactgagtaattttttaccaattatatatttgccttcaagtaagtttaatgatgaagcaagttacattaggatattttgtttccccataacattagggataagtcaatcaatattgctaggaaatgataattgtcagcataaattctgccagggcaaattcaatatacccaagaaatcatgtaattgcttattgcttagttttatacatttatcaaatggattccattaatgtaaaaacatttaataagatcataagctggttttaaaacttaatccttttccagctactggtattaaaattaataaatttcaactatgaaggtacaccttattaagttaaatggaaaagatctcatcttctggtctgatataccgtatagaaggggaacttctggggagcacccaagaattttctgtttcatagaaactcctcactcaaaaatactgtagtgtgagctagtgttcagtagcttccttttatcatagatatctctttggagccaatgttattttatattttgtttcctttcttgtgtattttacttttctgtttcaggaggattcctgatacttctgcactgtactcctttctctcctagttcattgtttgtgatgggaaaaattttccatatttattacctgttagaaaacaaaaatctaagatctaatttagcgatgctagctgtcctctctgcaaacaaatttttatttacttttgacagttttccccccttttaaaataacagtttgacttcatggttcttgatttgcagattgaaatcactttatgcactcgttttgctatatcttatgtacgagggaggaccacaaataattcagcgatggatcatggaaggttagtcaaacatttcttctttgtaatatctgcacaacattttttttgtaattcgaatttctttaccataagtagttttgtttgaaactttgaatattcatctctttaagttataaattcacttctttttttctttctatggctgcagactaggttatcattacacaggtaagtcacaaactctcagttgaatgttttatgggggcgactagatggtttgctcatcaagcaatgatgctcattagattggttactgggttttgagacgtaaatgctgattctgccgaatggtttagtgatagaatgaagttgtgatcatgtcttcttgaaagttctttcatgtcgttcttttgtctataaccaaaatattcaatatgttgggcacttgtcatattaagtgaggggtaatttgtaaattttattgggttgcagccttgtgcccaatgcttcatattttgcttcaatgtaaagctaaaaatggttcaaatgtgccaaggaacagtagtccttgacagtgagatgacactggttttagtggtttagcatttaaatgagatttcaacaatatctggttttgtgaaacattttttcagcttttaatcttgttttctgaacattttattagttgccacttgccatagattatatgtggatggatctattcgactggaacattagtgcctcaaaattagaggtatatttggacgacaaaattgtttttggcaaatgatttggcaatcaaaaagcactttgcattctcaacttgatatgcatcaaaatgcttaatattatgacttggttataatgatatctattgaaacatctaagcagatgttgggtaaggtacatggccactcctgcatggttggtgtacccatactaggtacatttactgtactgatacacgggtctgcacagacacttgatttcttttaatatgaattgtgttgtggatatgtttgcgtacgcattggttatgcatcacgttgtctgttgaaaaagtgtatgctatgcatttaatcagcattgagattaacataatactgcacacaaatcatgatagacatatatgataaatgagctgccttatattgatgttttggttatatcctattgtcccctgcctccatttgactgattcttagtgaacaatacaatatgtgtggggtaatggtttttgtaaaacaaccaactcctaggcccgttcatttgaggaaataaagaacgaaaaagaaaaataaatgaacactaaaataaggtgaaattcacacttttaaatcttactttaattcaaaattttaattttaatttactttttttttccactctaccgaacacacccttactctattcggtgaaattgtctacatggatcaagtgcactatagggctctagcaatatccttattttcagtaaaacaatatagagcgtagccttttttaatgggttcccctaatattttcttttgtccccctgctccttttaattgaactatcctccatttgatgggttcagctcttttccagcacttcagaggaaatttccccccatttgatccacttttaaatactatactaattacatttttagtttactcggtaatcacatttttcatcagaatgttttcaagaatattcttcaaaatataattaattacactttgaaataaacatctacgttaaatcacattctgaaagataatttttttaaaattgttttcaagaactgctaaagaaattgactgcaaaataagcaaattattaatcttaaattgaaacaaccctccaaacttttatgtttaacaaaacaatcgttcaacacgattacaagaatttacaccactactaaaattattcaaggaaacaacaccgtctatagtatttactctcaactagttagactatatatcaccagttattttcattttgtgtatttcaagatttactcatcaaatgaattgactgggagatggatgacacaaaaatatatttatctcataataatgctttgccttttacaatctttccctcacaaaattgttttctttaaataaaaaataacttttacaatatttagcttgactccaatcttaaccaaagcagctttaaaaatttacactaaccttcgagtattttaatcccattgtttaagctgtaaagtatcaagcaaaagtacaccatattaggctaatcaatgtaaaggtacaaagctccagtcagattttgaactaggcagatgactaatatgaaaccaatattcccaatataaatagcactcatttagtacagtaatacaacccggagaagtggggtcccatggtgaggatttcagacaacagaaagctaaaagcacaaagaaagtaattctaagaaaccctccattggcaactaaaactagaatcggtattcaatcagtccccacttgcacaacccttgcatccgcagtgaacacactctatgaccttctcctccctaagttgcttgggaactctgcaaacacaagtagtggcaaaattgtgatcacgtggctgcatgcacctcaggcagcaaagacgttcataaccaggctgcaattcagaccaaaaacataatgatttaagtactcaaaatccaagaaaacacagaatgcacaaatcaaataaaatcttagtgacagtaaaacaatacctatttctttaacgtttttagctaccaagtaacaataaccttacaacaattaacatctcggagaaggcacaaatgagtacagaaataacatactttctaatttcaccagtactcaatatcagacagacaatgtgagttcagattgacccaaagacacaaaacattgatcagctgtgggtaaacagagaagagaacattctttttgggacttgggaggtttgtcataggcctaaaatgaagggggttaggggttgataatttggcatcttaacacagaaacattgctttcagaggttaaatgactttggcactttcctttggagactaatgccaaaagaggcaacaactcaccaagcatataagagcaagtacaacccccaccagaacaggtgggatgctgaccaagtaagcaacactgctcatattagattttggaattggaagattattttccaggaatacacttctaatgtttgggtgatggtatggtataatggtatctttgtcaagttttgagaggaagttgagatggggagtgctcctatttcagagacttttcctgcatgtttcaactatctactttgctcattagccatttctaattaaggctaagaatccaagatcattatttacatagggactttaatttacttaagagatttgaatatgggtgatatagtgaactacaatcccttttggttttaaactttttacttgagtctctttctccctcaactaagttagatagaagagtttggatcatggactcttccagtattttctcctgcagagctttctttcaatttcatacacaccctaacctagtttctacttgataaatccattttaaaattcaaacctgtcttcaaaagccatgtcctttgttaggacagtggtacttaacatgattaatgcaaatgatttgttgcaaattcacaatagacctttcacgcagcttttggctcattttattgaattagtcttatttgttttggagaatttcttttattttttggtaactagcagattttttgagaacttcctcctacgttaaaagaaatggaaaaacaaaaccagtttcaaaagtagaataaaataactaattttagataccttcttccattttgcaattagattgcggtccgcatatccttgatctaaacagaattcatacagttctttagaaatttccttcctccgatggtagaggtcaaatatgtagcggctcttctggtgtgcaatcttaaatataggccataacgtctcgcattttcttttgccatcatgtggatcattctcagctgccacataaaggatataaaactattgatttcattgatttcagcaagaacgtaataaaatctactaagcacatgatgtaaaattccaaccttccctcatctttgcttgaagttcacggagtgtaggctcaattaattcccagccctctgggtatttaacacgatttgtctttactttcggcatttttgtatctgttcaaggaatacatggcatcaaagagtcaatttccatacattctcccaagcaatataatggtacatattatttggtacacgttatcaagtaagcatggttatcatagtgagatgggcaatattctgaatttttatatatagattaaataatttatctgtacaatatacatttaacgctcaaagtttaaatgacaaacatcaacattcatgatatattcattaataataaaaggtcataggttttaagcaaaacatacaatacaagtcaaggaaacaaacaaaattgaaaggcacgttcatatttcaaatacaaggcatcttaaacattcaataaaaagtgagggtgggtgttgcacagataaaagaacagaggttcagagttcaaaggagaaaaatatggaaggtgagtgttggcagaaatactgccagagatgcaccgaagttagtcaaatagtgagtgtcacacggtagataaaagcgagagaaactatatccaattagggatttttaaattctaaagaaggggaggcaaatctcaactgtgcactaagaacacacccttaaccgaaaaactacgctgttttgtgggcaaaaatgggtttagaaagaagcatcaatctagcgccacttatcaccgctagagccactattttggccgtgattgcagccactacagcgctattcaaaactttacagtggccactttgcactgctatagtgcgctattgatgcagatattggataactgagcaaaacagaacactctatgccttgacttggttgaaatttcacataaaaaaggtgaaattaattttgaagaaaaccctaagccacagcattcaaccatataaataacattgcgaggctagggcacgaagccatgaacgaggggaagagaaactcagtcacaattcacaaactgtgaaaaacaaaacgaatggcttaattcactgggcaggctatagttattcatgaaaatgtagataggaacactcctaaaccaaatttgattgaatttcacatcaaatacgtgaaactaattttgaagaaaaccctaagctgcaacattaaaccatataaataaaattagggcaaaaaaccaatgatgcgaccactatgccgatttcgctctactctgtgactcgattctgaagataggtagagagaaaccaaataataagataaaacgaaaatcaaaggagtaaacttgaaatatttgaaaaggaagaaagaacctacctcagaaagattttcaagaagcgaaagagcgcaggctgaagagaactgatttagagttattctggaagtttcacgctactgaaataatccccacgtgtgtaagacgatgaatgaaaatttaaagacttaaacataattctcgtgtctcatgaaaatatttttattttttattttgaaaaaattgtttgaaaatgaggaaaatatcatattttttaaaatcctacaaatatacgagataaatataattatttaattatataaattaaatcactttaacatgtatttttaataaatcaaattaatatatacaaatattttaatttactttaaattttaaaaaaatagtatttcatagaatttaaaataaattaagatttattttgaaaataataacatacttataactagtattttagtttgtacaatgtataagttactcattattttatataactaaaacttataaggaataaaaacttttgaatataaaaattatatcataattaaaaaattaataaataaatacttctaaacatataattatgttttagatttacactaaatgatttatattgtgaaaaagttatttttaacaattgataacttcttttaacaaaatataaaaattcaattttaaaaaatattaacaataaaattgaaaaagataagaaattaagaaaagttgttagaagaaatgggagatgaagttttgagatgaaggaatgtgacagagatggatagccagacaaaattaagaaaatagagtcttgagacgacaaaatgagaccaatgtgggtagtaaaaaaaattaggtgttacttaattttttttaatttaaaatagaattaagtttatgctactggttattacacatcagtgtaaaaatgttctgtactaataatgcatataccatttattcatatattatatattaaaataaagtaatatttttattcgtgttaaaatgcagtaatagaataaagtttcaattatttttaaattagattagttttggaaaatcaatttaactaaatgatatgaaatatgttcttacagatatcaactgatatggacttttatctttttaaaataataaatgaatcatatttataaaaaaaatctttctatcactaaaattttcggaatatgtcatttttatgttttttttccatgtgtattcatggttcatttaaaaggaaggattaagcagtaggtaatatgaatttttttaatctataataatttaataaccattcaggacaacccctttatttctttttatctattctccatttacctttattcgtttatctcgcacgagcccacttcctagtttactgtatatgaatgtcgttataatgttgtgtcatttgtaagacattttaaaatattaaatcttattaattattttaaatttatatttatatgaataatatgattttttatttaatctttctagaaaaatcttatcgtacctacttctaggcatggcaacgggggtggtcgggggcgatttttgcttataccgcccccgcccctaaaaccccaccctcgccctcacccacgaaaatcgaagggtcagaaatttgtcccccgcccctgacggggatcaatttccccgcctccgcccatcttactttctctagtttgtttcttctacttcgtctatatttgtatggattcatcatagaaaaaataagtaaccaccagaaatactgaatttatcccgaaccaacaaaataatatatatatataaataaaatcaaatataagtatttcatgttacgtgtaattttagaattaatatataataattaatttgttatacaaaaagtttgatattttatattaatattgatatgtatcattaaatgtataaattaattaatatgaaaacttaataacagtcttaagtttgattttcagatatatagatttgttaaatatttgaacataattatcctcaatagaatttacgtgaagtttgaaacaaaatataaataatatgatatatcattaattacactattgaatatataatagtataaaataattttacttctttattaaatctttttcattattttgtttttttctcctcgattattttggctaaattctcatattaaacattatcgttcttgatatgaaataattgaataacaatacaaaatgcatgcctacaaacacaaattccttcccccaacagaagttaaaagaacaaaaattaagagtttaatttttatatacatttaattaatataaaattttatatacatttaattaatataaaattttatagatttcaactaattaaaattatccttaaattttatatattttaagttctttattatgatagttaatcaaattatcagactcgatatatataaatgataagtttaaaaaaattatattgttaaaacaatcaaattaaattaaaatttaactaaattattattatgcataataaatagtaacaaaggtttaaacgaatatcattattatttgtgttactataggacaaataggtgcgggacgggggcgaggcggatgtcaacattaccaaaaccgtccctgcccctgaattcagcatgcagagaaaaatcgaatccgaaccagaaactgataaactcgatttttttccgttaaaatcgggacgggtgcgggccaatgcgggtggggacgggtgaagttgtcatgcctacctactccctacttttacatttaaaaaactcatcatattctttttctgataaatttgctattaaggagtatttaattttttaaattacttattggggaccatttttaaaaatttatcaaaaaaaagagtaagtcataatattttttacgacttctgttattttttattttcttgcgtcaaagttgtaaatagttagtataaattttttttaagtgataaaattgtgcacaacgttaagcctttttgttaattacttttttaaaaaaaaattgtgttgaagtggtacattgtgttatgaccattctattgttttttctatttgaagtagtaagttggtgtactatttcctttcttcttctttttttaaattctgttttattatgttttttattttataaaaatttatgtttattttttaatttatagtttcttaatttatgttaaaaataatatttttaatataaaattaacaaattaaaatatgtatttttttgtgattttgtattttgtatatcttagttaaatgttttaatttaatatataatattttttatgtaatatcattatgattttttatatggtttgatggtattttgtatatttaatgttggctatatgattttattaaaaattatttatatttactagtaatgttaagatatgtctttgataaaattaaatttaaaggaaaatatttaaatatttttttatattaacttataatatatcaaataatttttaattatattttgattttgttcattaatttataattatgattaagaaaattaaatatctcaaatactagtacgttaattttttgtaatagctatttaaatatcataaaaagaataatgcaaaatattatacatataaatatttttaaatattattaaaaaaataatgcaatagttatttatcaaatacatatcttaacattattaataaatataaatattttttaataaaatcatatagccaaaattaaatatacaaaataccattaaaccatataaaaaatcatatttatattacataaacaaatattatacattaaattaaaatatttaaataatatatacaaaatataaaatcacaaaaaaataataaatattttaatttgttaattttatattaaaaannnnnnnnnnaataacaacatatcatttgttagttattctaaaactaaaatgtatttttatcccttcttatggtgtgaaaaagtattaaatactatattaataagaattttttaagacttataaaattttaaataattattatatcttttatgaatagtatatgatttacaaatgttgcatacaaagtttttaaagtgaagtaattaaatattgatcttttcaatatcttaaaatattaattcttgacatgtatatatagatggatagataaataaataggttaaaaagaagacatacaaatcattgactcaacaaatatatttatacattcaaacatctaattactagcaacttatttaatatagtatattgttgatatgctctaagcatagtaatatataacatagaaatcacactaaaaagagggaacaattagttagagcagcaaatgttgtaaagaaactatttgcaaaacagttatttgcaattaaattaaactcacttctnnnnnnnnnnggaagaagtacactaacttactacttcaaataataaaaaaaaaaacaatagaatgatcataccacaatgtacgacttcaactcaaacatttttttttaaaagcaattaataaagtcgtaacattgtgcacaattttatcacttttaaaaagttttacacaaaagtcgaatgattaattacggctttgactcaggaaaataaaaaataacaaacatttgtaaaaagtattacgacttcgattttcaaaagttgtaatattttttatgactttatcactataatttttttaaaaacagtccccaatcaataatttaaaaaattaaataccctgaatagtaaatttgccaaaatcttcactctcaatcgttcaacgctttcttcataaacctctctttctctccctcttgagtcttccctttgtgagtcccaggattttacttacaaaaatcttgttagttttgtttcaacaaatgtttagaggatatgttaaatcttaaagggcttatgcactacgttgataagtctttaaaacaatacgatatcactcaccttagactattttatttgtgattaagagcacgtttgatttgtcatttttttcttataatacatattttaagatatatcaaacggttcaacggagaagtaatactttgatgcgttggcaaacctatgtttggggctttctaccacattttcaaacatgcactaattgagtttgtgattgcttcaagattgatgattttggtctactacaacaacaattttaagaacttaaggtaggatcctaatcccgaccactttaaaatccattaatttattaattaattttttccccaatctttttttttatttgctcaatgataatgaatgtcaaattagtgactatgggattgttgttgttccattttcagcgttttttaaattattttagaggttttgaacatgattttagagttgtcattgtgttgtgtaaaactttgtggcaacttcgtgtgattaaatgtgtgttaggatgtggaacattgtgtgactaaaatttaggtgtttagagaatttgataaaaaaagacctattaaaatgctttgatttgagtagagcgagagaaagactatgtcaatatgtttgagttttaagttttattttttttttaaagattaacatattttttcttttaagtaatcaagttttataaccattaaatctaattgggaaaacctaaggattctatattctttcaatacctaagcaataaaataaatacttgaatatttttatagtctaaaatattaaaatattatttttcctaagacatatgtgattatgggatatagaagtagtattttacttattagtgcggtggaggtgtatttgcatgcattcttttcggtgtattcaaaaatggatttagacaaccctttgaaaaaacctagagatttagtgctctttcaatatgtcaacgataaaataaatacttgaatatttttctagtctatgacatatgtgattatgggatacaagagtagtattttactnnnnnnnnnnaaatcttaaaacatccaaaacagttatttgcaactaaacaattaacgtcattatatattactaatgaaaacataagcgttgttttgtttatctgtctggtttttattgtatcaaattattacatattaaatctttgaatcaagtctatttgtattgaatcattcaataaaaaatggattgatcagtttggatcaatgagtaaatatataaaactcgttaatttttcttctcttatccacctataaaaaaccacataaaaaagtaacatgtaaaaataagactataaaaaaaatacaatgaaaaagaaatacatgtatcaagaaaagtaattccattggatcttacaaaatactgtataaaatgcaagaaaattttgtcgtcttcacctgtaaatttcagagataaggatgatacataagtatagaaggcaatattcaaaataaagactgtttgtcaagactgggaggaagcaaaaagatttcatgtagattgaactctctcaatttctttatcctaatgtgcagaagatacgaatgagaagtatgtagaaataatttagtcagaataaaaccatctagagtatgcaaaatgtttttggaaaagtaaaaagaaacactctgattattcttctacgatagtgatgctaagctgatatttcctcctcttgcatgtcattggtatgatgaatagatgttttgcttgattttcaacttcgcctaacaccatttcagcactgtcatttcaccaccgttgctcttcttctatcgttagtagttgaacaaagtattaaaaaaaaaagaaaagagagagaacgaataattaactttagaccatcaaaatgaaaataaaatataattcagaacaaaaacgttcaattaaaatgagatatttcgtttatatattattataaatttcatataaaaatcaactaaacattatttaaatcaaggttaagtttaagaaaaatattatcaacacattatattgaacatactttcttctatatgttaaaatttattaaaaaaattgaaatcttataggtcacataattaatttaataaatatcttttataatttttaataaataataaaactgagtatgttaaagattttttttttgaaaatcctcaaagtgctataaaaaattaaattttcttgctttctcttcaaaattagtgatatttttgcactcctaattcgtcatacttgaatttatcaatatattaaatccaaataattgacccaaataagtaaaattttattatatttatatgtgagaatgatttatttttttaaaaattatttacttttattatatgtaaaattttcttaaatatttgagtatctctaatatagtgagtttgaaagagtctatatgatagtaatacataagagagagaagaaattaaaaagaaaaacaaaaatatattttccaatattccaaggtgggtagcaatcccccaacaacctgcagcaggctacggtagagacggcgttgaagtcaaacaaaaccgctctttctcgctttctctctctaaactgcatagcgtcagcgtagttgcaaattcctggttttcttcctttacccatgatctctctttctctctctcagaggttctagaaagatccattcctaaatggacggtgcgccacaatccgccggtgccggaggtccggcgccgttccttctgaagacctacgacatggtggacgatgcctccaccaacgacatcgtttcgtggagctctaccaacaacagcttcgttgtctggaaccctcccgagttcgctcgcctccttctcccgacctatttcaagcacaacaacttctccagcttcatccgccagctcaatacctacgtacgtttcttcgattcctttgtttcgctgcggttcatgcgctcccttcgtttttattcgattctaattcgttcttcggatttctgtctttcatttagttgtttgcatgtcttgaaatgatcgccggattttactaattttttgtaattgttgttgttggatattagcactgagctgaaatgaaatgttaatgatgatgatgtgagatggagagaatgcatagtgagatagagagaccttcaatggatctcatagagtctatctgaagatatatgttacttaaagttaaagatattgacaaggttgaaacataggtttctttttttggaatgtgaattgggatataggattcagaagtcattgaggaaggtgatcagaataatcttatgctgtgccttgtggtattccttgctcaagtaaagtaccagaaaatttaggcactcagcagaaggtaataagaatctggtagtataggacttagcattcatcagagaaggtttatcgatcttctgcaaccccttgatatatatcacgtactcatgaattaccaaatcaccaaatgtgttccaaagtttttaatcctggtttctgctattctattattgacaagggatgcatgttgaataattatcagaattagaatattaagattcttagtttttatgagtcttacaatgttagcaatcttagtaggctgctagcgagggttgttgtacattaatacttgacctatcttagaaatagtggttggtatctataacaaatgtcaatatagatcattagatctcaataatttctctttctgtcttttttggattcttcttatgcgtttaataccagtcaacttctaatagtaaaaagtataaagcagtttctaaaaacttatatatgcttttcccttggttctccaaaagcgaatttaataccacctaagtttcaggtgtcattagacattagcatgacaatttggcaattttcttatattgtcgtttcgcagagtggtactttttaatgttgtgttttggaaaccattgggaattctaggagcactggagaatattgtatgataaaattaccaaacttgatgaaaaattcatgctagagcattttcggttgttttcatgaataggatttgttactttacctttaaactgtcttcctccaccataaatgtttttctttatccagaaaaaagatggctgatggaggtgcatatgtctattagtaggtcttaacacaaaatagatgcctaataatacataaatactcttcttgggctgtgctattgaactgttgagtgtttatgcacttgatggtttacactcacagttctttattttcagtctaaagcacatattccctggcactttatttgatcaattgataaaaatgctcgattttataatacattttccttaacttcttggttgaaataggtgttataatgatctttttgtgctgatctgatattaaaatgaactgagtttgaaagtgaagatataattactgacaaaggaaaggaaaagagctccagtagacatggttactttgtaaccgttatatttttgtattctcataaccagtttgtatctcatcttaaactggtaccttaacattttgactgaccaacaacgctgctgatctggggttgttactcactactgtaacaattcttttagacttctttggttttaatagaccaaaaaatgactccccaaaaggtaaggctgccaatgttagataactaaagccaaacctattagttccttctcgtaagcaggtttggatgggttttgtcactattcactaaccctaggaccctcccgaaaggcatcacactcaatcacaaattcctttgaaaaatgttgtcaccttaatattggggctgttattgtcacatctttcaagcttcatgataaccttatttcttggtcaaatcagttaaaggtttggccatcttgccattatccttttacaaaatttggtaatttcttgttaaacccaagaacccttgaagcccctttagaattcttgatataggccattctaacactcttgatcatttttgtgtctgtagccaactaggaacccttttccttgagataatatgcccaagatactcaacaaattttctcccaaattgacatttatttttatttgcaactaattcattttcttttaattcacccaatacttctctcatgtaccttatttgagctccccaacccttgctataaaccaagattgtcatcaaagctcatgcctccacagaggtactgattacttgtttcttgataggtgctatttttgtgcttgtagttaaatgctaatgccttagtttcttttatggatattgagtcataaaaggatatttgggctttaattttctgtctttgggaaatgttgttggctatgattactgtgtaggcccattcaggttgcattttgagacctatcacccatgcatattctagagctctgtactattgcagacagtaattaatttcaactttgagtgcaatcaaactctagaaagtttgttgctttctcttgctagaattgcttcctatttcctagatccctatttgtgtgagcctgcgaggctattagtacttttgtgttactggttttttttttattcatgggttgccttggaactttagtcctcaaaatttttccatttactataaaccctgaccataatttcagttctttaatattactttcccacaactcaaacactgcctacttttgctttccagagggtgggtttctttcttgtaaagagtatatacctgtaaggatttaatggtaaattattcaaagaaaattgtagttcttgttgcttgaaaaaaaaattattgtttgtgatcattttttttctttttcttaatacatattttcgagcatttaataaaaccattatttggttttgtttgttttggtctattgatattgctctattatcagggatttcgaaaaatacatccagagcgatgggaatttgctaatgatgagtttctgaaagatcagaagcatcttcttaagaatatacatcgcaggaaacctatccacagtcatagtcatcctccaggttctcttgtagatccagaaagggcagcatttgaggaagaaatagacaaactttcccgtgagaaaacttctcttgaatccaatatttataacttcaaacaacatcagtcaacagcaaagcctaagctagaagattttctgcagcgattagatggtattgagaagaggcagaaacaattgctgaacttctttgagaaggctcttcagaatcctacttttgttgaacatctttcacgcaaaatcgagtccatggatttatctgcatataagaaaaggcgattgcctcaggttgatcacgtgcaaccagttgccgaaagtagcttggtggacagtcatagcaattttagaatggaatttggaaattttttccatcaagatttctcgaataaacttagactggagttgtcacccgctgtttcagatatgaacttggtatcacgtagcacacagagttcaaatgaagatggggaaagcccacagaaaaagctgtctgaagtagaaccaaaaggagtgcagacaagaacagctcttacatttgcacctgaaacattagagcttgcagatactggggcttcttttacttttaagatggattcatgtttatcgcgaagagcaacaactgctgagagctcaaaactgatctctttggagccaagtagtgaagaaggtgatagtttatcctgccaactaaacttaactctggcatcttgtccattgcaagtcaacagaaattcatactcggccagatcaccccaaattgactgccaagaaattggaaaattggcagaatcaagattttttgccaatggtaaagaatctgatagtggtgtttcctcaaacctaaatgtagctgctgaggccaatttagcttcatcccaggaggatccaagtaacaaccaagttaacccagctcctccagacagggtgaatgatgttttctgggaacagtttcttaccgaaaggccaggctgttctgacaatgaagaggcaatatccaactaccgagcaaacccgtatgatgaacaagatgaagggcggtcagctcatggaatctctagaaacattaagaacatggatcaactcacactttgagttattctggcttactgcctgatttatcttgggaaaaatccaaaatccttaccagctttgggggactgatggatacaatgttaattaactggttgacagtgttgtaaatattcaagttctgtttggctttcaaacgtattactataaacttaaaaagtcttgattatggagtttttcttcatgtttgcgcagagagctgtgcagtaagtatttgctggatagatcagctttactttccattacatgatggaattccatctaacacagcatgaaaacatttgttcagaacgcacattgacaacgatattttctctcgctacatacaccgcacgaattacaacggtttatcttcgcttgcaggaatcatatgttgtcttcaaatcatgttagtttcataacttttgctggttgaatattttaagaagccaaatctcccctagctaaaatttcaccgtgggtcacatgattcactcgtgattttaaaacttattccattttacctacttatttgaattttagaaattaccaaatacactctaaactagaaatgtgtctatttctgagtaaccctacttttagtttttgaaattgtaattgtcagtcagtttactctctaatttcacaaaaatttcatttttagttttagattttataaaatgatattcactttaatcttattctgtataaaatgatagtggaaaatatctgaaatgaatgatttttacaaaattggagactaaagtgaagaatttctaaaatcaaagattaacgtgattaatacaatataatacatgaatgattgataatttcttgtttgtcaaattaatatgtacgacgagattagaagccgtttagcagaaaaataaaaaataatggcaaaattagccatagcattacttttcatcattactttcattatttaagaatatgtatcatcatatttaacaatgcattcaatcatcatcaaactcattttaattatcagattcatttttatttttttatcgatcaaagaatcttttaaagtgaatttatatttgaaggttttttttctattcataaatattagttgttaattgttagggacaaaaatgacaaaacaatcaacgatggacctaaaggtaacactcttataaataaaaaatacgttcaatgtcgtctccatttcaggatatttcttccatatatacctcaagagttattgatccaaaaataactcactaattatccagctagacattgttcttctctaaaatagaacacatttaattttcatcaaactcattttcattatcaaattcattttattttattttttatttttttatcgatccaagaatctttcaaagtgaatttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagatttttttttctatccataaatattagttgttgattattagtttttattaatagaaaaatcaattccaggatctctctctccctccttttttctctttatcattaaattaaccttataatttcacttagtcatttatattagaatttgtttggttgaaaacacaacctgttttaaattaaatcagaagcaagcacattattgtttgtctactttagacataaatacaatttatacgctttatacatatatacttgaggaaaaattaatatttacgcttcatatgtacattattattggttnnnnnnnnnnattggttttgatttaatcctgtaactttttttttttttgtttcaatttactttttaacctctcatttcctatcacgtttgtcttttcatggcaattttactaaataaaatataaacccaagtcatctaatgaaacttacataaaaatttcttaataataataaatatattaaaggatgtgtcgaaaagaatataattccaccctacttctccacttatatatttatttcatcgcatgatacctttaacataattaactggttgtctaatcgtaaactttgtgcaataaaaacttttaaaaggggattgagaaataaattccttattatttatttaatttgaaatactcctatatatagtagtcttaacatatttaaatttaaagataaatatagttttatttattcacttctaaaaacaattttcattttttattttaccttttgcacgaaaactggagagatagttgtacacagagtctccaatttatgactatccacccactaaggctctcacattcactttcacaaccttaacaacaaactgaaaacaacacagaacagtgtcccaacccagattcattgtcatgactttcccatgtttggcacttgttcttctgcttcacacccttctcccaatctgcaatggcctattagttgtggacctcaatttgagtgaaactgccgtgatgaccaaaagggtttgcaccaaaagcattggagagtgcttggcagagccagaaatggactcagagagcaacaggagagttctggaaggtgttcagcacataaagtacattagctatgagacactcaagagggacatggttccatgtgatagagcaggagcttcttactacaattgtcatgcaagaccagcaaatccttataataggggctgtgaggtcattactggatgtgcaagaggtgttcaaggcatcaaaacttgatacagttatggtccattaaatggatgaaggaagctaggaaagtgtcccaagtggctgtatcatgtatgttattattcttaatttccttttccatctaatcttgtttgtttcatttatgagctttcctgtgtagttattatggtcattgtttttatacttttcaaatgctttttatttagttctttccttgtaacatatggtatgactagcttaattatgaaaatatctaacttttgttcttgagaacataccactgcaacttgacatactctttgcgattttgatgcctatctgttacaaaatctatttattgtagagtttagttatcaattgcaaggtgtgggacttcagtcccacattggaaagatggaatctagtgtggggtttataaagtcttgactctacccatagtggttagtttttatggtgtggttctcccaagcttcttttcaagttgcaaaatttaacaggaaattattcatacagagcaatcaacctgagcattcgtatcttatttaatatgtaatgggtctaaattttatttaaaatgaggctcctcacatcgagtccaatccccttctgcaccttcgtggctatatcgagatttcagggaaaagaagctgatttcttcacatttggtatggagaaaataggaaataagaagaagaaaaatacaaaatgcaaaccgagtttaaaacaaatctcatcttagtttttaaacacatagtttccatagaaaagagtgctagtaacacattctccaacgatcttattcttagattagttatgaaaagaggaacgtagtttccattttatgttagtaaaagtctgccagaaataatagtttctcgtgtcaaagttcaaaagtgggagccattttcagcaagttctaggaattattcactttttatgaactctctcttccttatgtttggttattctcttaataagtttatgggatctcgtcaaattccttaggatcggcttagtgtgggggatttggatagtttgcataagatctaagtcttttcttgtttttgtcgaaaacaaagtattctcgtagctgaaagctatggtaaaatactagtttaggagcaacttctctacttctattcacaaaaagattatgaaatcttcatggcatggaactaacgtatcgcatataatgtgttcttatcctccatagcaatcacaaagacagagttgtatttgcatgaagatatttcctgtgatactatggtattatagtaatgatgtgcgtgggaaggggggagttgtttaggaataatatcataatatgatagtgaaatgtgctgaacaaatgaacaatgaagcacttgggacaacaacccgggttggcatatgctaaaatgtttcattgtgtgctgcattgcactaatggaagataagcacaggaaaaataattgaattagcaacagatcagatataataattaacaagagattactagcactaattagaccacatggtttcagttatgtttctcttggcaaagccttcacattgcaaagttagtcaatagccactagccatgtgccaaatgccaatgtcaaactcaaaaaactgagctatgcttggctggagatttgtgaagcttgacaaaatggcctgtgatggcaatgttgatgttttattaacactagatatatccaagcatgctatgctatagcctataggtaatggtaggccactttcaacaacaacaacaactatccaagtgagcatttatgcattggtgcccctaggggatccacactccatactcgagcacttgtggccctcatcttttatagtgttagtttggaaagaggacccaatttacctacccaccccacctcattctttttcaacaaccaccaaaaagaagataaatcatagttgttaaaataaaatcgcctgcaaagaaacaatcaaataaagagaggggaaataaattattttcatctctttactcatttcttttttgtcatttttatttaattaaatgaagatttttattctatcatttatattggaaaatgtgatcacatctgcattaactaattcacttttcctatctgaatttacatttaatatatgtgtatatatatatatatatatatatatataaataagcactcttttctattataagagttacctttggtctattccctacaagaaacataaatttccctttctgtgacacagcattttaagtagttgaatgacagccaaataatctttttttgttcatgttatataaacccttaagtaaaatttgtgatatttcaaaacttatcttaattgatacaaatctattgctactatctataagccagtgctcctctgacaggtaatgaggtgataaactattttctacactggctactatctatcaaatgtttcactgcttcggcaggcaaggcaaagggctgtgaggcttttggaatgaaagcttttgggcctaagatgacagataaaacatgatggtatttaagtagggatggtaaaaaggcggtttaggaattagtttggagtcaggtttaaatgtttaatagaggaaagaataaaaaaaaaaattccaattccatctccgtcaagatcagaaaatcccagcacactattttcaaatttattttacttatacatatttttaaataaatactatattactatatattttaattcaaataatgcgtaaaattcaattgaaaaatcttaaaactaagactgaggaactaaattgtattttttagtataatatgtaattttaatgtttttagtgtgaactttaatgttattattaattatttttatagtttaattttgaaaatattatttttgctaaacaatagttactaacttactatgaaatttttaattttattctataagcaatatatgaatttataaaataatcaagtatttgtatttagttgaatatctcaattagtcatcattttgtatttacattacttttgtaaaactttgattctgaaaataatagtaagtctcctattattgagaagcccagtttgaaaacattcacctttatgggccggaaacctctaaaaagcctagagtctaaacctttgtgacttttcagcatctaacaattggtattttcgaattttctcttttctttacaatcaaagctaataaattccctagaagagggtactatatattcctctctaatgatgtaagtgatgatttagccttcagattccacggtgattataaaagtgtaacgtatttaaacttgtatttaaaggctaaataaatttataaaattatgaaacccaagcacacgaataaatatccataaatttatgtactggtaatctttcaagatcttctaacaatcttttccttatcacaaactagctcttttatatagttttaatgtagttacttggtgatgttttattacccgaataagttctactctttcttcctattgtagtaaaaagtagtaaaaaaaatgttattcaaaattgattcaggttaagaaaaaaaaaatcacttacacgataaatttctttaaactaacgtctctttcaagttgtaaaataattgatttacttatatagagttctaagtttgaatgttgtgaacgaaaaataataaacatgagaaaaaaattccacgtaaaatgtttcgtgcttgcgtaaagattaattgaatcttaaagtaatttttggttattgaatgttaaatccctaaaaaacttatgagtttaagatttagaagaaaaaaatataaaatgaatcaagtatttgaaattattataatccaaccaaacctaccacaagatgagatgagctagtatttgaaactcttgtccgtgaaatgatatttaagaaacttgcaaatttaatgcctaaactaaaatataaattttctattggttgcttacgctcccataggatatgatatgatacaaacaacttgcttagtgcttctccatagtgattgagtgtcatgcgttatatttccttaactaaaggcatcatgtgaatccaactgaatgatgattccatgaaaaacactatctcaaacaataattagagcgagccaaatgtcagatactccacatttcatgttttctgtcttgaactaaaataatgccataacaacatcactttcgcataaatttattatttattaatactacacaaagattatttatgtgaggccactccttcgacagaagggaactgagatcgtagttttaagatttgtcgaacacgcaacccaccaaataggggacttgtatagtaatgggattgataacctactatgttttgtcctttctgttattatttattgaggattgaggactaagcaagatacgacccttttttacttttctagatccacttctcattcctttgtgtgtgtctgtttttgtcttttcattgtatagcaaatcattattaatatccatgttcttcatgcttattttcacacctcacattagcttattcaagattcttaataaaagtattagtgaaaacagatttaaatatgtttttaatttttcaattttggatcatttcatttttagttctttaaatttaaagttttttttttgtttttgaaagtcgagtaatgctctttttaccagtgtgatccaatggagaataaggacaattttttacactcaaaaaataattttctattttatattttaaaatacaatttatgatagtttaaaactattaaaattaaatcaatgaaaaactttaaagcaaattttaaaataattaatgggtttttttatttttttttattgacttgatgatgataatttttaattgccaaaaaattatacatataaagtagaaaatcaattctaattgtaaaaaaatttcataaattatgaatatcttattttacgtttagttaatacagtaaagaatgatttaaaaaaatattatatgaattccagaaactaaagaaagtatcttcaaatttggaggattaaaaataagataatctaaaaacatatttaagttaaaaaaaaaaaacatagtgaaactttaaacaaatttagagtattgtgtattgacaaatgaaccgttaatttttttatttgtttatgacgtttttagcaatatctcaatagtcgcttgtgacttgttactctcaatcaacctttactaccactctcaatatacttggtttttttgttattcctgtcttcaaaccccccatactttgactcctgaactttgaggctgcgtataaaaatacaattggcgtatcggacatgcaaaattgcagattgtgtaattggcctctggtccttttccagaccaatattgagaagttcaggcccttatggcacagacaagggttgtattgaatctgactttgacaggtagttaaaatttactgtaattaatggcaatgcaagactagcatcgaagaggggtgacacagtaataatagttgacacaacgagagcgcctatgttctagcaaagaaatttttttttttaccactctttaccaacagcatccaagacgttacgttaggatattcaaattcaaattcttcaatgcgtcactgagaagctgttgtactcatttttttcacgtaaaaacagagaaccatctaacacggaatcttgcaaaaattgatgtgaaacaagaattctctgagcctaaattggattactgcctaaaatttagagtcattttgcagaataggtagggaatattttattccagaacaactttaatgtaaaatcttgattaaagattttaagttcaaaatcttatttttattaaatttttcaataaaagagataaagagatttccaacatgaaaaaatgagttcttatagaaaaacccttaagatatacatattattcaaaaaagaatatttttttttctttttctctttctctaagatttcaaaatgaaatctaccattaaagaacaaaatgggagaaatcttgaaagatcttcaatcctacgtgacactataaaatttaccgaaaaatgatctaagatcctaatttgagatctatcactaaagatactttgtcttttttctttctttttctaagcacccatgaaaacaaatcagattttttataatttgggcgaggtctaaatttgtttttatcattgtaacaaaaactaaagaaatcaaagcaaacgatatcataggttatttggacctttgttattatcctacgttattatcagtttgatagtaatataaaggaatctctcttgattttgagaatgaacaattgactagttaaagatattaatatttatcaatttttcccttgactagttttaaaatgtttgattttttaagccatttttgttattaaggtaaaactgtaggttttaaacgacagtgtaaacacccatcaaatcaaattaacaattgagaaaattgaattctaactcaccaatctgtgtaaattcaattaacaaagaacttgatttcccttaagcttgattctacttatgacttatgagagagctttaccccttaagttaattcaccatatagctaaaatcgaattaattggaacttataaggctctaaaaatatgcaaagaaaataggaactcgtaatataaacgatgcaaatccagtgctatcattattttttcaaataaaaaaagagaaaaactcgaatgaacttccataaaaaaaagagtttacataataaaattacttaattaccctgatagccttttttaaaaaaataatgcagaagcaccaaataatacacgatgtgtcaatgtgttatgaaactggatacatggtaggaatttttttctctcttgattaattttgatatattgaaatggtggacagaaacacattttagtatttaataaagcaaaatgcacacatcccccagacaaaacaatccttattcaatccaaattggtttcatatcacagaaaccaacagtatgtcttcctccttacccgtcccacccactcgaacacaaattctacggaaattaaaaaaagaaaaaagaagctaaaattcttctacctcaaatctgaaagtctaacaccaaaaattcaaaaaaaaggaaaattaagcaatcaatccgatttataaaaccgattttgtctttccctcactttccgttgatcatctcaatcacttagtacctgtagtgagcaggcttgtatggaccctcaacaggcacactgatgtaatcagcctgggcctggctaagcttggtaagcttagctccaagtttgccaaggtgaagtgcagccaccttctcatcaaggtgcttgggcaaaacgtaaaccttcttctcgtacttgccagtactcttctccttccacaactcaagctgggcaatgacctggttggtgaaggagcaggacatcacaaaactggggtgtcctgtggcgcatcccaagttcatcaaacgaccctcggccaagacaatgatgccggagttggtctcagggaagacccatctgtcggtttggggcttgatggtgatgcgcttcacaccggggtagttctccagccccagcatgtcgatctcattgtcaaagtgaccaatgttgcaaacaatggcattgttcttcattttcctcatgtggtcaaccatgatgatgtccttgttaccggtggtggtgacaaagatatcagcctcagaaacaacgtcctccaaggtcagaacctgaaggccttccatgagagcctgaagggcacaaatgggatcaatctcagtcacgatgacacgagcaccagcctgcttcaatgcagcagcacaacccttgccaacatcaccatatccagccacaacagccacctttccagcaatcatcacatcagtagccctcatcagaccatcagggagagagtgacggcacccgtacaagttgtcaaactgtcacaaccacagatcaaaaggttaataaaaaataacacgagcaataaagcaaaatcaattcataatccactagatccacaaaacccaatgacccacttattggtttcaagaccctaatccataaacaactcatcacgaaaaactcagtttggatccatgtttgcaaaattaattttgaaacgacatgctttatgtttgaatgtttttctaatcctaaatcaaaatcagtagtaaaattcaaaagttatctaatgtagcttcaaataaaaaatgtttactcggaataaatccttattttgcggaatcaaacatgtgatcattgtcctagagtctaattagtaagctacttactaacgttctgacgtttcaagtttcaacacactaaaataacacctaataccgatccagacttctcagacggcattagtcaaacagttaacagattcaaaacctcatatcaccaatgccacaaaacccatccaagaacaacagatctgaactcaaccctacatttaaacacataaaaagcaccagatctgggaaaagaagagacattaccttgctcttggtgacagagtcattgacattaatagcagggaagagaagagtcccattcgcctgcatctgatagagcctcttaacaccagtagtggtttcctcagaaaccccaacgagacgccccttcatcttgcggtacctggtgggatcggtcttcaacccatctctgatgatggtaagcacgatctggaactcagcgttgtcagtggagttagggtcggggagttccccggtcttctcatagagctcctcggccttgacgccctcgtggatgaggagggtggcgtcgccgccgtcgtcgacgatgaggtcggggcctccgccggggccccagtcgagggcgcgctcggtgcaccaccagtactcctggagggtctcacccttccaggcgaagacggcggcgctgtcgcgggcgatggcggcagcggcgtggtcctgggtggagaagatgttgcaggagcaccagcggacctcggcgccgagggcggtgagggtctcgatgaggacggcggtctggatggtcatgtggagggagcccgtgatgcgggcccccttgaagggctgagatgggccgaactcagtccggcaagccatgaggcccggcatctcgacctcggccagctcgatctcgaggcggccgaagtcggcctgggaaaggtccttgaccttgtattcgcgcccgctcgtggttttctccaccaacaaagccatggtttacgagccggggaagaagaaagaaagagtagagaaagagagtgaagaggtgaagaaagaatgtgagagtgtgtgtataaataagggtttgggagggggagggagagggagttggtgaggtggactagatctgtttttttttttgccctgtgccctgttatttgcatcatttagtaaataattaataagaaaatttattttttaatatagtttaacacgtttagtaaataagtaaatttttttaaatatgttggacaaatttttttagtttaaattattcatttagtcttttaaaactcatttgacattatttttgtcttgtatatatattttatatcaaccaagtttctctaaaattataaaacacaatatactatatttcaatcttcaatgtatttatttcacattataaatatttaaaggatatcatagcagcagcaataggtatcaaaatctatgttacaaaatgtttattagatagagataaattatttgttaaaaatttgattattatgctctgttcatatgttcaatgatgtgtaaaatataaaatgacacataagtaaaagaaaaattgagttaatttttatgcacaatcagtataaaaagttttacacatataaaaaagtgtaatnttgataattatgctatgttcatatgttcaatgatgtgtaaaatataaaatgacacgtaagtaaacgaataattgagttaatttttaatggacaatcagtataaaaagttctacacataaaaaaagtgtaattattttatactattaagtattaactaattaaaaatatgataggtatgacttttaacataattattgtcaaaattaataaatttattatatatagttgtttgtgacggaataataatataaaaactctacatttcaatagatagactattatcataaatttttaatttccttgttgaaatattttataatggaattaataaagtgtaaattttgttttattggttaggttaaaaacctttttttctcatttgatatcctttgtataataactaatatggtaaaaaatgacatttttattatttacaaacaccccgtgcaaaatataggtttaacaattagttaattattatataaataagttttataattgaatatgttagtaaaaagtaattataacgtacgttattccggtaaaattatcaattaatttttataataaaattatacaattttgcataaaactatttgctcactaagataaaagctgcttcgaaaaaaattaacatcaacatcacctttaatctaaattaattaggatcgataataaataaatccaataatagataaaaaaaagacaaaaaagagaaagagagatggaaagaaaaaggaaaaataagacaaaagaaacgaaaaataagctaaaataaaagaaaggtgaaaagaactaaaaaatgaagactagaacatgggaagactagaatataaacatactaatgggtttaatcctccaccaaatttataatttttctccactttgttctaagacacaccgttcgtcaatctatatcacactctattatatcttgtttaacaacctttccccaagtgagtttcaatccacctttatctttctttgtgtcgaacttttgttaacaaactcttgttctaacgagagcatatagtgatcgtctcacaacatgcccaaaccatctcaatctatactccctcataatcttttcatacatcaaactacttacctttcgtcgaatattttcatttcttatattattcatcttcgtataaccacacattcaccttaacatcctcatttctgctacccctattttgtgctcatgttacctatgtgctagtccaatggtggacccacacttgttttcctgtccgcatgtgcagacacaaatattttgtatttttttttataatattttctactgagcagacatttgacgcatatgtggttggaaaagaggatgctcgtggaattgttgtgattcaggagtggtggggtgtggattacgaaattaagaatcatgttgtgtagatttgtgagcttgggtagtgggtttaaagctcttatctcagagtaagataagataatggcactttaggggtagggtggtttgagaaaacatttcatgtttttatttttaattacaaaaaatattactagcaaaggatggacacttctattagcaagaagcgggaatgaatttatataaaagctgtgatatatgtgtttaacttaggtattactagcaagtaccaattattctcattgcagtagaagcttatataaagggattaggatctcttctgattcattctcttgaagtaaagttcaatatacaaaagttgattatttatgctctgtttatcttcatgatatataaatcttgggtatagcctaaattactttgttaatagtttgtcgcaatattttttactcttcacatgattaaactatcaatattgttggtaattatatttgactttcatctttggctcattttattacttaggggttgttactttcaaatattttgatcttacacatactatattttgagcgggtttataatcttgtacataaaatgttgatttaaattttttttacaatttttttttcgggaacgctgcccccgaaccccaccaataattgtgcgaacataaattaaaaatcatgggtccgccactgtgctagtcaacacttcgctccatataacattgtcggtcttacagttgttctctagaattttccttttaacttaaggaaaattttgcggtcacacaaaaattcatatgtgttccatcattttattcaccctaccctgattctatgatttacatctttatcaatttcaccatctttttctccgaaaaaaagtatgctgcaaaaatttatgaaggtgatgaaaactatttttatggcaattttttattatataaataaaattttgaatcttataattaaaaatgatcgaatttattatatattagttaactttattttcttactttatccataataatgaattattttaaatacaaatcaattattataaataacttcatatatctcttttattacgatttaaaagacatgttcaaacaattcaaataattatattaaaatcactaatcacttaaaatacgaaaaaaaaaatatatgtgatgcatgaaagatgattgcaagagtcaactcctaaaatcttggtattaataatgtactagtataagggagatggggtcaccatagttgtatctgaattgctatttttcattggtgtatgacctattaactacgttgtggattgccaaatcataatatcagtgaagctgaagcaacaccctccgccagcgccctgaatatatatacgtgtgtcggtgtctgtcgtcggtgatttgcttgtaaattatttgaaaatgaaagaaaactaggaatcgtaaatggaagacacaaggaaagtgaatgtgcatgtctgaaaacattctgataaaataaaagaaaaaaaccagcatacataaataatcaagctgtggtccccggttatggagattaattagatgtggccttggaaccaaccattaaccaaaaatattggcaccgcacaatcacaattattgagaagatatttttaccgaatcttggcacgactcggcgtgttgcaatcgcaccaaaatgcaactgttggtctcgccctgtactcaccctagcttttataaaactcaactgcacattgatcttctatagtattctttttcacctactaaggaaattattagttttccattaaaatattcatggaaaatatgtttttagagtaaaatttggttaaaaactgttttaaagaaataaaacttatgatattttttcaaacacactttacaaatttaagtttaatttaaacttaagtttacaaattttaattaaaatatacattgatacgaggtactcttagactaatttattttgtttataaaaaaattgttaaaattttacatactttaaatttgtcattggtacatccaaccaactatgtacatcaaacttgagtgatatttgtgttgaaaggaggatgggagaggcatgacagagggggctggcttctagtttacccgagtgagaaggttttcatgatataaatatctcttatgattatgtttatactaacatgatactatcaattaatatggtccctaaatcattaggatctggtctcatgtcaggaacttacgtttcgtgacatatcaaaaagttgtaaattaggagtagaaatagactagaaagtctttcagggatctacaatctagtttagttaaggttttgtttggcttaacttatttattaaaacgtttaaatttgagctttttaaaaacctttttaattaaaaaggttaggttataggctttcaaaaaaatcaattaaatctgaacattgtgtctatataaattataatttataagattatatttgataatttataacttataagagaaacatatctattatgttattttttacttttaattatttgtttttatttaatcagactttgtatataggtttttaggctaggacagacctttatgcaggttacacttaggtcttaataacttatatttaacatgtaataaatcaagcttaagcttaatgataatgatacagactaggttcaaacctgtcaaagtctagtttgacttaacctatttttattcctagttgcaatgatacatttatacaccttcatacttggtataaaaccgacaatatcacatacgcatgtgcatgtcccccctaaaaccaataatgaggggacacatggcaagactagtttgaggacattttatattaatagatatcagctgcatggctcaagaaacgttaatggttgggttgagctaaggagggtgcttgtgaagcttatgagccttagggtgcttgtctctccctttctctcttcgacgtcctcttacgcgtactataatatctttgattttcaatttcttggcggctctcacactacgacacttcattcaatatctttgttggtcaaaatcttccactaatcagaactctctgtaggtagccattttcgagactttgactatcattctgcctgttttcaggatcaatgactgatcccacaaatcaacacaagatttttcagcatgttttgtcctcactcatatgctttcagggaagcttccaaaatattactcatcttataactactctaagccaaacacttaactatgaagttcttaagtaatgaactattgaaaagtatatgtatcttgttgatagaggtagtatcaattaattcatttaagttattatcagtcatacattctcatacatgcacaatttttgcatccctctcattctggtgtaattcgatttgaatgttacacttactatctccttgtacctttgaccgtatagataaactgatgtagagttattttaaattaaccaataatcttgaattcaagtaataacaatgcgattgttttgatacttatgaagagttttttcgcccataaaaatcatgttcgtctcaaatagaattgattccaataaaaaattaatgtgtttaatcttcacttttgtatctttatttctaaatgggatttcaattttttttaatgacgaaattatcataattagttaaaaaatatctttgttaattaattttcaactatcttaaaagccattttatattactttttttaaggacatttttatattagctttgcgttaccagcttgccacacaagtacaggtcaagacctggaaaaaactgtgtcggttggttcctgtttaaagaaaagagaataaaaaataacaaaaagaaaaaaagtgcccttccattacattcgcattcttaggaaaagagtgagcgatcccgggaaattaattaatatacgactaaaagatttgcgaattataataattaataattctttttaaaaagtaaagtacagtactgctggaaacatgaacatgttcatatattaaaatttaaaagaatatgaccagtaacaaaaaaaaaacccatgcatccaagaaagaaatatcatgtgcttctgtgtcctctatctgagatgtgatgacctttttcaaatgatcataatagttacttcataatgacgacatgcatcaaactattttttcttcaaaaaatatattggcaactttttactatgataattgtataaattattgttagaaatttatttaatttttatttggcttctctatttataaaaagggacattttttaagagaaaaaagaaatcaaatcatagaactcagatagctcgcccttctctctctcttttttacatgcaaatggccgttccaactattattactaatttgtaattattgaagtaaaacaattcaatgaccaaattaatgttaaaagttaaaacaaatacagtatatcaacaaccttttggcatagcttgagtagatcgtaaaattaggtatttcctcaattaatacgcttatattaatatagcctagatgtagatgcagtttgtcctgcgttgtaattaaataaaaatatcacggaattattatgagagcattattgaatataataaagtaagtcataaattaaaaactgcaggtgggtaattgaggacttagaagttgggacgtgccaaccgcaaataacatacgtgatttaaagactctttacaaatggctttgacaatggccaatgggcgatttaagtcaaccaccacatcaacctctggaattatgaagtaagaaactaaaatgcttcctagtcagtgaactagttgcatctcatttatatgagaaattttgaattacgactttcttggccatgttggtagagtttgggggaattcaaacttggtggagtggttcagcttaatctacaaatgtacatttgttcaagtggtttggtaggcagattttttcctcatcctggaatttatttttttattgataacatatcaatatctcttgacgatgctacgagatttctcatgattatagaactgagtagggtggcttaaaaggcttcattttaaaaataatttcaccacattgaattgaatattagtaaactggtatgcctgtaaagtgtacaataataaatgttttgatagaagctggtaggattttaaaatagctcatgtataaaatgtgaaaatggaaacgtgaactaaaatgctaataataaagatatatatatataataaaagataaaaactaaattaattaaagttaaaggataaaaagcttgttacatcaagtcatgttaaaggtgcattagagggtgcagagtaaaagttaccactggtttatctctaatgatgttcttaattaaatatcttttgacttatggggggtgaagacacaagaggttgttgttgtgatgtgattttggctgaatatgttgtattatgataggtaatacaaaagacaaaattttacattaattagtatacttttgactcattggtttatatattattttgtgatataaactattaaaatatttaaaaagagatgaaagacttatgtccatgaacttaaactaagcaggctttcctgaatgcaaatccgtcaatttaccccctgcgcgtgcgataatcagccaccatgcacaacataatatgcatgcctgctgaacattgacttcattgttaaatcaaaattaatcccatagacctattgtagtactcaatttcatcaatcaaaatttattggatgggggaaaaatacaatatttcgtagttcctagtcatattcagaaacctaaaaattaacaatccccatgttagtgaagcaaggtgtcggggaaggaaagcgtctgcatcagtgcagtagagagggttggtgattttggtgggaataaattggctatattgcccccacctaccacggtgctaccaacgttacacagaattgagaatgaaacctaaaaccaaatcttgcagtgacgtacaatgtacatatgctacgagggcatcaccttcaggtttccagtcaaatgttgaacaattggatttcttagcttgctttaacttaagttgaagtttaagaagtgaagctgatgcttgtttttgaatgaaaagcctttgatatatattttaatgtaagcattttccaaatttaactcgtcccatgcttgattgatcagctaatcaagctaactggtttgataacagatagacttctaaatctacgagtgtgagtgcaagcagcacaccttttaaatactagccactgtttgtctttttaatcaacagaaagagaatcccactaataacactattcgagatcggtgttcttttctgtttttttccttataaataaattaataagttttgttcttgtcctgttaaaaactgctctgttgtttcatgtgttgttattaaattaaaaaccagaacattacgaataatgacatgattttattcacatctacaagcaaatttacctaaaaaatgtgaatgacgtggaagcaagtacttcatgctttgaaattgacacacgttggagtctctaatgtccaaccgacactctaatatcctgtttggaacaagctaggacataaatatttacaccaaattaaatattcgtaatttttgcttttacgttttccacattaaagacgtgatttattggttgtgaagcatgttttcaaacatactataaatgaatataaatattataaggcaattaagtaataagtgggaaaaaagttactaaaaaaaggcacggcaaaagtttaggaagaggaagaagctactctgtctgtaacgagcagcaggcgaacaagtggagacaatttaaccaaccggaagcacagggtacaacggtcaattcacaggcggtcgcaaagcttttaaaaacgcacacataggcactgggcactcacattcgccttccagctcaaaggcttagaccaacacaacaacactctcttcactcatttcatcttcaacattcatggatccagtgagcgtgtggggtaacacgcccttggcgacggtggatcccgagatccacgacctcatcgagaaggagaagcaccgccaatgccgcggcattgagctcatcgcctccgagaacttcacctccttcgcagtcatcgaggccctcggcagcgccctcaccaacaaatactccgagggcatgcccggcaaccgctactacggcggcaacgaattcatcgaccagatcgaaaacctctgccgctcacgcgccctccaggccttccacctcgacgcccaatcctggggcgtcaatgtgcagccctactccggctccccggccaacttcgccgcctacaccgccgtcctcaacccccacgaccgcatcatggggctggatctcccctccggcggccacctcacccacggctactacacctccggcggcaagaagatctccgccacctccatttacttcgagagcctcccttacaaagtaaactccaccaccggctacatcgactacgaccgcttggaggaaaaagccctagacttcaggccaaaattgataatctgcggtggcagcgcttaccctcgcgattgggactacaaacgcttcagggaaattgcggataagtgcggggcattgcttctctgcgacatggcgcacactagcggccttgtggccgcgcaggaagtgaacagccccttcgagtattgcgacattgtgaccaccaccacgcataagagcttgcggggtccacgggcggggatgatcttttaccggaagggcccgaagccgccgaagaaagggcagccggagaacgcggtttatgatttcgaggacaagattaactttgcggtgttcccttctctgcagggtgggccccacaaccaccagatcggggctcttgccgtggcgctaaaacaggcctcgtcgcccgggtttaaggcctacgccaagcaggttaaggccaacgccgttgcgcttgggaattacttgatggggaaagggtacagtcttgtcactggaggcacggagaaccatcttgtcttgtgggatctcagacctcttggattgactggtaatatatataggattggaccgctgcattttgatttcgatttgttgccaatgtatctgaatctgaatctgactcgtttcttgtgtttattgctttgcagggaataaggtggagaaactctgtgatctctgcaacattactgttaataagaacgcagtttttggtgatagcagtgccttggcccccggtggagtgcgaattggtaaccaacttatttctcttttatgtgctagaatacagatcttgctttactaactcaattcaaaacaagatctcattcttaagatcaaataatgatttcctaaggctaggactatatcctcaatttttttttttttatcacagaacttaatgaagtttcttacgaaattttgtactgttttcttatcagaattggaatgtaagtaataatgtttctattaaaggctagcatattccaccacctgtccagggttgagccctgggatatatcgaagtgaaattttaattttgattggagaacaatgcttaaaacacaaagtgattgtatctaagttttgtgcatattttaatgcatttgtacaaggtatcttggtaagttgtagattagtattggaagaaatttcattgaggatgtgtttttaatttctagtgctttaacaatggtgtattagatcgggctaagcttgcagactgccattattaatgagtttctagttgtttgattgtgcaatatgattgccaaatcaattactataaactaatatgtttttttgttatttgtttttaatatttatccctaaaaatgaattatcttgatgtattaattacaaaaatgctttttttttattgcccctgtttctgtatttttctctgatgttagtgaaatgtgtgactgtgctttgtttatcatgggtgagtgcctgactggagtttgtgtgaacaggtgcccctgccatgacttctaggggtttggttgaaaaggactttgagcagattggtgagttccttcaccgtgctgtgactctcacactggagatccagaaggagcatggcaaacttctcaaggatttcaacaagggcctcgtcaacaacaaggccattgaagatctcaaagctgatgttgagaagttctctgccacatttgacatgcctggcttcctggtatctgaaatgaagtacaaggattaggttcaatcataccgctctctactgaattatgttactcaaagttcggcgcaaagggcagaaatggagaaaaaggaaataagtgtcttcctttctgggagtattagggtttatcgtgatggtgtttcaattcaatagtttgaagtttctttgtctttgatttcatgtttaatttgttagcctgattgatatcatatttttttcatatcaaaattgaaataatacacctgctttctttattttcctcgcaagctagtagtagtatgtttcatgatttcatcttcaaaatattgctcaacagaacatcttaattcttaacaaccatgagttttagttgagttaagcaaaaaaaataaaaattatccaaataaatctatcgtctttcttatgcctcaatgttcaatgcctcccccccctcccttgaaaaccaaaatgctccgtgtctaattgtgataaaccgataatacccctctggcagattatgaagttaacgtaatcctgtaacctattgtagatagacttttgtaacttaaactcaaattcttattgtggtgttttcattgtctaattactgaatcaattcttgatgcatcacttcaacgtcttcttgctgtagtaagttccacacgctcctattggaaagagattatgcatcaagagttaatcggtagaagcaaaaaattaataagacattcattaataattatacagcgtgacttttcaacatacttccaacatcgttgtgtaaattttcccaatcccatatctgctgcttctagtttcttatttttgctcatgtactcattgccaatggatccaatgcaagaaagcctgctaaaagccattaaaatgtacataggaatgaagtgagcagctattgcattgtggttgttgaactaatttacttgatgcaatctgaatcagccactaaagggctcgtttctcctctcattagaggcgtaggatttgtttgctcaatcagcgtcctaaaacacacatcttatctctaatgatttctatcattgccagaattacaattaaaaactaaaatatcatttaaggaaccaaaaagttctgggaagaaaaaaaggaggatcagtccagtaaatgtaatcaattagattgaattgaacttctacagacccagaaggccctcgatgcattttcaccgtaggtggtttgtctttctgtactatactgctcgcttagcaaaataatcaggttaagaaagtttgcaatttttttatcttgttgaggggtttgttgtcattgaaaacaaattgtactcaggaatttgactcaacatgttcaacccacacattatcacatttaaacaaatctaaatcaatcgcaaatcatatattcaacgttttacatactaaatatttcatatcatagttcctcacttcgttactacaaagtcaaaactttatgtgtacaatattctcaatacaaattgaaataagaatcaatattcttacatcatagactacaacatgaggttttaacatgtcatgtaagaaacttaatgccaacgagtaaggcttgaaatatgattagagtaagaaacttcccagattttataactagaaggagaatgcacgtgttaggttttatttctccttggaatcatagtaaaagtacacccaaagaaagccacttgctggtttctttgttatcaatcaatgtcagagataactctcaaagaagccctagtttggaagatatatcatacaatttagaataggctaccaatcaattagaaatgcaaatgagctaaattgcatcaattacttcaatttctagttaagaaggccttcacaactattggactcttgacgtaatgcttgccatctgaccatatcagttttccaaacacgtagttatttgtggcctttccttgcatggccttgaaggttactttaaagctcttctcttcaccaacatttttgaacttcaagatgcttggcttcacagaaatggtgattccatgcgggttttgaacatgagcaatgtacgtccctggagaaccaacatttttcaatctccttgtaactgtcactgacccagagagtttggggactgtgattgagggatagttcaggttgaggagactaaatttcttgcggcattgatatggaccttctgtgaacactgagatctgtgtcgcattgtaacctaaagcacataagaagttgaggtaatcatcaattgttgtgtcataaactagcccgggatccattgctctgtttggttgaacatgtcctgccccgtaactgaatggtgttgccttgccattagtagcattcagtagtggttccacctcattgtctagtgttgtagctgaaagttgcagaggacaaatcatcaacttttgatagccactttaacctcaccaatcaaagttgctttctatatatgtatggacaaaaacttagatacagttccttagatactattggtgttgttctccaattagaattggagtttcacctcccctcataatcttacatatagtttcttaggtactgtaatcgctgttttctaattcgaattagagtttcaccttgcacaatcttttaatgaaaacctttattaacactagaagaattaaaaaaactatatctaagttactttctatatgtatatatctaagctttatatttctgggacattttgttgtagattggcttaagaaaaaggatttgaagcgtgagaaacttgaagaacatctcactcacccgtggtcatgattgctgatttaatagcagcaggactccacgtaggatataaggctctcaatagtcccacaatgccagaaacgtgagggcatgacattgatgtgcctgaaactgagttaaatggaatcctgcgcttgtcgaacacttgattggttggtccttgggcttcagtataggccgctataactgacacccctggtgcagtgatatcaggctgaatatatgggacaaattaagagttgttagatatctaacacattacaaaaaattacaagccaaattacactagtgagtaatgtcacctttaggatctctggcacgatagtatttggtccttttgatgaaaaggctgccataaacggggctggcttagtatccaactgagtctttggatgtgtaatatatgccactgggaacctagcaatatataaatttcaagtagtcaagttgaaaaactgaaattcatgattatcctttcgggatctttatatagctcaaacaataacaatcacaaaaaaactagaattgcttcctttacttatttgaccataaactgtaagtataatagcaatccatttgaccataaactgtaagcataataacaatagtatagtgcaaactccaaagtaggcataactttaaggcatagcatgaattagtattaataagtggtcgactagactggtaagtatcttacttggttgagttgatgtaattaaagacatcactgccatcagtaaaattgatatgagaagcaggaaggacatgaggatcagctataatttcattcccagtagtcttgtcattagcaaggaccattcccacagcaccagcaagaaaagcttgctctcccttgtccactcttgcatttattcctcggagacataccacgatctttcccttcaccttgttgggatccagggtcccattctggcacagcaccctgcatgcacataaattttatttaccatatctagtactatgttaattatgccaaatgatcactcaacaactgacgactataacgaatttcaattttttttttatacttacgcatctccagctcttgcactcgccaatttagcatctgtagctttaataattgggtagaacttgcgtgccaatattgtagctgataggctttcgcccttcaaatcaagcaatgtacaagaatattgagtcaggtgataatgttttatatattaagagtgtctcctagatcatattagttttttccatcattttttgcaataataatattaattttgactgacatgacaagtgcccattttattttacatgaaatctcttacaatgccacatatcatcaaattatcttgatatgataaagtgaaataaggactaacttagtgtattataaacatttaagggactatagaactacattgtaaaaaataaaaattacactcacggtggataaagttaaactctttcaaaatttccataaaagaaaatgtgtgtgggaaagagacaaaccttgaaggtgatattgttaccgaggacaacgtaagtggggaactgtcgatccatggtgctggcagctaccgtaacatgccagggtgcaagattttccgcagtggcatccgcaggcccagtgttgccagcggagcaaaccaccacaatgccatgtttggcggcatggaaggaaccaatggcaacactatccttgaaaagcgtggaggtagagccaccgagcgagacggagaggacatcgacgccgtcgtggatggcgaagtcgaaggctgccaagatatcggcgtcgaagcactcgtcgccggcgacggggggccagcagaccttgtaggctgccacacgtgccattggtgagccacccttggctgttccgtggccctggccgaagacgctgacacgtgcgaccatgttcccggcagctgtggatagggtgtgggtcccgtggccctcgttgtcacgtggcgagtcaaaggaggagttcaggggacccgccactgaggcgtaccccttgttgaagtaccttgcccctattagtttcctgcattgtttagtgtgttcaaattggtgttaatggcgtttgtcttgagtgaggaatgagtggcccctcatgttatatgggaaatgctgaccttcagagtgtgtatgaatggaaggaacatagataaggagaaaaaaacaagaatagtgtgtacacatttgaagttaatgtcataatcctttcatgaagagtggccctcaataagtggttgactaaataagataaatcctaaattcaaccaaagattgttgtacttcatggttagaaaagggttaataacatattttctaatataactttttcttataacaccttcttttactttctttaatctaatcttaaatataaggaggaaaaattattctaataaaaaaattaatcgacatcatttaattatataaattttatttaaaatatttgtttctaaatcattcttaatattcttattaaataaaataactgagatttatttatatttgatattgacacataaggaatttttttcttcttatattcaatatgatattaattaaaatttattaaattaggaaagagaatactgaatgagaggtgagattcagaaaaattgatgatttttaataaataataaataatgtgttgaaaataatttattattaatatttttcaaaatattcttcttttctaacaaggccatatcgttctagacacggagagaggaattcagattaagagtttttttaaagaaaaccttggatataaaatgacaggaatataatgaccaggtttacattcaatttatccatctccataaattttcaatgttggttcgtttgattttttaaaaagtctttataattacaaaatatatttagcattgaataaatattttaaaataaaaataatagtttgatgaattaaaactatattttctttaaaaaatatattctgaggagacttgttaacgagatccaatattaaatactttaattcgaattttctttttataaatatcccaacaaactcaaaggaagatggtacctgttgcagtgaaaagtatgatcaattccgttatcacagattcctctccactttgaaggaattggtcccaatccttcctcactaaagctctttgattcaggccaaacacctagcggtaatgcggtgggagcaaaagagagaagagtgtggtcaaaataagataagcatattgtaaaacggagattctacttccttctaccccttctccctcaatctcatccaaattggctaaaagctagcatcatgatggtcctgtttttagttttcattgcccccacccacttttcatgcttacagtttgggagcattttcaaaatgaagctcatgtaatgcacttatcgattttcttattggtgagcttattatgacttccttggactatccccaccttggcaccattcttagccccacctcacattataagcccaccctttttatttatttatttattttagtcctatcgtaatgaacagaagtcacaacttatagttttgtctcaatctaagtatgatttatgaccaaccttctgcatcacaacatatgcatagactgaaaacatatatttataacttttaaattatttaaaataatgaacatctaatggtgtagtataaaccaataattgtaacaaaattctaatcctaatatatataacagacaaatgacaagatgcctaattgcccatgtcgcctttctaaaggtggtccattctgaaagtcgactactccattatcaccaaacattttctatacatactaattttaccataagaagtttttcaatttctttataaataattactttcatcttattttattttgatgataatatttttttggatgatctaagatatcactcaatcgaaaattaatcttttaaaatattaaaattcatttaagaagttgacttcttctcatatatgattttgatcatatttttaagggataaaattattttacttaatcatgtcatgtttgtccatttcattttagtgttaattatgctttgagtataattactatataaaaatgatgtaagtgtagttatagctaatcacaagagaataatgcaattagtctatttctttaagatggttcgtgaacattcatactttgggtgtggaaaaaaactagtctaacaacccattgacggcaagattcaaattaataataaactaatgttatgaaatcaacttttttgaaacgatcaaactctggaaacagattggtggtgggggatagagatacgatgagataactttgagtatgttccacatgtgtgtataagtcaacgatctagattaaaccataataataataataatcataataataataataataataataataataatcaaaccccgttaattccaagatgttgctgaccactttgaaaagaatagcaagagtttttaaacacataaatcaggaaaacttaccggtatccaggtttccaatgatgactccctcgccaaatctggctttattccagattgagttggattggatcaccccattatgctctagccccatgaaatcccatgatcgagtggtgtgtagctttctcccacggttctcgaacactgacaacactttggggtgctctagaagcagtatggacaaaagggtataagtacacaatgagatgaaggaagcacagagaagagaaaacagaggaactaagcagaggataaggttcttggttcttacttgatatctcagcagctacttcttcttccaaagttgcagcaaaaccattgatgtgccttgtgtatgagtaaaagatggagtccttggttgtattagaactacaaaaaataagcaaactcaaacaatttcaataggtaataaattgtaccatatgtgagttaagatgttataattgcatttttttttaataccttcctaagaaagatcccagaaactcatggtgggactgtgtcacttgattgaagtcaactgaggataattctggcttgtgtgagtgggctcccaagtacaccacatatgactacaatttaaatggttcagtgcaagcattagatctttttccacagttttatttatctttttcaagattgcaaattgcaatagctcacctttttcactgcaaagctgggtctgtgcagtagaaagacaagaagaatttggaggagaaagtggatggaagaacttggtggcctcattgcttttcctctctttgaagtcctcctttgcttttgccttgttttgaatgtaacagaaacacaacctttggttttataggtaataacagccttgtaaaatatagtcattgcacctttgctccttaggttgaaattatatttaatgtactatgtttgccatatcagattcagttcactaagtggttttaatactttttttaaaaaatttgtactgtacttcagagctaagtttttatttatttataaattttacatggtattaatctgtttttgtatctgactaataatagagtttataatgttatattcttagccttaaaaatattatacacaagcacactctcattaaagtgtttaaaatagagatattgcattaccattatatttaaataataaaaatatacattagttataatttcatttgattaaataaagagagccatcaaaactctctcaaactaagcacatccgagaaatcaccaacgtgacagctaataattaccaaatataatattaacaaggtggctttatataaattggaccccatacagaaataacacttttggactattgcgggtttgtgaaaaataacaaatgcactgtttatttattccgagtgagtgtgtagcaagttaattaattaaggcgaggattgaggaaataggtaattggcaaaaaattgacaagttagctttaagtacaaaaaaatgtaatttctatccaaaaaaaaaaattgtaactgaaagttactaacagaaaggtatttagttaattgaagtagaaatattaataaaattagttataaaaattatgactactatgaatttatcgttaaatttaaaaataggttcgactggaatttaatatttttaaaattttaattataaaagaagtgaaaatagaaatagaattttaaaaattggattgatataatttgtattttttatataaaattcatatatttgtcctttcctgcgagctaaatataaaaacgtatttcactgtaattcatcaatgcttagaaataagtttttcaaacttatgccaaagataaagatagcatattgatgaataattatacaaattttacaacaaataaactataaaaaaggtaaatcattcgtgtcccttagtatatgtatttcttttaagaaataatacatcataaaaaaagttactaaacaggtaagttcaaggcgtatgttacccttaataatcacattgggttgggacgtcaaggttaacatcaattactcttcagaaatggcctcgtgtaattatttttaagtgtgattatcaatttaaccaagaaccaattaagaaaaatgaaagcattattgaaagaagacgataagtatataatgctgtgatgagattccatcgcaatcaaaatagcatatggtatactgttgccagccataaccatatttatgcttcgaaaaggatggcaaaaggccactgctgcctgcgaaaacctccggcggacagatataatctatttgtaaattgtaattatttataatttatttatctcttataacttttcagatatttttatatctgttctgtatagtttctagaacacaaatgtacagcacgaaagcgctgtatgattactgtttgatcactctaactccgcaactatgaagatatcgatggtgaacgatatcccacagtagatgatcactgagatacacgaaattggggtggggtgtgtgctcagtgtaattgaaagagagagagagctagagtgtgtgtgtacctttcaccaacgagcaagtcatatttatagatagaatacctgaccgttggccaactgcatcgtgcacgagtggttcctatattcccggcttttacctgcacgttagtaactacctgagtggactaagtctttagtccatgttcattgaatcccaatatcaggccacgatcagtttacatgtcgcccactaattgggccttaacctaagcccaattgtggcccccagaacagttgccccccagcccggttgccgagtacactcgggagccggggtgcttcctccgacaccgcaattgtcaagtagacgactacaattattcatcctcgtttgtccggacacaattcatccgggtactgggagcggccccgacccgggtacatctcatccggacacgttgtggacgaccccaataattaccttctgatcgacattaggagttgaagtcgaacatttgttcaaggaagaaacattgtcgaccatctatctagagaatcgtgcccgggttggtggtacgaagtcgactcggtttaaattacgtccgggttgccgtcctcaggaagactcgcgaagctcctaggcttccacccctgcgtcggttattattctttgcccttaaaggcagttaacgcatttaatgcgtccgtctcttcactgacttggtgatgattgcccattatgcacttttaccataatgcccttgcgacgtttcaattttgacaactgaaccggttcttttccttctggcggttactgaaactgtcattactttttgaatttgattttcgaaaattgccttttcgtgcctactactcccttacttgtcatttctggttatactctttctgtcacttcctccttttctctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcccacagacggcgccaatgttctgtatagtttctagaacacaaatgtacagcacgaaagcgctgtatgattactgtttgatcactctaactccgcaactatgaagatatcgatggtgaacgatatcccacagtagatgatcactgagatacacgaaattggggtggggtgtgtgctcagtgtaattgaaagagagagagagctagagtgtgtgtgtacctttcaccaacgagcaagtcatatttatagatagaatacctgaccgttggccaactgcatcgtgcacgagtggttcctatattcccggcttttacctgcacgttagtaactacctgagtggactaagtctttagtccatgttcattgaatcccaatatcaggccacgatcagtttacatgtcgcccactaattgggccttaacctaaacccaattgtggcccccagaacaatatctattaataatctattttgtttctttaaattcatttttctaatttcagatctaataacttagacattttctattttaattcttgtaagatatttaatttatctatagtctatataactttatatatatatatatatattttttaattttggtccctataaacacaaagttatgggagttataaataaaaaatcacaaaaagctgaagagtagcaacgacaagaggatggtatttatgtttatcctccgtcttcacatgccatatttcttattgtaatcttctttttctcttcactctctaaattagtattttttttatccataaaaatagaaaattatattaagatttataacattctcatatgctcctcaattaactcagatacatatccttggtattattttaaagttgaccagcattttcaatcatacttgcaagacgttaaaagtcacatgtccgatttaacttcctaaaaattggtgtctcctttaaattggtgcaaactgttgaaccaataaaaaactagtaataacctataaaacccgatagattaatctgtttcacttaaacttttttttaaaataaaaactttcaaaatgacatttttttaaaaaattataacttatgacattttaaatgaaatttacttttattattattgatttatgcatattattattttttcaaaattattaagttattatattaaaatctatttgatcctaatttgattttgattgaattattaatccttgaattaatgtcttcgatgaccggtccgattctaacagctcccttctgctggcagattagcccagttctctgtcttttgttgctttgttgccgtttcttctctgattttatgggcttagcttagacttcgtaagcactgggttttcatcccttttacgcaaaaaaacaaatccagtctaagtgagtacgaataaatttggtagaaagaatttgttaatcccattatacttaatatttagcaagcattttaatttgtgtgttgcttaggataagtgtttgttttaaattcattacatgattaaatttataataaatgaataccttgaaatatatataaattatatcttagatttataatgaataaccattgacaattttgttaaaaacaatctattgaaatttaatcaagacataaagataaaagatgttagaatacaatattataaaaaagtttaacaacgattttagaaggacttcaatgacgatttttcaatcaatgtttaaacaattgtcattggcttttgatgatggttttccaaaatcattataaaaatcgtataagaaatatctaatatcaacattttcaaaaataattttgagaaaaatcaatgtaaaatgtctcttttcacgataattttgcttaaaactaatgtaaaaaatgcactttataaagacaattttgtagaaaattattctggatatagagatctacatcgattttttggcaacccatgtaatttgtgcaactttttccaatgttggttttgttttgacaacaaatccaatttgtaatttcaaacataaccaaactcagacagtttataacaaacatatataattatattcaaattattatcgatcaaaaacaataaattcaaataccaaataaaatgataccacattatccaattaattaattacattaaacaaaaaaattcaacatttgtcatgtttataatataaattcaacctaaaactattctaaaatacaagtttaaccatcatatacattttcaaacactgttcattgcttcatttctaatttttaaaaaagatcttacccattttttttgaattgttttattccttgcaatttcaatgatgtttaatcactaaatcactacaacatataataaatacaagttaatcacattgaataatcaaaagtctaataaatgaaataggttaaaacaaactagtattttcttataaaaaatcaataaaatactatattaaataataagaagtgtaattaaaaggatagaaaataacaaaaaaatataaaacatacaaataaggataaaataatataatttgagatgattgagagattttcttaacaaaatgtaggagtagagtgtggaatgcacatttagaccgaagaatagaggaaatattgaaaatgtctaattaagagaatggaaaaaaaatatcactcattaagttgtgtattctaatttataatatataaatagataaataaaaatttccaacaaaattaattcttcataaagtttggcatattaatcaacatcatcttgatttttttttcttgcttaaattatatatacctatccatctttataaaatgattgtcagcttttggttgattttagaggtggcatgggttatgggtacatatgagccttggttttcggctttgcccatttaacatataaccgaccaataaattattgttagtcctttttaaaaaagatattattgttacgtattttataactcaattaattcttcattttattttctttataaactaattgattatattccagttttattcttcattttcttacccatattttccccttgatctcttcctatttctttccctcgaaatcccaaacacacacttaactccaaatatcacaccctataaagacaaggatatacaattattttgaaattatagtaggaaataattttgctacaacagttaaacatatgtataaaatatagaggaagtatattattatttgcaataaagtggtccctacagaaattttgcaccagaaaaagaattgattaaacatgatgtgagcaaatgcatgaagggccaagcagaacattcatagtgtgtggattgtcggtagtactaaaccccattggccactggatggtgaaaggccaaaagtatgactttgttgctctgaaagaaaggcatgcatgttgtttgaaatatattaattatatagatatgtgtatgaagaggacgacgtagttgtgaggagaaccatatgtcttcttctgtcttagtctcaaatgggtagtaaagtcaattctcatggatctaccgagcaacgaccatatctttattccttgctagccctagattttgaaaaagcaaatgtgaataatggttatatgcaaaattagaaagcaacctagcctaccccaccgttgtaaggtatttattgattaatataacattacgtgggattttcagttttgcttgtgcatgacgagtaaataacaaccctagttcaagttcaactcacacacgtacttgttgttttcatccatatttcattgcatgctgcaacctatacatgaggtgtctgtgagggaaatgatattcttcacgatggaaatgccacatttgtctttcatttcaatatgattttgagtaatgttttcatttccatttcgggtatgttgtgaaagaagaaagaggacgaaaaggaattgttttctctagcttcaatgttttattcctctggtcctcagtttgcataaactttccttattttggtttgacttgtatataaactttaccccactaattgtggaacatattgtcaactaaagaacaaaacgcatcccactttggttgatttttgggctttaatttattctagctttcaggatcttatctcgaagaattaaatatttgacattaaaatcaatatcttaaatatcaacatattgttaatattatttgtataaatatactttatttaagagataaaataagtataaagtgaatgaatgaaattataaataaataaagaattattattctaattcatgagtatctaatttttaacatctttatgcattacttgaattcctgttttcttccccaaattaaagcttgaggtggtaaactaactgtttctaatgacaatgagctcgtggtaaactttacttaattggtccatttttttctcttcttgtcaatcttttcatattttttttacatatttagcttgatttattttaaaaataaccatttttttgtcaatttcatgagattttaaaaaaaaaatccttcgtgaaattattcattttcaaacacgttagtttacactgtttttcctaaagtgacatgttgtttgtaagatcttgatcatctatagttgaattgtatgaaagtccagtgaaaaattgtattcatacaagaaaactaaataatttttttattatcagccgccaaaggtaaaaaattatacaacgttttcttttctctctatcacttatctcatttttttattgtctcttcatttcttatttctctcttatttataaataaaagttgcataagttaatttattgtataaatataatttctcagcacaactcacatgtgacaaataaaaagaaggattagaatcacatgttgtctttaaacaacacatgcgtccaaggaacaaattaatctcctctaccaattaaagcagttaggtgaagtttgaaaattgattgttttttaatatctttaaagagttcaattatagaggattcaaatctaagtttcttgtatatggaccttttaatatgccagaaggaaaaagaaaaatatttatgtgnnnnnnnnnnagttaaattttcaaattgttgtgtgcagcgcatatgtgagaaaaattattagataattttaaattattatttatttatggtctcaatcaatatttatattcatataacatgtatttaatttttcgaatttaagaaaaaataatcagtaatatttaattaagtgtcatatagaaattaatcatgattatgaactaattaaatgatgatcctaaattatctaataatttctcaagaataagattattacaaattatctttatagtttagaagtcgatctatttgtttggaaatatactttttgtttatctcaatacaagggctgaatacaggtagcgtcctagaaaaattaagatcaaagaaaatagaagaacacacatataaacttaaaaaaaatagattatttaggttttgctaaaagtttagtcatctatatatgagcgatcaccaatgcatatagtcaagaattagttcaatggagaagcttacgtagtaatattttttttattaataaatagatcatatatataaatataacgtctcaacttaattaactttttttactttattcataaaaccaaataaactaatataagtccataaaatattaaaaaatttctttctgtttttttcttcttatttccatattcatttataaacgtttatctcaaataataaaactgtgttgagatctctctgttatatttgtttttcttatcttaattcatatcatctacttgaacactttgttactactattataatttactgtatatatctaaattataaataactattacaaaggagggacatatcaacaaccacaatctccttttgtaaaggcaccctatgcctatgggctatgggatagggaacttcttgtgcatttcccttcccgggatcttcgactactgtaaaagagcaatgatacagtatatatatacataccacaccacatggttgggtccattattatagccccacctttgcatcatccccttcccggttgtacttcctttatgcatgatagatgtaattaattatgatctctgaataatcctcagttactaaaactaatttaattaaaattaatgatattaattacaatgacaatatgtgtctcacaagtctcttaattatcattatcctccattccttatcaacgactcactttctatgttgtatacgtatcttctattgtctataactaattgactttaataattatttaactttcttaggagcattatttaattttaataattatttccatggaaattatgtcaaaaaataacttttaatttagctatattttattttatcatatttgcttgtttttatttattactagataaaaataaattctactttatttcatttcatatttcaaaaattaaattaaagtaaatcattttaataatttattatgatatctaaactaaaacacacttatttatgtatcaagatttctgtcacaatatttattacgcactggaaactcctgccaaaacttgagatggaataaaataatttccaaaaagaagaaagtgacaaatatccatccctatttctgtatgatatagcttttagccatagggatatttttagatcacaaaattatgaggtactgtaattttattttattcttgtcgggtttatatgtgatctatggatttttttttatatcatttacatataaattgagtttaattaacaagatagcaatttaattcaactcattcttaattatatgatgcgtgctacgttttttagtaactatctttgaatttttactactattagattgttatttaatctatactaagtattgtttattgatttataattaagagaacttgtttatcaccaccataaatttctctgtattcactagatgcatgtattgttaagtttaagaaattcatgcctataagtaacaaaaaaagagattttgtaaagaatctatgcacgagttgcaccaaagtatatcacgtaactttctctgtcttttgaaaacaatctatttgtctgaaacctaagtagaaaccaactattgtaattaaaagtttaacgccgttttttgagttctgttatgtcggtagggactatggacaaatatattttttttgttagttaatttatttatttatttatttattggtgattcactctctttcgcttttaatttcttgggttaaagcagaaaatggcaggaatgtggggaaaaaattggaggacagcgacccgattttctctcacagcaaattgagaaatgagaatagtttgccctcgcatctgatgcaaattacataattatcaaattatgttatgttcctcattctttgaggtactggcaaatgaaaagaataacaacaatgctatatatgtatctttataatccaatcacatggtgtgttagtgggggttgcggcactgaactggtgaagcacgatatattatttagataattttacatttatttatgaaattaatgagaatagactttcactttaattatataatagtacgtaatataatgctgctctaaaatgacaaaactatttgattttttcggtggaaattgtttgaatatggaaaagtgactgactatcgttaccatcgatgcagattttgaaagtgaaaatcaacagcaaaagtacttttaggtgtgcaacgtactttttgggaaaaaaaattccttgaaataataaaatagaacgataacaaataaacaaaataaactctatgtgttagaattttcaagtactaagtactaccaaacaaacatgcatgcttttaaaacaaaatatgaaattacacattgaggacattttaaggaatatgttttcaataatatgccaaaattatatgatataatcttaaattcagtttgtctgatttaatagatcttaggtgtccaagttcttcaaaaaaggtagtttgtgttttatttccataaacaaccatatgtctatatgaagagttgataagataagtgatcgccaatagttaaaactatgtagaggaatactaataaaaacttcaagtaaaaatatatgaaaaacgatttagatcctaaatagcatttttgaagaattggttttttgacaaaacacgatgatatcttttgattcatgtaactgattccacctagtggaaacgggcttttgttgttgttattgttttaaactactatatgattgcataatttagtagcatcatcaggtacattttaaacaaaagtatatatatagatatatatatatatatatggaatcatagaagccaattagttaccttaaacatgattatgctggcaaagatggtgaatgatgtaaacatgacatannnnnnnnnnnnnnnnnnnnnnnnnnnnnnnnnnnnnnnnnnnnnnnnnntatatatatatatatatatatatatatatatatggaatcatagaaggcaattagttaccttaaacatgattatgctggcaaagatggtgaatgatgtaaacatgacatagtaaattggtgatacaactgcagttttaaaggtgtccaaagcctgaaacatgattccaaaataaataaaatagcattacaatataattggtaggtgataagcatattgtcttaaacaactaacccggcacacttatttgaatgattctaacattattggttttatttattaaagaaagtctaaaaaccaatactaaaatgaagttcaattgtaagttagttggaaatccctactgtaaaaaatatggcatgccatttctgaaatattgcatgttacgtattactcatgtataacggcaaaggaaaggaaatgaaatagctcaatgccaattaagaaaagcaatacaaaatcttttgtttataacttttccaaatgccacgaactagattagaaatgcaaacatggtcatttagataatgatagaagtctcaaagattgcaaaagcatagttaaatttcttgagcattacaaattaccacctaatcactaaggtcagaaaaatcaaaatactgttttcaacattagcactccaataaccaataaaaaaaattaaaaatatatttaactttgacataattattttaagttgtactttggaagacaaattacaatgactgccaacagtaaatgtactaatataagtaagtcaaagtttaccttgttcaagtagttaatctgcaaaagacaaacatcctattacaataatcataaagaaccaggtctgaaagtaaatgaattggttgttgccttcaaatgttaacttcatagctattgacactgctttaacactcacgacctatgcaacaaggaacaacattaggtttatagagggtagttttattgtgacctacatgacacatatgagcactgaacacataatcgatataccgtaattgagcctgtgagagagcatattccgacatatataaccagataggttggcccatatcgagaacacaatagaaaataaggatgcaaaccaaccacaactatacacatgtagattagaaagcctgttgatgaaggaaagaactcaatgtcagtttcattaaccataaatgaatgccttgaatctattaagatcttaatatgcatcccactcatcttgtatcctcctactttgattttttacaagattcaatggtaaaagatatgttgaaaccaaacaatcaggaattgaaaattacctggttctgtagcaagttgccacacttctttaacagagtcaataactcttacatggggagcatgcaacacaatatttgtagatcccaccatacaaagagcacatcaaatatgtgcaacctctcttttaagataaagtgagctaatattgcactgcatcatgatattagtttgtaactttccaaaatgcaagccgcatccaaattaaaatttaatggatgaagatgtgcatccacatttgtgtcaaagaaagcagaaacatcctaataattaatgttatgaagaatagcatgttccttacctgaaaatgatacttaaagctcccaaaggagttacaagtagtgcaggagcaaatgcataagctgcaaaattggctacttctccaacaatcactacaaaaatgaaagcatacatatagaattagttgatgaaattttcataagattgtcggggacattagcaaattagttatttatagttacagattactaagagttaattgaaaatttgctctatgaaatttatatgtagcacaaaatttatatctatgaaatttatatgtatgtactaagacatttgaatccaaagtcaaaggaaacattgtcaaagtagtagaacttaaaattaaaagtaataaaaataattttgtcttagaagaattaaacttaaatcagttgggttcaagaatttttggtagtccactagacttgaaatgtgatagaaattattctgcatcactttatcttttttcaccctccattataatcctaattgtaaaatgtcaaattagctgataaagacaacaaatgagacgccttttcaacacaacagaaaaaaccatatatcatgaagtaatacaataaatacaaacagataattaaagatgaattagatcaaacatgcaatacaattggtcacaagaaatcccctttaaataaaaataggtagcttatgattaggccttgtcaaatgtgttttgcaggtaaaatgctacatgatatattataatttagtaaatgcagaaccaaaataatttttaaaaatcacacactagagatcattccaaaccacttccaaggttcatatatatatgcatgccctcccgcacctgatcaaattaaaacaaaataaatatatatatatatatatatatatatatatatatatcaatgattaaagaaagggtaattaacacctagcaaaccaaaaacaaaaatgtgaggaaacatgaacctgctctcgacgcgccgttgctcgccaagctcttcgacgtcgtttctctcccacgtcctccacctcgcagcacaagcgggcgtccgctacgccatgcagaacccccaatcctcggcttcgtctcccttctagaagcttccaaaaactccaatccccatccctccatcgtttgggcctcctccagttccgtctatgggctcaataatgaaagcccattctccgaactccaccgtacagaccagcccaactttcacatttcatataatatgtggcaatataatattctttcttgtgtaggcacatgcaactttaacattttcatttttacatttctcacatccctttctctcctaatgttcctttcttgtgttgaacttgcatgcttctcattgccggtaacccgatcatggataacagtttctatacaacataaccaaaccaaacgaatatgttcatactattaaaataggaccacaacttcggttaaggacaggcatgagatctcacatcttttaatgcttagcacacttcaaaattctgcctctaaaaacaagagaaatgaaccagtcacttggatacacaggctcaaattatacatcatgacctcaagaaagaaaattaatgactcctcatattaaaacagaccacaacttccgttaaggacaaacatgagatctcacatcttttaatgcttatatcccacttcaaaatgctgcctctaaaaacaagtgatatgaaccaatcacaactcaaattatacattatgacctcgagaaagaaaaaaaaaatcatgactcttgcacattaaaacagactacaatatctgctaccattaaagaatcatatccatgatgaaattccaaaaatagaatggcggcaaaacaactttgtattatgtcaagaaatatctttaataaagcattagctattaagaagataggttaagaaaatattttacagaagaatgtgtgaattgatattattgataataaaactttgaactaataggttacaaagtataacaaactagataagatgaaaccaaaacaactagataagattaagtgtaacaaactaacaacttgcctatatttaaaatacataacaaacaaatttaaaatacaaagatataaataagattaatctcccataacattagcatctaaactcaaccaaagaaaattgttttatacaatgtctcgtcatcacaatattcaaatccactcatttctaaggagtcgtgttgtttgatggatcccctgaaaattgctgcagaatcaatttcagctgttgttgtatttcattcacctgttcttgaattttttgcattccatgaacttgttgatatgcactatcagaattttcaaatcccctcatttgatgagtcaagctgttttgtggattcagcggcaacatttgttgtttttgttgcatttcgtgaacttgtcgaatttcaggaagagaaattgaattttgtaaatcaatgatgtaaggaactccaattttataatgtaaggatatgtcatgaatgctctttctttttttctgtgtgagtgaggcattttggcgaagaaagtatttttgagcgtgactagcgatttgaataggagattttgttttcacaaggcttgaaatttttgtccattgtcccttcccatatttttggagtccaactaaaaaagacctgccattaaaaaaacaaatatgagatgagaatttgataagttttcattcatttactgcattaaaataatacaacgttaaaagtctacatgtgttcttcttcagtccatgcctcccctctccctctcttgcgccgaaccgatgaacctgcagcattctgcatcatggaaccaccaccaccgttatgcaccagcgcctcaactgggtggctgggcaactcgaccggagccgagacagtctggttcacgtggtgttgggtgtcctccgccagcgacatgggaggaaccggagtagcaaggttccgcgtcgaccagtcatagagggtctgccacggctcggtctcgaaatcaaataagcgagtgtagtcatcaaacccagacattgttttcttctttcgttttcagagttgaagtttcaaactttcaagtcaatgcctttcttttcgttgacacgggcttcttattcaacgccctgacgctggtttctttgaaaatttggcggcgcaaagtggcggttctttaaaaaaaaaaaattaaaaattaaagaattgtgttatggcattttaaaaaataaaggacgattgaagctttccaaaataataaataaattataaatcttctttgaatttgaaaatatttcctatgaaaatcttatcattttaaaacttttttgaatttaatatgcaaacttaataatttttttcaatttgatattcagttgaaagtcagttgaaatttgatattcagttgaaatttttttaatttgatattcagttgaaaacctttactatgaaaatcttatcatttccaatataatttgatattcagttgaactttttatcattttttgtctttcaaattgcttattcaaagataaaaaaaggtttatcttaataaatttacttatttaaataagcaataaatgatcaattatttagaatgcttaattaagccattttattttcaaaagcctccgttaagttctttatttttttaaatgatgtctcaatgtgatattttattatttaaaaatacttttatattattcttatggttcaattcaggatgagatgttaagttacaatttttgatgagttttaatgtatgaaaatttaatcggcattatatttatcatgttttaaaaaaataaaaaattatactaaaattgtagatttgcatgtcaaaatcaagaaaatcagagaggcggaaattaaaaatatttgcatctacatatgcttgttaaggaaaagagtaaaaagaagtttcactccctattgaatttactcgcaaacaattttcgcatctagatgtaaatgccttagcaaacacttgtttattcataaaaacattcacctctcaaatgttcctagggatggtaaaatgggtctggctcggtgggctggcccgtttaacccacaaaaaaatgtgggctgggttgagactttgagcccacattcattaaacgggcgcgggccaacccggcccacaaaaatgtgggccaaatgtgggctaggggtgggccagcccaccgggccagcagcccaccaataaaaaataataaaatatttaataggtaattaaatgagtgacttagagggagagtgactaaaaagaagttaatgattttgaatccttaaccctaatacatttttatttggaacctaataatgagctatactacatatacaattatgttttgattgtctgcatcattgtgaaccaaatttctaagaatttgttaagacttaggagttaattgaaaaccattgttaaacatgtattttgtgcttgcttttacttctattaggcatgtattatatattaaaaatcattgttataggattaagttagtacattattaatttttagtataaataattacatttgaatttttttaataatttattttacctttttaaaaaatatattttttttttattttttaagtgggctggcccgctggcccactaacccactttaaagtggggcgggctagtattttcagcccactttgcaaaagtgggccagccggcccgacccacttttttagtgggttgggccagcccggcccgtttttgggtgggctggcccactttgccatccctaaatgttccatcataaatcatataccatagatgaagtattgacccttaaaacacttgtctggtgtcgttggtgctggtttagttttatttttcaaaataagaaataaagtggctgttttttatagtttaatttgattaaaactattgaaattttcacttaatgccttcatgctaaattgaaccgaaagaatcacattaaaataaataaataaacaaagaatcgtgttatggcattttaaaaaataaaagacttgatagaaactttccgaaatagaaaatccttattaaacattataaataagtgttataaaaatcgattcacacccttacctctaacaaaaatcaaaatgttctttctttcattaatcctcttaattatgtaaagattagacaaattacattgattataattagttacattacaaatttattactagtatattttcaagcatatagattatattataagtttatgataaatgataataaaatgttatttttaatattaataatttattctaaaaatattgaaattcaatttaaaaataaagataaaaataacggattgaaagagataagacaatattaataaaccgttgaagaaattttttatatcataatatgaattatttatcataaatctaaaatgtaatttatatgttactatctactaattaaaaactaataaattctaaattatttttattaaaaaagaataatcattataaatatttaatataaatattttaatattatctagagatcgacatggaattnnnnnnnnnnnnnnnnnnnnnnnnnnnnnnnnnnnnnnnnnnnnnnnnnnnnntcaagcatatagattatattataagtttatgataaatgataataaaatgttatttttaatattgataattcattctaaaaatattgaaattcaatttaaaaataacggattgaaagagataagacattaataaaccgttgaagaaattgtttatatcataatatgaattatttatcataaatctaaaatgtaatttatatgttactatctattaattaaaaactaataaattttaaagtatttttattaaaatagaataatcattataaatattttaatattatctagagatcgacatggaattttattataactgagtgagaacaaaaatcttgaccattaaatcaaatcatgaaatattacaactaaaaaaataaaagttatgttattttattttaagtggtgccgtaattattaaatttttaatattaatcattgatgtataattgtatatttttaatttactcttttactctcttatagaatacaagcactactcatttaattaacttgatgtatcatgaatatattgagaaaggggagagagatattaaactaaaaaaataagataaatattaaccagtgacctaaagaaaaagataaaaggattttcttattaggatacctagaaatatattttcctacaaattttaaatgagttttcatataatttttaataaaaaaatttccttttaaattcataatcagtaccggaaagtaagatcgaaaaattaataaaggccctgcaaaaaagaggaggccaacagcatcttttggtaacctcttccttgaaccaacggtggcctcatgcaattttattaaaaggaaatccattctcatttatttcaaagctttagtggcttgaaagttgaaatcactataaaacaaactaagcatataaaatgaatatatacacacccgtgcacacaaaagaacaaaattgtcgtgcttgaataatgagaatgttcaccactacccattaacttctcatgggtcatggcgtacgtccccgttagattttaattcaatccaatcataatttccaaaaagtgattatatgtgctttatgcctttatcctatagtatatcaacataaatggttaaatgttggataaattatggaggacgtgcaagactcttgtccactaaaaaaaagtcatctcatcctagtgtactacaaggttaaggttagggcctcgtacaatccaacccacctatcttaaattcatttatcttttgaatggatttatttgattgttcatacaggaacaagagaatgcgtgcaagctatattaacactcccttttgggattcaactttggaagcttcctctaactatttgtagtaacttaaatggacaagaaaattaattgatgggcttctaccactggttaagctaagttggattttttgaacatgggagctgcaatgggttatagcattacatgcttttttgcctcatatataaaagagagggggtgtgtgaatgttacatgtatatagttgcttcagtgacaacgattaattgtatatatatagctgctttatgacaacgtacgtttttcatgttcattttccttatgagaggttaccatcctttgactgagatgaacaacctaaaacataattcttcaatggtttaggacatgatgaacacaatagatactgcatgcagcttgagctttccgatcgtgagatggagagattcttgacttttgaagatttatacagttagctagttctacatgaggaatgtcttaacgggatgatttcataacaagttggctaaactacccatttgagcacaaagcacgaggtctcaaaatatttttccatgatttcaaaaataaaaatagtatttataatttgaaaaccatcaataattttgtaataaaaaaactacattgtcaataattttggcatcagcggagtaatttcatatgactaaaaactgactagtgtaggacatcatgggtattgaaggcaacacttaaacatgtagtattatattagtttaacaccgttaattaattgaaagttgaaaccacggttagattcaattaataatggttttcatttcagtagggatggcaaacgggccggcccgcaaaaaaacggggcgggccggcctggcccgcgaaaaatgcggggcgggctggcccggcccgcttttggaaagtgggctacaaatgctagcccgccccgcttttatgcgggccagcgggctagcgggccagcccgcaaaaaaattaaaaaaaataaaataagtcaatttaaaaataancaaagttaaataaaaataaataatttaaaattaatgttaaataaatgatgtcatgtgataattcacaaaattataccatttgtaaatgaaatttacgattataaacggttcaaaagtgtaatatgctagtaataaaagactatttgaaagtatcattatcataatcattttaatattaaaacttagaagttaattatgagagtgcaaaagagtataaatttaaagaatatacctatttcaaaacatgttaaatatatttatttaattttaatatttaatatttaaataatataggccctgcgggctggcccgccccgacccgcgtttggcccgcaattttgcggggcgggccagcccggcccgtttttgatttgcggattgaaattatcaacccagcccgcgtttttttgcgggctacgcgggccggcccggcgggccaagcccgttttgccatccctacatttcagatattaaaatgatgatgatcagatacaactgtataatagaagttaaaaattgacatctcgagaaaatttcacttgtaagtccacacaaacaaccgctcaatcagcttcctccattgataagtccaagtgttggattcacaggtcctaatgaaaagacaaaaaatccaaattaaaaatattaacagatacgttttcttttagaatatgtaacaattaacgatgaaacaaaattttgaatttataatgttatgtgaagtactgaaaaatgataataaaataaaataaaatataaatattttacaaaccgtgtctcactagaaatttgacacgtatgtggataggtagcagtagtgacaagctggggtaacgccacctggaattgtcgcagtggtaatgggaaccaaccaatgcacatgacttggcttttcatgcatttttcttcttaactctgtaatacacttgttcacttggcgcgtgttttcacgttagactaactttactggctctgggagtgtgattagtttaatctgataataatttatttcgagtctaaaattatatttagatgattttttatatatttaattttatgttggacaagaatttaaaattaattcatgtttataatttattttaattaaaataaattatacatctctctcataagagaatataatacatattttttctttttacaaaacttatacatatttttcatgaaatttaatatgtgtttggatgatatatttaaatcggataattcattttgtaaagggaatttaaattcttttgagggaattgacttgtttgtataaaacatttaaaagcaaattcaaatgcgtatttttatctaacaatttaattatattaaatcagtcaacattaaaatactcccaaaaaatagagtttgaaattttttccagagatactctaactcaactctcaccctctgtctagtgactccacatttgggagagagagagagaacgatgctgatagtgatgtcacacacggtggagagagagaacgaaagttacagtggtatcacacacaaaagagaacaatagagaacagcaacaatactgtcacacgcgaaggagagagagatcgatgggtatgttgcacacagaggagagggaaatagtgatgtcgcgcggaggagagaaagaatgacggtgatgtcggtggcgggacgcgacagtggcaatgctgattggaggtggcagcgtgaaggtagtcagtgatgacgattttgattggtgagttggtgtaggttataaggaaggaggaaccaagaaagaaaggttatcaaaattttttattattttttttatttttgaaaaactattatgaaaacttattttaaaaaatatatgattttcattttgatcgatgaatatagtaaaaagtaaatctccattttgtcactatttaagaaaataaatttgtatttatcttcatattcttgaaaaattataaatttaaaaataaattgttacatatgaaggtattgaattatttcatcataattaaaaatttgaattgatttatccaaacaaatcatatacaaaattaaataattttaaataagagcaattcaaatatatggtatttcaaattctttagaatttgaaaatccctcatccaaacataatattaaggaaattgcacatgcctctcttttattttttaaatttatacaaattttctaaatgttgtttaaatattttttgacattgacaagcatgtgcattgataattttgataaaaaatgactaaaatgtatttttcattttcataaatatggaaatgttctgagacaatttttcgagaaaatcgttttagaaattggatcttctaagacgatttctcccataaatagtcttagaagcatccatccttttttagataacaatttataagataattctcataaaaaatcgtcttaaaatgtagacttttaaagatgattttttgtaacaaccgtcttataaatacctttttttaagaacactttctaagatgatttcatgataaaactgtcttaaaaattatacccttctaatagtttaaaaatcgtcgtccaaaatatgggtgttcgcgggtcggttcggatcggttttggccaaatttaggacccaacccaatcaaatttgatcggttcgattcggttcaattttcagaaaaaaaagtttgaaacccaactcaacccaacccgttcatgaatagttcggttcggttcggatcaccaggttacccatttaatttaattttataactattattttatatcacgattgtttcaaatatctcatacaattaatacaatattatcaaatgtataaaagtagtaaaattgattcatttaataccatcaacataatattataaaatagacttataatataaattaaaacaaaagatttgtgaacaatatttactataatagtctgaatcataattatttcttacaaaccaagctttgttataaccaattttgttgcaaccatatttgctgaatcaaacaaataaacaaaaatataaatgaagtaacatggaccttgttcatttgaacagcagaagcaataatattgaaataagagataaagaagacacaatcaattttaacgtgaaaaacccaattgggtaaaaaatcacgacttccaaattggataatcaatccaatggataactccactatgataattttgtgtacaagagttcttagtatcctagtttcctaatctacccttacacaacaattatcccatttggtatccttgtttcccatcaaaaagctctagtctcaatttaccaagaatagagatacactgatatccttgtttcccaaccaaattggtatcctagtttcccagccataagttgcatgtctcaattcatcaagaatacagacaaaattggtatcctagttcccaactgcgaccttttttccaaagtcaagaaaaagaatacaataaaatagtacatctacgcttatattccttaagcaaataggtacctttaaatcctgattgagagttgaagaatcaaacttgtcaaacgcttctatatgatctcacaacaattctcttaatgatgcagacataaactctctaatactctaatattatttggaatggaatgcatacatgaacaccaaaatatgtttctatttatactaatttaaagatatgattttaaccaatttttgaatgcaatcctaaatatatcctatcatattatccaatgcaatcttaaagatattctattatattatgcaatgcaatcttaaaaatattttatcctactttttaatgcaatattaaaaaatatcttatcttatttttgaatgtaatcttaaacatttacaatatcatacctttttttattatcaaattatttttaaatttttaatatatacatataaataataaaatttatattattattacgggttcacggatcgggtcatcggatcaacggatctgtaaatctaaacccttgacccaacccgtacatgaacggttttgatcggttcgattcggttttgacccaaatatataaatgacccaacccaaactgttcaaatcggttcggatcagttcggattcacaggtgacccgtacccgtgaacacccctagtccaaaaatattaacttttataacggcgactttaaagataatagtaacatatcaccgttaaaaacttttaaagtcatagtaaaaagtcaatttttaaatgtatacatttgtcaaattgactaagttgatctcaaatttgatttcaggataaattgaataaatgtttggctggtaagtttatacttattcaagatccttcaaagttatttttattaattttataaaattaattgtctaataatcaaatcaaatttggttattcattcttgtttattagctagttgagtaaggtacaagatttgtgataaactttcattatttatattcaattcttatgaaaaaaaattatggtcttaatcgaataaaaaatataatattttgacttatatataatacatattattcttatcaagttcacttgttaacaaatctgatcttctcggttgtctaatattattgatataatctcttatctttttctttggtgtgcaataaaatacctattaaaaggacttcaacaatcaaatcagttaagttgaagatatttatatgttttggataagggaatacgtaatttcctttttgtttcttggatatgtattgagggagagagaagttacttcttcccattaaccatcctttgctgaatgatcctgtttttcattgtggagattgtgcctagacgtgcacgaacatgggacatgtgtctgcatggagaatactagctagtctaattatataccaagctcttgtttaagctatgctgttgagtatacacagagttcatcaccgtactgtacacaaattgttcactaaagctaattaaatgttgctagcttacgagagctatgaagaggatttgactattagttcacgtactatcattttgaatttgaaggaaataaatagagatttgaaatcgaaatacaaatcaaacttacaaatcctcgaaacaaaatccactctcaataaaatataaataaaaaacaagagaataaattatagttatagtacatgtctggatattagttggagaactcaaaaatacttttatttccgaaaagacattttcttcttttcttattttgtgacctgaactgtaaaaatgtgcattagaatcatcaaaatcatgttttcaacttttatccaaatataaccgtaaatttttgtctaacgaatttataaactaggcaaataaatgaaaaattatctattacttgacatttttttaatgcaaggtatcgcatattagagttagcacttaatctcttagggtgtgtttgatataatttatgagaatcataattcttaaaaataagaaaaatatgtttgattgagattcttttttatataatatttatatatatttcttaagagcaaaagattttcacgttaatttttaatagaaatttataaactttaattatttatcacgatataataaaaataatatgatatttttatcacaataattattttttcagcataggaaacttagggtctgtttgtttttattattttttgttttcattttcaatgaaaataaaaaataattgaaaaaatatgtttggttagatgttttcattttcaattttagaaaacaaattcagtattttagaaaattccgaaaacgaaaaaaattcattttctgcattttcactaatcatgcatgacactcatgaaattttttagatcttcttttcatttgcatcatactttctttctcttggaacctagtaacagtcaacaataacatgaccgtgcactcaaaacttgcaatctctcccatctagtgaatgccattggataaattttctaagtaatgagtggaaaacaattattgaagaaaatcagaaaatgaaaatgaaaaccaacaaacatatttttctaaatgatgaaaatttgaaaatgaaaataattttcataaaataaaaaagaaaataaaaaaagaaaatattttctcaaaccaaacatacccttaattttctaactttcccatgaaaataattttatggaaaacctgtgtagaaacatcattggaaaacaatgtttattgaaaatgttattttttaaatagtaaaccaaacacaaaaattaaacatctccaagttcaaattcttagaaatttttaaaaaattcttatagcaaatgtgctcttaaaagtttcatataaatccaatcaatataactcaattaacaacaagaggaggatttatattcaattttcacattatatacatcttggaaataatgaattttaagtgtgactaaatccttcatctaggattagtcctataattgactcaaaaaatcaaaacttgtaaaaatatatcagatccaattgagaaataaaaagttctaattactatattaaaaaatattcatttaagaaattatatctcaaacaaataatattcatacaaatggacttgagattggaatccttatccacttgacatgttaaatacactagtacatacattcagtgttgtgaaattcgatccgatcaggtcggttggacatgttggaccaagatccggtggtctaaccggaccgatttcattattggattgattatgtagttgatctggtcaaactcgatcagttagtttattgatcttggttgaatcggttcgacctgactaattttacaattttttatataaaaattttgattttttaaaaaaaatcgaattttgaaatataaatgaatttttcttactcaaataatgttagttatatatttatataatatatataattttgaatgtttaatatgttcctgatcaaattggatcaattattaatccaccgattaaattactgattcattatttcaagtcaataatcaaatcagatttcacaactatacatcaagtgtgatggacaataaacacgtggctttgcttggcattccattgttgcccttcctttttgttctggtttcggcatttgggttttcaattatttttcagcctcgcgtgtgacttccgaacggaaaaacagcacatgagcccccttacttaggaatatagagaaagaacagagaaagtgagaaaataaaaaataaaaaataatgaaaaagaaacacatgaccaataatgatgagatatatattagggacaacacacaacttaagcacagaaaggcaaacaaatacgcataaccagagagagaaagaaatagaagaaaagaaaagaagcagagtggtaaacaaagagaaacaaaacccagaatctagagagcaataacggctctagctttgtgaatagcataccatagcaacaacaacaacaacacacagaacacacaaagaaaaagtacttcccccaaaaccatatattatattattatatgtacatatagatatacatattcatatttttgtgtatattgagatgagattgttgttctctctttcttctgtttattcatgagagagagagagagagatcttgtcctcctactatggtcgctttgtagcagattaggtgatcttatgcaacaaatttcacttgggctctccttcatcaatcgatgtttcacttttttttcccgtcaacgcttcgaatcagagcttcttttcccccttttgatcgatacccattattgcttaggtttcaaaaagtgtttgattctctttatcctcttcaattttgctgctttatgctctctcttttttgggtgtttaatcaacaaaattttcggaattgggattagggttttcattctttgtgggtattttccgggtatgtgtactcagcttgtttgtgttttttttagggtttcattggatcgtaaccggggggcacttgtccaaattgcaaatttcctgagtgattagggttttgatcggagggtgtgattgaaaggaagactgtgcttgttcattctctgcgtggggttgcgtgaaatgggcatggtctgtggtcttttcaggggttcatattttggatttagagttacggtggttgagcatttgcacttggagattgcttaagatggtgtttaacattgcttctttgaacatggaagaagattgtctatattaataacagtgaatcagtgatcaggatttggataaccgtttctggacacactacaaaaagctgggccttctgggtcttcatttttggtgtttttcttctctgtctttttgtctttgttgggggatcattttggtttagggatttgacacaaagaaaaagctgttgattcttagttggctcacaaggaaactagagtatctgatttcagtggtcctttttagtttctgaagcagccctttgaattgatataattagtctgagcttaacactagtgtaggaaacatatactgattggaattgtgttgaaccatttgccgactttaagtagttagaacaagtggttgctgtgctgtgcgttgattttgcatcagtttttagtagtatagtttgagctgtttgaatattttggtgaagggtagtaaaccttggtggtttccacaatttgtgtttgtagtaagaggcttatggaggaatattaaagctggaaatgaatgcagtgacatggtgcatggacaggagcatagttgctggttcgttccctttctggaacagggctactggaaactaattcaagcactctcaaatttagaagaattttacactaggcgtatttggattttgtgcaatgtcgcgctgttttccatttccaccaccaggatatagaaagaaggctataacagatgaagtggacttattaaaaaaggttaatacacttttcctacactcacattgtacatataatttgacatagatttaactgtgatgcaaaatggagttttttgtgaattgcataacgttaaatgtatattgatagacgtcattttctgaatggaacatataaagtgctgaattcattcatgtttgaattaattttgtactccttaatttttcatctgtttcttcttaataatataaattcaatttgtttgaagttcattgtaaaattcttgcttgaaacattttaatcggcatcttttgaactatcacaagtcatgaaagtatcagatattattctgtatgggtgcaattgaagatgattggaggcttacatatttacattacagtatctgttttggcctacagttattagtaggggttctgcactttgttgatggaagttggttcacttgatttgctggagtttatctgtcttatatgtctataagatgttaggtttcctgtggtgtgtccaaaattttgatttttggactgttatgatatgtactcctgaatatataagtttcaagaggattgagtggagaaataatgtcattactggtgtgatcagtgttatcaatggcagatggtgggaggccataattccgccatataaacacgccattgtgccttatggtctgccatggcgggcgtcccttcacaaattgaatatggcagttggcaaaaaatctgccacgccatttctccatggccgctatttaacaacactgctggtgatgaggaagggatattatgatgattaaaagtgtatatgctctgcttgttctatgcctgttgttggcaatattatttttttacgagtccttttgttgtaaaatgatgaactttgtgcttgatggtatgccttggcaccttaggtattgaagcaaaaagttagtattagtagagattgtccatttatatttgggttttggagattcttctaatattcgttgtaatacttactgattttttttttttggaagcaacatctttgaatatccttgatcttgtcagtcatagaacaaagcatttcacctcatctaaaatggatttagagtaaggttataggaattataatcatttttggggttcaaattgacttaagcaagttgtgggaaattgctagttctatgtctttgttgaaataatagctgtgaagaataaggacagtccagggttaaatatattatgcttgtatactcaatgggaatcagatgcatactcttaagttaattacactggtgaaaattggttctagatattcttggcccaacccaaccaattgattttacacaagtgggactgactcgactgagaagatgaagaccaagaattcacattgatttgattgtaaatagttgggtgtatggttttgtataaataattctgactattttagtttcttgttttggcttttctacctgaacatactttgttgtgattaccaaggaaaatttaagtaaaaccattacaaaataccatgatctaaaaatagccttggcaaaagctgggtttttgacgtagtacaatggcatggtttgattcttgtagcagattccaactattgggaaaaggcttttgtggttgtattcttcttagatgatcttataggaaattttgagggtttgatatatctaaaatatattaactgtttaatctctggtttattggctaccatgacttcttgaatcaaacatgagttttgttcccctttttttgagctcctttatactgtttttattcaaatcttttgttttaagctgtctatctgcacaattcagtagacttctcattctttctgttcaaagaagaaagagaaaaagggaaaaaatattctattactcaacattagtttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactgtttttattcaaatcttttgttttaagctgtctatctgcacaattcagtagacttctaattctttctgttcaaagaagaaagagaaaaaggaaaaaaatattctattactcaatgttagttttttttaattattattattttttttatttttttgccttttttctcctgtgattttaatggattttactcaatcatgaaccatttattgaatggtagcagattttccgctataagttcagtgaaattgtgctagtttattttccccaaacatgtaaaagtgttcaagtttattttgtggtgaaactagaggttgctacaatgtggtgatcaaggtgggagattttgtataatgttcttgtataaattcttctggttacatcaatttatgtgccccttgagttcgtgttatgtttaccttgattagattaataagttatatattttcagggccaactatgatttgctaatgaaataatcatataataagttatggatggcaatcaactacttcaggttgattttatattagaaagaaatgaactaattaatgttttgtcaagtatatgcattaaattctcaatttgactagcaatgatgctagtcaactctttcccttgtatcattcttcttgttaggtgacattcaaaattgttagtgtagcttttctttttggttgatatggtgtatgtttttaccatgtcataacattattgattatcctgtcttgtcaattcaggatcatagttttttatagtgagctagctacagtgctctcaagatacttcttctctactattgtattgcaagttttatgaagtggtactatataaaaagacaatgggtaccctaaaatttctgattgtgtattgatgtgatccccccttctcccttctccccttgtccccttttttatttttttgtctgtgatgcttctctgtgttcagcagcgacctctgggcctcttcatgggtagtgactgtctctttggtccatgctttttctcctgttcccccataatgcctctcttttccttgctggactggacttccaccaacccattgatatttgactatctagagagactggctagtggccatatctctttttctgataattttttatttgtttctttctattagaccatttctttgtttcaacttttaattggattccgttaccagtagcatctcttatagatagctgagctttcctataagatggaatttggaatttgaaaattttgaggagaaagagaaaataataaagcaacatctgttatgttggataaggatgtttgagtatagaggttgaagttatgtagatcagctagatttattgcattggatgattcattaaagggagtacattatgcagtagatttacttttgtggagcaggctgttagcttatatttttagttgatgggagttttaagtatgattaagcctttaaggtgttgcgtgataggaactaacttgaactacataatatgaattgcatgataataattactgcatgactaaggtattgcatgataataattactttagcattttggtttgataattggtcctctatttttctaatttttgtaatttcttcattttgttattgaaacctcaaccaaccaccattgtaaataggaagtttgtgaaaaaaaagtgaggaaaatccagggaagataatgtgggcagttttcaagttggtatgtgtacattgcagggacatttgtatgcattttgaaatagaatggattatggaggttaaagtgtttcactttttacaaatattttccttatcgttctaatatttggagaattgcaagtttctcctcatttacaaagaccaaacctgctatgctttgttcccattttgttcagatcctgtttcaatatcgatttaatgcttatataaaaatttttggtgataaaattgattgtttaatggatacaaaaagtggatttaatgaagttttaaacattttgcatgtgggagatcatgactgcatttagttgcaacccattccttatttaaatgattacatttcaatagttttatttagtctttcctattactttttctaaagtctctccttttactaagcattataattatttttgaatgcatggcttgtcccaagccaggataaaggaagagagttggtatcaggtgttgcgaatcgaccataaaaaaaatatctatttttatgagatgacccataatgatattttgttggagtgtacccttcatagtgacgcgttacatcggatcccgggtgtagcgaaaaatgtgctagagcccttgccgcaaggcaaggcgctgcatcggtcccgggatgcagtgataagtgagctagggtccttgtctcaaggcaaggcgtcaagtcttcaacccggatttggtgataagttggtcagggtcccaacatgcagatgggcgagggtggtaggtgaataccgcccaagggttatggatgcaattgggaagctgaaatataggaaccttaatgggtaaactgaaagagttagctgatgtttttgccagaaggaaagtgaatattgtttgcttgcaagaaattaagtgggttggagaaaaggccaagaaagtggatgacaccagtttcaagttgtggtacacaggtataaacaagagtcgaaatggtattgaaattatgatcgatagaagtttcagagataaagtcgttgacgtcaaaaggaaaggcaacaagattattctgattaagcttgtagtgggtgatttaattttaaatatcctcagtgtgtatgcaacccaaattggactgcaatcaaatgataagaactaattttgggaagacttgacggaggttttgagagggataccatgagaggagaaaattttcctaggagaagacctaaatggtcatgttggtaaaagaagtggaggttttgactatgggacaagaagtgagactgaagaagatatcttgaacgttgcactagcctacaatttgatgcttgcgacaccttccaaaaaaaggagtctcattttatcacctatcatagtaaccaaaattgtagccaaattgatttctttatggttagacgataagatagaaattcttgtatcgactacaaggtctacactgtagactgtgccgctaggcaacataagctgatagttctagaggttcggttcaataaagtacttaatatgaggaagatggttcaaaccccaaagataagatggtggaagctaaaggaggaaaaacaaatagagttcaagaaaaacatgttgtgtgaaggactgtaggagcctatggggggagcaaatgaaatatgaaataagatggttaaatgtatccaaaatgtgggaaggaaggtgacgggagaagcaaaggaaacaaatttcttacaaaggaaacatggtggtggaatggagaggtgcaggagacaattaaacagaaaaaggaatgctttagatctttgcataaaagttccaatgatgagaacttgcaaaggtttagattagcgaggaaaaatgcaaagaaagcagtgtgggaagttagaggcaaggtttttgccgatttgtataaaaatcttgggagcaagaatggtgaaaaagttatatacaaacttgcaaaaatgagggataagaagagtaaagacctcacaaattagatgcattaaggatgaaaatcaaaattttttggtaacagatgaagatgtaaatggaatatggatgaactattttaacaaactttttaatgtggatgacaataaaagtgaggtggatttggatgacgcttatgatgatctgaatagaagatttgtgcataaaattaatacatatgaagttaacaagactttaaagagaatgaaaaataataaagctttgagatctgatgacgtcctgaagtgtggagaggcctgggggatgtggcaataaaatggctaaccaatctatttaataagttcttcaaacaaataagattctatctgatgcttggaggaaaattatgcttgtgtctatttataaaaataaggaagattattcataattgttctaattataaagacattaagtttatgagtcatatatgaagttgtgggagagagttattgaacatcacttgaggagagagaccaaggtttttgtaaattaattttgatttatgtcaggaagatgtaccataaaagttattttcttgatgcaacaattaatggaaagatatcgagaaaagaagaaagacttacatatagtgtttatagatcttgagaaagcatatggtagagtctcaataaaagttttatgtgggctcgagaagaaaaaagtactgttaaaatatgtaaatgcaattaaggatatatatgatggggctatcatgtgtgtgaaagcttgtactgaaatttaaagttattttcttatcacggtaggtgtacaccaaggttcgacttttagtccttatctctttttcttagtgatgaatgaactaacaaaatatattcaagagaaagtgtcgtggtgtatgctttttgcagatgatattgtgcttactgatgagatctaagatggtgttaatagaaaacttgaattgtggagaaacactttagagtctaaaggactcacgttaagctggaccaagactgagtatatgaaatgtgagttttcactggtaagagatgatgatcaagatccctgcatctacttggtcaagaggtatccaagaaagatgtttttagatacttgagatcaattttgcacaaaggtggagagattgatgaggatgtaaatcataaaattagagcatggtagatgaaatggcggagtgcatctgagttattgtgtaaaatttcctttatgctaaaaggaaaattctatagaacaactatatgactgacaatgttatatagaactgaatgttggccagcatataggcaacatgaacataaaataaggatagcagaaatgaggatattaaggtgaatgtgtggttatacgaagatggataagataagaaatgaagatattcgacgaaaggtaacagtagtattggtgagtgaaaagatgaatgaacatagattgagacacataatgagacgcccttggatgctcctgtaagaacagaagtttgttaccaagagctcgacgcaaagagaggtagaggtagattgtaacttatctagaaaaaggtagttaaacaagatttaatgaaatgtgatatagattggcgaacggtgtgtcttaggaaaaatggagaaaagttataagcttggtggagggttagatccgttgttatctctatgttctagattatccctttttagtcctttgttcttcatctcccctttccttcttttccccttctttacttttaccgtctttgttttttcaaccttctcgtatttattattgggttcatctaccatcgatcccaattaatttggattaaaggtgcttttgatgttgatgttgattagcagtttgttgctaatattaagttcatcaaatccaccatgtaggggttggcctctagagcatattcttgaatcatgtcaatgtttttaaaatcaaattggaggttgagctactgagacctggtgtagattaataagcctagagtactctgtgtagagtgatgagccggggtttaactcctttaaagtgaggtgtaaaatgagaaagttaatgtgtatccactcttgatttgaattatccatttcaaatcaagggtggacagactcttgctttctctctttagaggagtcatcagagtacttctaagtccttactagaatttcatatgttctagtgacaggaagtgtctatattacaatgatgcataaggtcaaaataacgttaagtcaactaaagggcacttataaccaaagataataaaaatcttagatgaattataatttctaagaaaataaactttaattaagtataaaatcttattaataaggttttgaaagtgtttgaattacagacatagttggttcatggtcagatcagttcaagtgatcaatcccgtctgtttattcaaacatttcatgacactgcattgtaatgggtgttcaaaaactaaatggggataatttcacacaagaggaagatcctagagtctcatctgttttgctttggatgctcctctacaaggagtatcctaatggagctcagtatagttatgactttggtcctgtttggtatactattgtattgactatgatgtattggattacttcttgttaattagaagatcaaaagcagtggctttgttgtttgttctttgccttcattttttttcaggaataaaatgatcaaggtttgttctattttgcattcattttgattcaactacaggaacatagaagggtattttccttggtatcattgaagtttcctggttgttcatctatgggttataactggacatgcatattttattttgtggagtttcttgtttctagtccttaataaaacatgtcagttgcacttttttgatctttttatttcaatgtgaggcgtagaatacagaacttccgttaaaagtgtcgtagcatatcttatttgtaatatgtgccaaaagccataaaagaaagaaaatagggatctgaatggccggcagtataagaatgaaattgtttctgttgggtttaaagaatctaatcattgggaatgtttaataaggcatcaaattgaattgctatacttttatttttgacttttatggatttgtcttttccctcttagtatggttatagttggctgaaatgtgctctcctagaatctagaatactttgtcggtagacaatgtgtattgatggactttgatcctgttgttattgttgcggcttcttccttggatatatatgattgccaaggagacaggagccttttttttcttttttgcatgttttactattgatattctttttttctctttggttgctcctgggtgaagagattttgaagccattttggtttattccttatttgattattattcttaaaatctcttctcaccatatgacttgcaggaaaagcagaaagaaaaaaaacataagaaagataagaaggacaaagagaagagggagagcaaggaaaagagagagaaagaaggaagagatggaaagcataaggaaaagaaggacaaaaaggaaaaacacagagagaaaaagaaagataaggataaagacaaggacaagagcaaagatagagataaaagtaaaagcagttctgctgatgacaaagggttcccaagacaagctgagggtctcaacggaggtaaaccccatcaaaaggaaattaagcaagatgataagaagggtatcttgtttgagaacagtctcaccaaccagtatgctggtaacaatggggagaaggcaagagagaaaaatcatctggctgaagagagcaaggattcaaagttcctcctggagttggaccggaggattagggatgatgatggaggagctgacaatcaatgggttcataaatttaccaatacaaaccatagaaaagatgaggggactgttaggttggtggctaaaggtccaggtggcacaaggtctgatggtaatgaaaaactcaaggatatgggtcttcatgttaagaagattgatgggcgaggaatacaggatgaggtccggccaattggaaatgcaccaccagttcagaatcatgttggaaattttcatcctggagttggtggaatacccaaacttttgggaaagtattttgaaaggaatatggaagcaactgttgaaggtaaagaaaaggttaaggaaaagaaagatgaaaaagaaaaggccaaggaaaagacagaagaaaggaaggttaaggaaaagaaagatgaaggaaagaaaaaggttaaagaaaaaaaagatgataaacgaagagataaaaggaaagatagagagaaggagaagaaagggcatgggaaggacaaagacagggacaaagagaagaaaaaggaggagaaagctaaggagcatagtgaacttaaaacaacagagcaaaataaattaaaagaaagcaacaaagttggacttataaattcaaattctttcacacagccttttaggaacagccatgggaacgctgtcagtggagaaaatctcaagaagcggaaggacattgagtcaaatggagttccacatggtgagtgttacttatgatgagtcttgttctcatttctactcaatgatcctgttaagttgtatttaaaaaagaataagatgtttctcttactggatttggactagtatattgctgacctaataagctaataccagatactacgtcctgtgagataacggtgggttttccctgatgtcacatgcttatattgatatttcaattattggtatttttcagtcatattgacaagttttctcaagtttgtacgcatttttttgctgttgaatagacaggttataattttttttttttaattttgttacagtcaatgacagtttgcccaaaaagtttccgaaatcgtcttcctctcatccactcactgaaaacggaagggtattggaaccttgccaagtttccattccaaatgcttcagataggccacgagaagccaccagtgttaaggtagtaaagaaagaaagcaagatgaatggcatcattgaaagtcagccatttgcagcttcttcaaacaagactcacactgccaatgtgccagctgatttggtaactgaagcaactgcaaagccaccacatccagataccaagtacctaggccaggtatattcagtacctaaggtggagcagtggtctgattttgacgatcaagcgtggctatttggcagcaatgtttcgcaagaaagaaaatctgtggtgaaatcttcagaggttggggagacacctcaggtatgggcagaagctctgcacatagagccagcagatgtttttgctcttccatatgtcattccgtactgattgattatttaattgtcacacgatgctcttcaaacaattatgatgtgtgcacaaggaaccctcctttgacactccgtgtgggaggaactgaagcatggaccggaaaatgtttccaaatttcttgatgcattcttttgttgcttgcacactggcagcaaataatgagtgactcattggttgccttgatcttaaactgtttggatggtgactcgtgctgcaactgattgtcttgattttttactgattggaaagggaacatctgtcacaagttgcatgcttggtactgccagattgggggtgcagctctcaccttgtgcatcatagtaattcatttagacaacagagaatttgtacaggttgtggagagggggaggggagaggtacaagattttgcaacttgtttttctttttttgctgagagctgagctgctctttttaattgagaatgagaatttgcaagtgaatgtggtctttgcaactccaccacaattttgatttgtaacatagaactctgattttacgagaatatgtatgatagagaaggggaaaaagaagtaatcggattcatttattcagtttcctgtaaattttattggtcattgaatcattttgctttagtgttaatgattattgaatggaattatatcgtaggggataatataacaagatggttttaaattgagtaggaggggtatggatggtttgaatctttttaatagatggtggggttcactcgtgtaaatcaaagatgtgaaaggtgactttcgttttgtaaatttgctttgaatatttttctttttaaaccacttgcaaaatatcgtctcaaatgactttaacagcttttcttattaaccatatttcattaaggagaagacaagtcaatgctatcccagtgtcgtccaagggatattgcaactaagtggtaccgtttatggtctttctgggttgttgcattagatttccaacattttttttacggtggggccgtgggggtggaggttcataactgtgggtcagttacaaagtccatctatgcattaaattatcgaacatgtcatagttaaggaggaatctaaccttgtgattgcatgccaattttgatgctaggattcagcatcaaaaagaagttataagttattgactaccgagtctttttcaatgttcagctaagtttctatcacaccagagaaatcaaaataacaccaccacctgagcccaaaatatctatgcaaaacgttgagaacaattgactaatcctaaaatatacttaacggatgtttcattttatttatatttattttttgtatgtaacactttagctgaaagcaatatcgccttgctttgtgagacacaaacctggtagagagggtatggttccatatcctaagttaattatgctacattatttatttatttattttttaaaaatctaagctttcaacaaaattaaaatagtggagcctacaacaattatacagagggacctgctacgtacgtacacactcagaattttgaacctaaatattatataagtgtagataacatagtaaaccccaatttgatttgaatcaatttttatgcaaaaagttgctgataatgtttttttatctaattaaattataaaagtgaattacggtttaatttgaataaatgatttggtttttatatttttatttctaaaacattcagttaatatttaataagtttacaagtacattgtaatcattataacattgataccgtaataagacattcaagtcagcaaaaaataaaacgataatggagataatgaaattataaagaaaataaataaattgataatggaattttataaaattttatttatacaactaaggtcctagttagttttataaatgaaactctttatgtttggttgtgggaattttttttgtcttaaccttttgattcattataaaaatgaactttaattaatttaaaatttggtaggaagataactaaaatctaatcaaaatttatttttgtcaatgattaaacttacatattacccaaataattcaatcttaatttcagtacattaatcatttaagtccaatcatttggttgattgtgtggtttaacattgcttttaaaaaaaactctatggtattatagtaacttatcattagtaagtcccatgtttaggtaagagagaaaggtggtgtactggtgttacaccttcaagtcttccacaaacaaggtaaagtttattgatatatcaaactatgtataagtacggtttgatttggttttaattgtttttcaaaattggattcaaaattcagcctaactaatgaaaactttacttttttagtcaacttgtttaattttttgtaatctgttatgatttaggattttcttcatctcaaaaaancctgttatctaggatagtgaaattgttgtttaagatctgtttccgtatttttagttgtagatgtttcttatcttccgtttatttcttttttatattctgacattatctctgcacaaatttcgcagttccctccaattgttaaacattaatttttgtatcagtatcaaccaccaattgtgttttttaatccttccaataaaggaccggttttcaaaactatggtatcagcctctaaatgtgtttttttttttcttccaacaacagatcggtcttcaaaactatggtatcagcctccaattatatatttttttttctcccaacaattgttaaacatacctctttcccattttctgttagtaattttacataaatatcatttcccccttttcttactcttttaacccattcaaatattctacacttctgcttctttctttcagttctttacctttcatattctttgacaatgcctttgtttttctttcctcttctctgacgacttttgcaataaaaaattacaaatgtattccttttataatgttttgtatatgtgtctaatcccaaaataataaggacaaattcatagttgaaacaacagtatcgaacaaaaaaaaatatggccttaccacaaacaccaaaggataatctctggcagccactttaataatttaatttctaaacttagtagaaacgaacatgattcaaacagaacatgaaatatctttctatataatataacctttcatattaagaatatgagctttcaatgtgttcttttacagctaaggggtagtttgtgctaaccgaataaatagcattgttggaagaggatgactcaagcgatcgaaggcatagagaaagaaaataaagtaatagccagaaaatggactaggaatgaagaggtagtatttgtaaggagaagccaaaggaagaaagaaggtgagatatatttgaaaagagggagaaaagtagaaaaaaaatgtatataagcaaagttattaaaaaaaaaaaaggaggagggatacatttagcaacaataagatggatacatttaacaattactttacttttccaatggctatctgagttttttctttctttcttcatcatcatgggaatcctcatttcttgacctgatgctttctagagataaaacattgaacaacatgtttatgactaaaacttcctatactcattattgtttccagctgtgtcccattgcattttgtaaagctcaatctgaaatgaaccaacatcccatgtttatcatattagttttgggctttggcccagtatagctatgttcagcttccgtcgttgttttcgttgattaaggagggccaagcctagaactaaaaacccgaggaaagattacaaagctaatgaactgaataaaaaaaaatcattcttttgtcaaccgagaatctttatgacgaaaaagacatgaacattaatttttttttctcagccgacatgaactttatgataaattatctagtcattatatcttacccaaaaaaagttttagtatttatatgaaaatgtttttttcgtaaatatttttttagtaatttgtcaccgtcagaaagtttttataacaattttatatcactttaaaattaaagtattctccaatgttaacgacaggaaacatagaagcaaaactaaaattttatgcatttgtaggaactaaaaaatcacaatttttttttatgagaacaaacttaaaatgataacagttcagtgatcaagtgaatagtttacgcttatggccaaaactatgatagaaggagaaaatttaattaggaggctaaaaagaaagttatttcatggataaaatttaaaacaattatacatagtaatattttaaaaaaataattaaggacatggtttggtcccttacaagtaacaatgaatgacgtcccattccatggttagaagatagtacatgggcacctccaatgctagaagcttatatggatttcttattgagttttggtgaaactctcttgaaatactgcattggagatggtcttatatatctatcatggttatgttgtcagatacaacatgccacttggctagaaagtctgatgcagaacacaaaagtggtgatgaagtcttcagtgttcattattcagtctgaaatgatggtatatataaaatccgataaaagaaaagtttatttaaatttagtttttatacactatttatatttactagttaattaaaaattactttcaaattaatttttaaaatgactattacaaagttaactatcttacaatacataagatttcattgttaaataatggtataaaatatttgttttatttatatgtatgctaatatgtattaatctttcacagtgcatataaattttttgactagttagtgtttggtagtattttttaacacagtttttaaacacattattttaattttttaaaatttattgaaaattataaaatttgttaacaaatcttaataaaaattatttttattcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcaaattaatttttaaaatgactattacaaagttaactatcttacaatacataagatttaattgttaaataatggtataaaatatttgttttatttatatgtatgcttatataacctttcacagtgtatataaattttttgactagttagtgtttggtagtattttttaacacacgtttttaaacacattatttttaatttattagaacttattgaaaattataaaatttgttaacaaatcttaataaaaattatttttattcttaaagcaataaaattttctttcttatacattagaatttaaaaatgctcatccatatcatatgtaattttttttttttttgaatgtatatagttttaattacggactcaaactttcagcaaattaagttggtcactaagatataaaataatagatacataattgataatgtatttaatagagagtatattggatcttgccttgcatattatttattcatatcttttattaacggaatttagtttagttaatttaataaagtgcgtaaattattataaactttttagaatttgattttaatttcaacggaaaaaaatcataaaaaattatgagggatgaaaccttttgtctgtttttttgtttaaaaaaaagaccaagaataaaatcagtaaaacacaatctaaaggatagtttacacagtagaatcttgaatataaatagtactaatgtagttgtcatgtgaagtagaaccaatgctataaattctgctagtaatcttgaatatatatagttagacaagtgacagcgcagctgcatgcatgcaccaccaaagcacatgttcaaagttaaaacaaccttcccgtctcgccctattaattataccctcagacctaatagtctaagagcatctttagtggtagatttcaaattggaatcttagatcactttttggtagatcccatagtgtcatgtaggattgaagatctctcaagatccctcctattttattttttaatggtagatcttattttgagttcttagggagagagaaagaggaaaaaaatttatttttttttgaacaatgtgcagatcttaagggttcttctacaagaactcattctccatgttggagatttctctacctcctttattgggagatctagtaaagaccagatcttgagctcaagatccttactcaagatcttgcactaaagttgctctaatacgcttcttgtgtaacttttttttatcaatgaatatataaataataaaaatctcttattttttatattaaatataaacaaatttcaattcttatgttttatttaatgagactcttttaatatttgtagtggttagtggttacctatgcaatcacacgttaaattgtttgagtgatttttgtcctgtaacttattaatgaaaaaataatgaacattatgattattggacagggtcaaacgactcaaatcaaacaaaatacaaaatactgaaattttaagaaaaaataaataaactaatgtctctctctctatgaatgactcgaattgataagaaggagaagaaaaaaaaagtataaatgaattgacatcataattattgaaggatcaaatcaagagaatttttatggtgcctcaagaattgtgagggttttggtattgttatttttttaaccaacgaaattatcatgtcatacatcttctcattaattaaagatttttttgtttttttcaaattagtttttaaaatcaaaattaaaactattttaaattttaaaaatttgattaaacataagtttaaaatatgaatcctaatctctttcaccaatattaatacagaatcacaattttatttttcttgaggtaatagttactctaatttatatttaatcaaatttttaattaaaataattgtaattttatattttaaataatcaagaactaatttgaaaaaaataaaaaattatttaattaataagacgacaaataacataataattttatcggttaaaaaaacaaacagtgtcaaaactctcataattttttgggaaccgtagaaactctctcaaattaaacaaaagccgaaatattgaaactaaaaaagattgaagccatgtgtctctcactatgaatgacgcaccatgcatgcatgaaaaggagaaggaaaaaaaaagtagaaaatgatttgtgtgagttttacaatttaaagaaaaatcaaataggtaaaaattaaagacatataatttttattgaagaaagtaagggggtgaaaaagactatggaaaattattttactttgataaataatttttttaatctattatataagaatagttgcagtatattataagtatttaatttaataataaatatcaatttttcattggagaaagcaaatgaaccaacatggtgagttgggaccattcagatttgagggtcgatctccatatatgacaacagaattgggataagtgtgtgatttcagataaatttcttctgacagtagaatacacggcttgtttagattacaccaaaaaagtgatatatatcaccattctagttaattatagattacagagaaactcctagctagaaagcttctgtcttattgaacatgcactatattataaaatataaatagaagagagtatcaggggtaccccacccatattacaccactgtgtgtattttgcctgctgttgagctgttccactactcccctatttataatgtctcctttgctgctatttatagtttatttaccccaacacgtggatcatttatttatagccttctagtgggtcatttatgtatcactcttaagtcttaactacatttttatgctaaagagtaagaaactctccttactctttttttattatagaaattctccttaattactttcaatagtacaaagttaagaatcccttatttatttagtataaggtatgttcggataactttttccaaaaaatacttttagaagaaaaataaaataaaataagttttcataaattaaaaatcacgttttagaaaaactcatgttttttttacaaattagttcgtgcataagttaattttagtttatgtaaaatatattacttttatttttttaaagtgtttttagagaagtaaatgaatatatccaaaattctaaatagacgtattttcttcttcgtttatatcccagaagttggttttggaaggctatttggttatttcctaatcatgtggtttggtgtatgaatgatgaagctgcaaacgtgtagccattagttaatagaagagttagctaagctatcataattaattatgacttagacatttatatataataactagctaagacacatatctaaccctgccggtactcttcctgtataatattctttgtttgctgataaataaaaaaataaaaaatctgaccctcctctagcggcttggaaaacgtttgtggggattctataacaaggttagcaaaacctggtttgctgagttaggttcatgtcattctccctgttagttgtagaagaatatttgtattatagaaaatgacttaaatgaatttttaatctttgaaaatatgtcattattttaaaatcttactgaattttttaatcttttttaggttttatatttaacaaaaaaagcgcattttcaccttgcaacatttgacacggaaaactttttttttatctcatgatcttggtttcatataatattaatattaaagaatatattaacttaattataggcctggaaactgacttagggaataatccgataactttactgggacactagctgaaattgaatatcattttcataagaagaagacggttctaaaatattactaataaaaaaagtaattgaagaaattaaatctgttctatattttccttttaagaatttaaataaacactaaaagggaaataaaaactaaaattaaaatattaggatctaatttcacttgattttgaattcggattcataaattaaacaactttttccttgcccttatccttgtttttcatatcccaatttcttattgatggtgaaattcccaaaattagttacaaccaaaatttatttggggaaaatttacctgaactttattaattaacaagcttatttctttaagtcaaattaacaaaatgagattgattatgaagttctatgaaatttaagcaaaggctaaataacaaagttatttatttctatacataacttcattcgtggcagcaaatgcaactatgcaagaagcgcgtagttatatatctcattattcttaacataaatgagtcaaaacatttaataaatggtgataaacattcataagtataaagcaattgatgctcaaatcagggaaatgcatgtttatagaaaaaactttaatcaaggttaaaacatttttaacatgaaaaacttgagttcaggagctttcatcataatattaattggcgaattgaagatctgattacaaagaagtggggatgatctatatgtcttttcttaaaaccaaaagcttttgctcctttgatgaattagtaacaacgaattcgtagaatggggaatcaagaaaaggatagggagggtaatgacctttccataatgggtagacccacccttgaattgaaccggtcagaagctctcaattgggagtttaactaggttcaggggaaagatgattgaggggaccaagagacttctctattctatggtggaaggtttattttgtatactgacaaattggattgagaggcgatgcttacttattcctactaaatgttgaagctaagaggataaagctaagagaattaactcatgggataaagtatgcccactacttatattgaagagaaattctgaatgtcatgtcaccgagagtaattaatccacgcccatgcttaatttcactgctatattctggcattatttttgtaagctaatttgtttgattaaaaagtgctggggaatgaagcaaaaagaatgctcagccaagcaccctatgagtgtacaaaattcattattgtgtgcattgaatcatgcttatcttacctaaacaacctaataaatatattgaaaatctaactataatgataaaacatactaataaaaactaaaaaataagaattaaaaaaaaaaacaccacaagcacaatataattaaataacaaaagtttagataaaactaattacaaaacttgaaaaagcatctttaaacctatttattacacgtaagatgaccaaaccttttaacttttttttggataagccaaattaaaatcaaagtcattgtaactgagcattcaaaacttttaacttgacagagacttcgatctatggacaaaaactaataagcatgtcctgcacaaagttattagttttaccttgagctcaatggacaaaatgaattgtctaggtgtcagctataaaccaataaaactacatcgaatttaagactttgatggcatattaacttagcaacccggatttagttatcaacatcaacatgaaatgtatgtaggactattatcttcacttcaactactttctctgacattatatattcatttctatcaataggcagttgacacctgtttaaattcgatgaaggttgatgaacatgaaagtgatcgatgcatgtgagatgagttggatacttgcatgttgcatcagtaacacgaacggcaaaaaggttggggaatggggacaatggaaataccttttcggctgatttagagccttgatattttattttgatccgaagatatttatttgcaagaatgggggagttgaaattcttgaattagcaaggttagatcccgaaattttgataaaatggagtattgacagcttgtaaatgcaaatatatatatatatatatatatatttttgttgacaaatactaacatggcttgttcaaaaataaaacaactaattaaatctcgagttttaggcttccagacagaaattttgtaattattattaacattttaaaagtaaaaaatatctaatatgttggttaaaaggtttcaaaattgaaaaaaaatatttgaattgttataaatctctcaaaacttcttccattcctatatataaacaaaaaaaagttccagatatcattttttaaaggaaaaaagatcgttctcaatttttatttttggtctcactttttattagatcaatcatatattagttgatagtttgctaatttttattcattaataaactcaaatccattacctccattctttattctttattcaattactaaatcaatcttataactcaatagatacaatatctataagaagtggtactttcatttttcattatatgcattatatcgtgtttattaattagttgcatcttttactttcctatatgtaaattttcacgtgtactttatttattccaattaattatcatatgttcattatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatacatgaaaagaaaaagagtaaaattaaaaaatattgacaaaagaaaataaattaataaatagaaggttgagtaaatgtatgctttttttttggtacaatgcttaatttcttttagtagtagatcgattttggttttaattttacacataaaactgataataaatattttttaaatatatttattaaataattatcaatgagaaattagatacttaaataaaagtataaaagttgaaccttcttttaatgtctttctggattcgttccggtgatatatggtacaaactacaaaggttggatatatcactttattttcacaaattaagcgtgtgcttgcaattaaattatacttatcgagtattaattacataaatttaaactcaaattaaattgaaatgatttgtaaaaagtgagggaaggcgcaggaaaggtcagtgttggtccaacatagattactagcttgcatgtttcattaataacataaagtttatagtttagcttaattataatttttattactaattttttagtttttaatttttttaattcgacacattttatcatcaatttataaaaaagttcaaaatttattcccaatcattaaattcgccaataannnnnnnnnnnnnnnnnnnnnnnnnnnnnnnnnnnnnnnnnnnnnnnnnnnnnnnnnnnnnnnnnnnnnnnnnnnnnnnnnnnnnnnttgttccaacaacctagatcattcccctaaaaaaacaacttagatatactttctttaaaaacaaaaaaactattttacaattgtttcattttttatacattaaattttaaaagttttattttgattttttatattttcaaaatgtatgattttgatactttttgtcaatttttctttagaaatattagagttatcttaacttttaaattttaaaataatttaatgttattttttatttattatatttcacatttgtttctcttttgtatattatgttttaaaaattttattataatattttatatttttaaaatgtatcattttttattcttttttcaattttttattagaaacttaatgtctatgagtattttaaattttagaatagttaaattaatataataacgactaaaaatcattattatttttttatttaaaaaattaaaaatcattaaataaattagaaaaatatagatatgaaactacggacaacaactatcacttttatattattattattattttattcatttaatttaatcatttaataacaataataatttcatttatcaattattttcaaaaatataacatttaatttgattattttaaaattttaaaaattaatagaacactaacatttctattaacattgaaaaaagaatcaaaacgatacgtttaaaaatataaaagatcaaaataaaacttttaaaatttaatatattaaaataaaataattataaaatataatgaatcaaaataaagaatacgcgtaattaatagtacctataaatgagtggagtggattgagataataaataacttgcattgtgattttttagatgaaacgtaagatcgaatgtcaaaaattagtaaatgattaaaaaaaaattatatgtattaatggaattcgttggccctccacatcgaagtacatcttgtgagcaaaataatggacattaattaattgtagttggcctcgccatgctttgggttgggcatgcatggtattgtgcattccgaaagcatgctcccccattctgaaagcatgttccccgttattcagccatactaattttgacactcaaacatgaaaactcactttaatcaagattgaggttggagttgagtttttttcttcaatttcttaaagtggatacaaccctctactcttccctccatatatttaaaatataataattatttaatagttaaataataaaataacaataataatttaataaaaaggtaaatttatatatttatttaaaatgtaatttaattgttaattttttttaaaaaaatagttattatttattgattatatatattatttgagttaaaatgtaattagtattttttatatatatattttttttaaaaaatatgtaagataggctatcattagatttcttgaatctgatgagaatgaaaactattcatgcgacaacacttgtttagtgtaagaaataagaacaataaatatggaccatatcatatgaatggtcaagattataagtagttgtccgattcccaagtaacaaagtcacgtacattttctttaaaccttgataatataaatatgatttagtagtctatatatacattactcgaatttaaagtgcgagtacacacctatcttacaggacaattcaatatgatatatgggcctaaaacagttttaaaaaaaaaacattattttaaataaaagttatatatcaggtttaaaatatacgaactgtatttgctttagttttcgatcaagtctgatgtcttatataaatgattaagcttaaataacataaattatgcacaattttaaaaaagttacataactcttttgagtaataatgagattttaaattttatccattcaaatatgattatatgaattagatgatttattttttcattcttacatggaaactcataatcacaatgtacatttgaaacattggtagtgtgataatttaaaaaaaaaatcattaggagtaaccaactaactggnaccaagctaataatataatttgggtagtaaataaaataatttaaaatttataatattgatttttaaaaaatcacagtttgagtgtttatatacttattccttctgaatttttgtaaatacttcctactaacatccaaaccgtacatagtctgagtcaagaagttgttgatatgagttatatattgattatcagaaaaatcgataaatattttatattaataatatggtatatatatatatatatatatatatatatataagttttagccggttcaaacgttattgaaagttgaaacacctaattcatagaaattattgaagttattttcttatttaggattataaatatcctttacgacagactataaatacgcagctgcaaagcgtaacaaaccaatgtggatgacatcgatctattttcctctataaatcggtgagatgtcaccactcaccagactataatattaattgccatgtgaatgtggggaacaatgtaaaattgatcgcattattagtaaatgagtccgggtataaaagggaaagcaagaatcgtaaaagaaattatatgagaatgtatttaacaatcaaagaaaacatgattttacgtattttattaaaaagcttccttcttttattttttttaatcagtgttcttaatgtttgtctaaaaaataatttattcattttttttatctatcttttaaggtttctatataaacacaaaatgtaataattttttttattcaaatgacattcgtgtggacttttctattatatcctcttcatttccattctataaataaatgcataagtgtaaaataattaaaaattaagtgaaaaataagagtataattgataaaataataattaacattatcttttttaaaaaaaataacagttagatagtaaccaatttttgtaaaagaactcaacaattaaaaagaaatagaagaatatccttaaaaaaatagaggaagtatacggaaaatgataacgaaaagtggaaagtttttaatcagaaatggaatattactacttctgaatcataataaatgttctgtaagagaaaaaaatcaaaataaatattgtggaagaatatattctttcaggatttctagtacaaatttaatatatatcttatttattaatttctttagcaagtatctttaagatatttactactctctctgtcctaaaataataatcattctagcttannnnnnnnnnaaataaataagagaataataattttataaaattaaatttatattatcaatataatttatttataaattttgttattcattaatattacaaaaaatataagtaaaaaaggtaattaatattacataaaaaaattaatatgacattattttgaatttttttcttacacaacaataataatgggatggagaaagtaataatattttacttcattcgtctttataatataagacacttataactaatttaaatatatatttaaaaagttagttaatttaagtgctaacattaaatttgtttgtaaatgtaattttatctaaaattactcttaaaaatatttggactaattatgttacttttttcagttaattactttttatctaaataattaatatatggagagaataataacagtgagtttcagtttttaaacctaatttcttcaactcttcaatcctcgcaagaaaaagaaaaaaagatgatttatagcatttattatttatggactaaaatagttaacagtattttaataaaaataattaatatgaagaaaatttaaaaaaaaaatagttttgtaaatgatcaataatgtttcaaaaaataatatttatatttggcatttccaaccgcttatttcgtacgacccaatgggaatgaaacgcatagtaagtttccattaaatctccaaccagccactccatggtccttcacttatgacaccactccatcactctatatatgctcgtaggcaaaaactcactttagtacaacaatcaaagcctcttttccagttttcccttgtgatctctctctctctctcttttgttaagcaaaaaaaaatcccaccaaccaaagagtttgctttcaatttctaggatcaagccaaaatggtcttagaagagtgtgtagtgcatgatgttaggctatcctcagttgggccaggccgggccaccgggtcagatgtgttccataaccctagtgggttggatttggctatgaagcttcactaccttagagtggtgtacttctttgataatgaagctgcacaagacctaaccatcatgaaaattaaagatggcatgttcactttgttcaaccattacttcatcacatgtggccggtttcggcgatcggattcaggtaggcccttaatcaagtgcaatgattgtggagcaagattcattgaggccaagtgcaacaaaaccctagatgagtggctagccatgaaggattggcccttgtacaagttgctcgtctctcaccaagtcattggcccagaattatctttttctcctcctgttttgttgcaggtgcttaataatttccctatagatactatactaatttatatattatgcatcactcgtgacacacacttattagttattattcattttttatgtatgacaaaacctagtactactttcataggaattttttagtgtttttttaatcatgaaatggaatatttcatttctataattttcacactcgaaatcaaaatacaaccaattcaaactaatggagataaaaggttttttaattgttaatatttaactgatgaataaagttaaaggaaaatagacaccgaaaggccacaatgaaattagaggaagattttcttattaatctttatatttcttttgaatgttgagtattggttattccacatccgatgtgttgcaattaacaaaaaaattatttcaaaataagtattgtatttgactttttaatgtaacattaattctctttttcatcaagagaaatgttagtgacgttatttttaatactctctttttcaacactttttagttattggttgaaacnnnnnnnnnnnnnnnnnnnnnnnnnnnnnnnnnnnnnnnnaagttttgatggatctcacttatcatttaatgactctcttttataatttagatataaaatttatcaaaattgataattttaaaaaataattaatcacaaagagagtgttagaaagagaatgactttccaccaataactctaataaatatcactttaattttttgaaagactattattttccttcatttatttattatttttgtaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctttaatggtagatctcaatttgagatcttagggagagaaaaagagagagaaaatttattcttttttaaacaatacacagattttgaaaatttttgtataagaacttattctccatgttggagatctcttcatttcttttattgggagatctagtgaagatcaaatcttgaattcaagatctttgctcaagatataacattaaagatgctctaagaatgtgtttatttcaggaaatgatgttttatcacattttcatattaatgtgtttgtctaatattactaaaaatattactaaaattttaaattaaaataaaaaataagagttgaaatggaagttataattgggcaagaacatgtatagcttcctacaaccccatagaaatataactatttcacctcttatcacatgaatagaaatgaattaaatgnnnnnnnnnnnnnnnnnnnnnnnnnnnnnnnnnnnnnnnnnnnnnnnnnnnnnnnnnnnnnnnnnnnnnnnnnnnataaaattataaaaaaaggaaaaaacattcattatttgtacaaatacattttttatattgattgaaaaatatattaaaaataagtatgttaaaaggaaaagaaataggagaaaaatgaagttgtagacttatagtgtccaactacatgatagaaaaataaaatagtagaaacaaaaatataaaattataattaaaccgactttaaaatcgtttaaaattaatcacaattttaaagtggtgaaaaatttattatataaatatttttaaaaaataaagtcgttgaattttttatgatttcattattaaaaaaaaatcaaaatcataatttttttaagactttatactcaaaaatcgtaaaaattcttattacttactttttatttaagaattaattaaagaatactttcatttgattcataatgaagttattttctcttggtgaaaaccccctctttatcgtgtcctggtttggttgaaatagtgacctgttaattagtcgcaatgtttttctggtagagatgttaataccatcctatcttcataagttgcccttacattaattcagaacgcagtatagtatggtatggtggacaattcctttcataagagggataaggtagatcctaactattcaacnnnnnnnnnnnnnnnnnnnnnnnnnnnnnnnnnnnnnnnnnnnnnnnnattacttgttttttatatataaataattccgaggtaatattttgatttttagtaatgtttaatcttcttataaattttttaacatttaataaataaatattatatgaaaaaataaatacaattaatgtcttataaataaaagcatttaatatttaatactacctactacatagagtaacaaagtggatattgtaggagtatttaaacctatctttaaatcttatcatacacatatttttggtatacaatgaagttttaatttactnnnnnnnnnnnnnnnnnnnnnnnnnnnnnnnnnnctctttctatatagatacgccgatattgatcagaatcgagtttatcaggctcatatttttggtatacaatgaagtttatcattaacacgttttttttaaggaatcattaacacgtttaaattcgataaagactgttttcctggggacatttaatataattttacatattatatacaacaaattgtcgaattaaacacaagtcatcaaaaataataatacggtaaaattattattgtttttattttttaatgcttaatacacgaacaagggaatgaaaagttcagaaagatgttttcctaatttgcataataaaaaaatgttttttaaaaaattaattaagagagatgtcgtcttaggtgagaggagtaatttttaatcattaaatataatcgaaaattatttaaaagacaattacattaatatcattgatgtcttatctccatttttaaaatgttccatccttactacaataatagtaaaagaagcaaaattttacataagaaaattagaagcaaaaatttgaaaatctcatttagataaaagagtataaatacgtttaatgtttctttttacttggtaaagacgaaatataaaaaaaaaaatctgaaaatttatttctagatggttattccttctatcactgtaaatcatacaacttggcttttgcaggtaactcaattttcgtttgatcaatatgcaggtaactaaatttaagtgcggtggaatttcattgggtcttagttgggcccatgtattgggggacccgctttcggcttcaggattcattaactcatggggcctaataatgaaaaatggcctaacaaagctttttaacatcccaagatccgtcccaacactcagacaacccgagccggaaaaggatccagtttcagcaaaacggtttgacccggtgggggatcattggatcccagccaacaacaaaaaaatggacacattctccttccacctaactagctcccggttgaactacttgcaagcacgaatttggggtccaagtcttgaccaaactcctccttttgaatccctatgtgccatgatttggcattgcgtggctcgggttcgatcaggatctgaacttaaaaccgtgaccgtgtgtagaaccgacccgtataagagggcaaatgatatcataggtaacaaccaagtgatatgcaaggttgaggctggaagtgaatgctcaattgttgacactgatttgacaatcttagctagcatgcttgcagatcaaggtgtggatgagaggaagcaaattgaggaagcagttgagagagaccaaggtgtgagtgatttctttgtgtatggtgtcaatttgacatttctagacttggaagaaaccaatgtgtatgacctacaattgaagggacaaacaccaaagtttgtttactacacccttcaaggggttggagatgaaggggttgttttggtgtatccgtggccaaaaggttctatcaagaatggagttgatgggaagtttgtgaccatgattatgccggaggatgaaatggtgaagcttaaatttgagctcaagataatcgatcttctgcttgaggataattaagttttaatgagattaagtatttttcaacaaattaattttttttatttgttatgtttgtgagcatggaaaacttttagattgtagtacataatttattactttaaagtcatgtgtatctcacgttaaactttaaagtcatatttgtctcacgttaaacatagatatgatgtggtgtgtttcttcttcctgcttttttattaaataaattatttccttttaaaaaaaagaacttaattgctttgctttacacaaagaattaatatttcacaaacacacattttaatataaaaaactaaactaaaattcagacatattttattttacagcaaaattaagagacacgtcatagttttaaaaatatctctattaaaataaattctaactttaaactaaatagagcttattaataatacagtttggttctctttttttgaatgtcaagcatgtcatttaatttgcttgaaaggactgttttaattttggtgatgctatttgatttgtatcgcgggtgaggtctctcctcatagggacaccaccgtcgatggaaatcggtacacgggataaggtctttggggttcttacttattatgctaggaatgcctcgtagggatttgttggggtattcggttttccatgtaacttcctacggttgtttttttggttgatgcagattcaatttcacagcttgtgatttggatgtctgcacctcttgtttattcacccctttatataatatacttccttttggccttaaatttctgtcaaaaaaagtaaattttaaacaattataacaaaaaaaaaaaaaagaacatgtatttgttcaccctcaatagtcaattcttcaagaaaaaaacataaaattaatataatgaaaagacaattcattaaaatggttgttaggagttcgagataaaataatatgccaagttctagattgcaattaaaaagcacaaatctgcatataaaaaattataaagcacaaatcaagggtcaatggtgcaattaaatgttttcagcctaaggctatctttgaagtttcctttcattttccatatattatatgtttatttataggcattgaagattgagtttaagtcaaatttcaaatcttaaattgacttggaaggatgtaatttgaaggtataaatcagctagagtttaatttctttatttggatttcattttaatactaattgacttaaatattatggtggctagctgctatgaatttatccttatgatcgagacaatgataaacaaagacaacctcaattacttcagccacacaatcatacttgtgtcacctaatgatgagttaagacggtgagttcttaaaatgttaactatttgattaattaaaataaatataatattgaaactttgttaaattaaaagaattaaatgtaattttgttccacctatttttgttcattcagtaactttgatttctctattttaaaattgagacatttgatcttcttatttaaaaaatttgtaattttaattttctcatttcaaaatagaaacatttagtccttctattttaaaaaaaaatcacaatttaatttttctattttaaaaaatttgtaactgtggtcaaattctcacttttgtctaattttatttcttttattttgatttaattgaatcataaatctaaaatattcatttaaggtatcattaataaataatttaattaattacagaaataaaaaaaatgaaacattgacaaaattaaagatttaactaaaattataaatttctaaaatataaaatacagaaataaaattacatattttttaaaatatgaagatcaaatgtttgtatttttgaaattggagaacaaaattatgaattttttaaaataaaagaaataaatatctcaattttaaaatagaaaaatcaaaattacatattaaataaaatagatgatgaaaaattacatttaatccaaattaaaattatttacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtagatctcaatttgagatcttagagagagagaaagagagagaaaatttattcttttttaaataatgtgcagattttgagagatcttgtacaagaactcattctccatgttagagatctttccattttttttattgggagatctagtgaagatcaaatcttgaactcaagatctttactcaagatctagcactaaagatgctctaagaatgtgtttatttcacgaaatgatgttgtatcacattttcataaatattaatgtgtttgtctatttttaatattactaaaatttaaaattaaaataaaaataagagttgaaatggaagttataattgggtaagaacatatatagcttcctacaaccccatagaaatataactatttcacctcttatcacatgaataaaaatgaattaaatgatggtataactattattttaatgtggataaacaatactcaagaatatttttcaaaattcttaacaaacatgaaaaattcacatttctggctgtgaaacaaatagcccgtaatcatttaagtatattcttgagatatttaaaagtgtgtttgactaaattttaatattttcaaaattaaaataattaaaataaaaaaacaagaattaaaatgtaagttataattggattagaacataatttcctacaatttcatggaaatatatctttgtcactcttcatgaaaataaaagttaattaaatcattataactattttcctttaaggaataatattttttttccaaattcataacatacataagaatattatattctcataaattcattttaatccgtgaaacaaacacgccacaagtcactttatcaccacacgtcgttctaatacacttgataaagataaataagcacacctagccaggttatcatatagtttttattgatggccaagttaggatgttgggtgataaggactggggattaagcaaagatcatttgctcttttgacagttaggccaaaagacttggtcatgtctaattcttggtgtattgctccatttggcagctcccaaacaaaatggtaaagcaaattagccagtgacagcaacatgtaaggcatggaaaatgcagctccaggacaaattctccttccagccccaaaggggatgtattcaaagtttgtgccactgaaatcataataagagttatctacaaacctctctgcttcattccaatactttgattctctcccaatggcccgagcattgataatgactttgctctttgcagggatttcatatccattgatcacacatgtctcactgttttctcttgagactaataatgcctcacagggggtgtagcctcattgtttcttttatgactgaatttaagtattgacaatgtctaaggcctgtttcatccatataacctttcacattgaagacctttcttacctcagtctctgccttttccataaccttaggatttttcatgagttctgacattgcccatactgtaactgccgttggtgcagctgtcccgccaacaaacatgtcctgaaattaattaaccatcaatctaatttagaacattattaatagagtaaattagattaatatctatgacattttgtatacttgtcaaactcctttctaatgtttacaacaatttttcttatggaaaacatgatcacaattaaggagttagtgtaatatataaaaattatcaaggtaatatttttcaaacaatcgaaagagttattgatgaaataaagaaaaaaaataggagagatttcaccaggaatagtataatttactcttgataataaagctaaatatgtggtgtagcacaatccaaagctggtacatctttccgaaaaaattaattacaactagtattaacatttcaaataaaaaagggtcaaataatattttaatttattaatttttaaatttttataggatgagcaagaagctgccgtgtgagaaaaataagaatacagaggacaaaagttggcgtgagagatgtgggaacattgtcatgaacaaacgtgcggtgagagacgtagaatgtaacgaaaaatattttgacaatattttaactttgtataaatattttaaaaaataatatcataatttagtaacatttggttttataaatgttacaaaatggtcttattcataacattaagtagttaaatgttgctaaaaacatatgtagtagtggcttatacgacatcgcatcgcaattcccaaaaaataaaaacaacgtagacctcactcacgtctttgggaaagaagcaaagcaaaatgggcatggggtatgggcacccaggcagttgaagacttctccaagaaggcaataatttagggacccctttcgaaattggccaaggaataaaaatgtagccaattagcaacagggggagtgatgaggtggacccaagggattaaggtatagccgtatagtttgttctgtttttcctgctattaattggtaagctcatttagatatttaaggatgacccaagggattggtatagtttgttctgtttttcattaaaatagaaccaaataaatgaaatgaaaaatattatttaattatttcataataggataaaataaaaatcctattccaatccatatggaacagaaaaaagaagaataaaagaaaatgaaatataatctatttaataaagaaagaaaggaaaagagagagttgttatccacttattttatagataaagtattttaactggtaaaattttaattttcttgatcataaagtatatataaaagagagattattttcagattcaaccttatcaccaacaaataatcaaaatacaattttattattttatcagaacttatcatctaataaacgaagtatatcttctcaagaaaacaagtatagtacaatcacttattttgcatagaaagaatattttaataacttgctacttcaattatatatatatatatatatatatatatatatatattataagtgtaatttattatgttagtaaatttcatatctatgtatatagttgtatatatggaaatcttcaaaagtaatcctaaagaataatgcataccgacccacatgagtgctttgctgttgttgtgggtcaagggaatttccaagtcatctctcttttgagttttgagaagaatatcaataaaatcctcgtgcgtcactccatgcttgttcctattttccttgtgatccttgaccatattttctaggatcttgtcattctctctgtgctctttcaagtttagttttcattcctgtgagccaaggaagcactttgattgaagggcagatatcagcaattgagaaacctcccaacagcagtagcatttgctccatcgttgacacgaaagcttcttggtctttgcattttgtaccattagctgcccttgcaattatagcaattgtcactgactcagtaataagattgataattgacccttcatttgcacagacatttctaacaagtttataatcgtttcttctcttatgtgccttagtgattgaacatgctttgcattcaacaactctgaaatgcaacttttttttagttgcctccaagctcttccgtaagaagagagggctatgtcgctgctatcatagacaatgaatttggaagcaagaagatggggcctatttgcaaagatggcatcatgagttttcataatctctttgtcaatatctgctgaagagactattatgtgtggcttttcaccaagttgtaggtgcatcaagggtccatgttggttagccaagtttgccaaagtttggtggggaagtggccccagaaattggtgaatcttacctagaagagttagtttccattgtccaagtggcaagtttttggaatttgaacgattcagagtgttgaacaatgcaagcaaaggtgaataggaagagggaataagaagctcactccatgttaagaaataaaatgttgtatatgcatgactggaatggtaagttcttcgggcttataaataaacgagtggtttatcacgtactggaacaaactcaacgtaggggcagattcataattttggatggaccgacacacacaaaaaaaaaaaatgaacggacatccatcatatcattagacacctagtgactgaaaaaaataatataaatattatacaacttatgatatgatcaaaaaaatattagatattagaaaggtgtttaaaataaataaataaaaatgtttctttttgcaatttgaagcaacgcttggaaaaccacttacaacacaaacaattttgtaccacatgcttaccgttgacaagattaatggagatcaaaatggaacatggtaaaaaaaatggtggaaaaggtagatgcatcaaaaaagtcttttggtggaaaattgtggtacttcaagagatgttgagacgtcaagagttaccgttttcgatgtatattttcttttgtcattttttgaagtttatttatttgatttaaaaatatataatattttttataaaaaaaaataacctattcacaattatttttaatcaaactatgtgagtttttagttctttaaaattaaaattatttttctcttatttatgttaaaataagaaaacaaatatttgtacaatcaattggcatgggtgattttttcatcaaaaaaattgggatgggtgatttagagaagacgttggatttaatttctacctttccaatgcacatgcgactcttaaattttaagatttttcattttttccatatttcaataaaattagtggtgactccactaaagaaaattgcgaagatcaagcccattaaattaattgtgacaatcatttttatctttaatttgttgatttgttaatatttgtgttgtcttttaatttcttttaaatccatagtgttgaattggtaacttggggctatttttaagaaagttcttgtcataaaaaaggtaaataaacgtggagcgatggtagggaccaacacccttgggaccttctctcacttgggactattttttaaggataccctggatacgtaattctatacataacaattaaatttgaactcgtaaatacttatctgattccgatttgatgttgatgagaaaacctattttaaccatggttgagttcaggcttttcctattttatagaaacaccaacgcttatagtgttgatgcttttgactttaatacacatatttattatagggtataagtatgaatgaaatgctgtatatgcatgaatggaatggtaagttctgcatgctctatagatagataaataagtgctgtgtggtttatcatattttggaacaaactcaacttagggatagattcataattttgagcggaaacgatttagtgccatttatgcaacaattgtacaagacaatcaattttgtacattgtaccgcttagtgtagacaacattggaaatcaaaatgaaccgaccgtgggagaatgcatccatcaattatcagtctaaactctaaacatttaaaaagagtttatgtttgatatagtatgatcttgacatttttatagtctaaataaagagttgtaacacaaaatgacggggatttatagattttccatatttcaaacccaaacaagattgtttgcaataaaaatattttacgtgttgttcatctgttttttgtcagaaggattgttaatgaccaatttggtggcagatgcttttggttaagaaggctttgtcctgcactagctctttgagtttatttgctgcatgctgatgtagcaagtttttgggttgcttagtcttacttagtttgttgggcttgagtcccttttaaaaattaaactccatatattttaaaaattaatttgagttattcttacttcatctgttttaaattataagatataattgataaattcatgattaataaaaaatttaatcaatttagttattaacattaaatttgtctatatttattatatttttttaatataaaaatcttaattttattgaaaatttattcattttttccaattttcataggtgaagaaaaagataatttaaagtaatttagttaaaaataatttatacatgaaatgaaatcttataataataaaaaaaaaacttgttgagtatgtcttatatttgatgaccagttagtttatgcatgttcctctgatgttagtttaaagattttgcgttggaccggttcaacctacttcaccgtgagtttttaccggtttgtacggtttttgactagtcttaccggtttttgaacggttctttatccaatagttttaagagtgtgacggaccgaataataggacgatatttatttgaaccagccggtttgatttaaaaaactgtgattacatttcatattgtctcaactcgatgtaatattttattatttttagaacatacaaaaaatcctaacactatataaataatactttgtatgacacgaatttatattttatattggtatgttttagtacattctgggcttttgatatttattctgtctattggtattattatattcacataacaattactctctaacagaacattataattttgcccaacaagaacggattgaaaaatatgtttgtgactttaaaaaatgaaaacaacattttatcaatattcttctcactttgaagaaattacacattactcgcttagctcttaaaatatacactgtattattctctcgagtgatcaatatatatacacaatactcctgtttcttttgaaaattacacttgattctctttgatagagaaatatatattatactaatttattttgatgtaaatcttaaaggactattttcgttctctgcaacactcaacatcattactcagaaaaaagaagacacaacaaacaggatacaaagtgccacaataagctgtcgatcgtacacaagagtgcctcgttcacttgtttcaatgattttggtgaaagttattcttgcagtagcaaccatgattattgttatattttcagatgctgtgagcagccaacagatctgtattggatcatgcgaagacactccaagctgtgatgcccactgcaagttcataggctttgggaaagggacatgcttcatagcctcacctgcatattccaagtgctgttgctcctaagatggtagacaatatttttgaccaagagttttcttcatatatagggttgcaagtaagtaatgtattttttttaataattattagtttcattgttggaaataacaaagaggattgtaaggggggccatctcactagattgaccttttgttgttgaaaaacatactttgaaactattacatgtgatcagaaattagaatcaaattcttcttttcccattccctgtcccccaactgaaattattagttgtcctaacttatgactcttaaatgggaagaatccccactcaccctttacttcacggttatcttatagaaagttatcacaagttacaaatttgcaacactttggcattacaacttttattgataaatgcaaattaatcctcctctttatttctctctctttggtcgggagaatgacatgtggcgtaggtatggatatgggaacgggaaggacaacggtgcctcatgggaaatcaatctcataccctctttttacaagacaacatggtatgtaccattgacaatgtcaagttaatggaaaatcaaattccataccctccttttacaagacaacttggtatgtaccattgacaatgtcaatttagttttaatttaaagttaaattaatcaatgtcaagaacaattattggtccaagtaaaattagattcaattttttttatatgtaagatttcaaatttaaattttataaacaaaaaatatatatataattaaaaaaaataccacactaaagataattaataaaattttctgacataaattagttatcagtcaaaatagtaaaacatgtataatgttaaccaatatttaatcaacgtcacgatttactaccaaaacttacacgtgtcagacactaaaccaagcaaccgcaatgctcacaactcatcacctgatgtaacttttatgcatcaatttattcacaacatcttgaaatatgctcagatgcatattaccttattcgtattcatatccattagcttccgaatcataatgcttcattttctgtatgttattttgctcattcaatttggccaatttcggccagtttccttttgattcctacttccaaccactgcataattaatcaaaccaatactttttttcatttatcactgttggggtaaatgtgtgtatatatccaacatccaatttattatattatcaatttttgtaaagaattattttttattttattattataattatttttattaaattattaatttgataaatctttgattaaagttaaagatttattatcatgatacagaatatgataatgagaaaaaattcatttataattttaatctaaattgttcttgatagtaggattattctaaataggacattaataattcagatagatcaatatatatgtgatggtatttattgaataaaaattaatgaatctcatttattaaattacatatatagaagataatttacatgtgaatatcattatttaactgactcaattgagaattcctaataattaatattactttgacatgccaataggaagttcttaagaagaaatataataattttctttaatttgagattatcatagtaattaataaattatttgttatattttaattttggacacctaatgccttatgatactagttaaatgaatattggatatgattaaatacttgtagaattaatgattaattaagaagaaaatcatcaactctaggtaatgagtttgagttctataatagaattaagaccttgactagaacaattaaatgaaaggagaaaagagtttcttaagtcatccattgattaaatataatatgttaacttattagaatttgatagtaataatatactctagagttaactttgagctgtaaatgatggaaaaaattattacgttattctcctattggttcttgaaggtaaaaaaaaaagttacttcatgttatccggaccttaagaagtgttgttagacgcctatcttgattagtaaattaattgtgattaatttactatcggtctagtgttgaacctactagatcacacacaaacgagtgttccaatttttgcaaaaaaaaattatttcataattaaattaaagaatttaatttaatcaaataaatattttagtagaatattattatattcttcattagtaccaagaatataattaatataaataaagagtattattatataaaatgtggtagttgtctataaataagaataaatttttattgctacatatcaagattagatcatgtgacaagttatcgtaattaatcatgattatttgataattatttttcttatattaggaaacttcttagcataaaaaagatatgagatgttttttattttcaaatataaaaatagagatacgaaattattttaaataaaatctctctttttaaaagtctcaaatccatatatatttaatattataaattccatatatatttaatattataaattgaaacatttacatgaaatcagagtgtactagatcaaagtagaaattcaattttaatttttagacttgaaaagtagaaaaagatgttgttctttagagtttctcttattaaaaaattgatagcagaaattaatttcaatatagatatatttagagttttcacattattaaaaaaaattattgtttcaacaactcacaatcggatacacaaatttatttatttttaattaccattactgtatattttaaatataaaatagatcctaatttttcgagaaatgttaaaactaacaatcaattggcgaataacatcacccctaaagtcatacacattttttcttaatataacacgtttcatgaggtgctttcaaattgtataatttgtggagtttaattcaatcatatttgacccttgacaaacgaaagttcctaatgaccaaagtccaaaacattccggaaaaaaaaaaaaaacaaagtccgaaattatatttctctctcccaccttacacataaataggcacccagaaaatcttctcaccgcccaaataactaccatatgacacgtttcataaggggctttcaagttgtataatttgtggagattaattcgatcatatttgacccttgatattaaaccaaacttcctaaagctactggttggtaaccaaaacagaaattttttccaccttacacataaataggcaacccaaaaatcttctcagccgaaacaaatttgttggtaaccaaaacagaaatttttttccaccttccaaattgtgtaatttgtggagtttaattcgatcaattttgccggatcaaaaagaaaattcaatcatatttgacccttgatactcgtccatttaaatgcataaacgaaaaccaaagttcctaatcccacttgctggcaacctaggtccaaactatttttctccctcccaccttacacatcagtaggcaccccaaaatcttctcacagccaaaataacaaccacacagaacaatccataaataaagtattaaaaaaattgtcaagacatcgttacatgtcagttgaacagtttttcaagaacaattttttaagtttttattttattttactcttttttattctcccttcctctttagttttttttcttagaattttttttgcaatacacaggtctagctgctagttacactaatagtgtgtctagtttaaaatcacttttagcataattgattaaaaaatctaaagtgaagctataaatagttaagtactagcttcaacttatttataaagttaccatgattttatggactagactcaaatctcactttattatataaacactatttgagttccccttagaatatccaaaattacaattgaaataccaacgaacataattttcaattaatattcacatatttaattttccattaagaagttaattcttaatctaatcaattgagttaaagtaattataaataatttttgcattaaataaaaaatttatcctaaattttattactaacttgcttttagaataaaatcatctaatgatctaaatataaatccattaacttcaaaagccattttatctaaaaccaattttgcaaatgctaaccaaaacacactaaaatggcctagagacgttaattcagccgactattagttagcacgcttaaaactgtgagtagagcaatgggccaagggcacgttttctcaacatcaactttatatctgatttgatctcgagtacgaagatgtacacattatctattgtctatatatacaactagttacattaaatatagagaactaaggaaaatcctggtcatgattcatttgacaattcatccttctgctggcgcattcgtgctgcccatgacatattccctccaacatccttgctgttacttcttctcttcagctctgacagttgagatttccacctagctttccattcacttttttgttcaaccacctgattcaaaaccaacagcttagaatcagtgagcaaaccaattagtgttctagccaaacacctttacccgcttttcttcaatttaaaattagaaggggaaaaaaagtgaattagacaactgaacaagcaaatacagtaaattaagaaatccctatctctttaggatgcatgatttatgaattcccacttactcattaccacgataaaaagaaatttccgaacagtagtatatgaataaagaaataattaagatcacactcaatctcattcgcagacacgtttcatcatcattattattgttattgttaataatactaatatttatatcctttcacactgttagcttgcacagacttttaatacgttgaagagccatttatacatgttacagcaacaacacacttattcagtttttaattttttatggtggtggctgggattgaagttgacatattcaaaaagatttaaattttttttggaaaaagaacaaaagccgtaatagaaatccagaaacaatgtattcctaccaggaaacgtcataaggaagtatctgccgaaagccctcataatttatgaaaatagaatgattgggtgtaggtacagtgcagaagttaatagatattgcataaaataacacaagctcacagcaggaagaatctgttataccatcatgaaaaagaaatttaacttgtaaacagattttcatgtgctgaagaggcaactacaacacacttgttcagattttgtggcggagaggctgggattcaagtcgacatattcgaaaaggaaaaaaatggaaaaagaacaaaagccagaatagtcctcataaattataaaaatatcaattatgtataggtgcagagcagaagtcaaattctgtaatagacacattaaatattaatataagttcacaaacagcaggaggattctgtgataccatcatgaaaaagaattccaatagaagcaaggtgaccgctacaactgtaatttttggaaaacaaaaaacatagaacagagaaagaatcaagttcctattactaacttataaaaagcacccagaaatataaaatatcagaactcaaacgtgcatgatgaagcaattcccattccaggtcaaagttacagtcaattgctttgtttgctgactgagataggtgaacaaatcagtagtaagacaatatttcagattagattaaattcaaatcaaattttgaatcaccaagctaatttttcaattgtgaatcctaactcacatcaaatcataagtttagacacaaagtgaaaaacagccctagtatatcagataaacgatgtatagagctcaatgtataattttaaactaggaattgaaaaaaaaatacatattatccataagtttcacgaaacattataagccatatgtaatatgtcgtaagttaaaacaaaaacaaaaataagggcacatggattgggtgggttagtgtaagtgtgcaaaccctttgtcatctcagaattaagagaaaaaaaaaaaaaaaaacagaanntagcatgcacagagcgagagactgtgcaaatggaatcaaagtaaaagaacaaccaaacaacattcactaagcagcactatacctaattccctattcctttttatttcacaatttaaacttatttaaattttcaatatctttaacgaggactgttaaaagaaaagccacccaaaaaattagaaaacacaacaaattattgaatcatatcatacatcgaacaattcaaagcaatttgcaattcatcctacacttgccaaatcatacaattcaaatggcgacaaatgataatggttagtttgttagcagcttcccttttttcttaaccacccatgacccaaccaaccttatatctcctgaaatggcgaatcatgtgattcaaataaaatgaatggaataattaaaaagccctaagttggctggcgaacctgatcgtggtaattatagcgtcgacgagcgttgaaggcgaagttgatgcccctggccatgtccttatcgtacatagctcttcgggaaggatcagataaggtttcgtaggcctcctgcacctgaataaacctcttcgtgtactcttcgacccgacccggtggtgacacgtccgggtggtactttcgggcgagttgcttgtaggcgttcttgatctccgttaccgaacccgattcgggtatgcccagaagctcgtagaagctcagctccaccacgaaaccctcgttcttattcagggtcgcctttggaaacgcgattcgggtcgtgataatgggtttgttgggcctcaagaacactggagatacggtggggacgcagaagcgctggtcgcttcccggtacgattaaaccataacaccgcattatctctcaccctttcttcttctcttctctctatcacactctcgctcttactacttcatttgctttgcgtgtgttttggtattactctttatgacttatcgattttatatggttctcatttcgttttttatttatttttgcgtgattggatttcaccaaaaaaataataagttttacgagattggtttgtactttgtggttagctgtcgttttagccttaagtaaacgtctgggaggccaaggtgtggcctttgttcattgggtgggttatacacatctagatttttttttaagttgtttttacaaaaataattcttaaacatctatcacatatattttacaccaaagaaatataaatatgacaaataatacatatgattaataataggaagagggagactgagaaaacttatgtgccaatggagtttactggtgtaaaattgtgaagtgtccaaaatcatagacattattttacagcgtgtttaaatcatcatccctgaataataaatgtgtaagacttatgtatttattttaccatgtgtttcgaaggcaatccttttaccacattgtagaaaattattagtcccttttctaaaacctaatttgctgatatataaaggcttttatattattattttgttatatacgaaaagaaaaaaaaggttcatatgtatatagaagacctatccattctaaagaaatcagagaaacaatgtaacccaacaatttattattcctatttcattactattactgtattatctgatatttaaaattaatatattttttccagtaaaaaaagaaatgatataattttttatttatatctaatatatatatatatatatatattcatcatttaaagtattccaactattattttcattaactaaattactctannnnnnnnnnnnnnnnnnnnnnnnnnnnnnnnnnnnnnnnnnnnnnnnnnnntcacgtgaaaaagtctaaatcatataatttcactcctaatctcttaagaattaaactaagtaatttgctttaagaataaatatgcatagataagggtaaataacatcattttatttatagacatgaattacctagaagctcctttaagttcttagggtaaaaatatttttcaatgattaaaatcgtataatatacatatgaatgggtgatcaaatcataaataagacaataaacttaaatagaaagcaataatattgaaataacattaaatggatagtaaaattcactacatcaaagagtatttggtattcaaaccccaacaatggataatttagtatctcataatcattatgagagactaaaaaacaaaagatgaaacaaaggaaatggaagaagagctcccaagtgactcttttgctctattttgtgcccttgctgactaactccctttaaaagcacattgtcacatttttataatcttcgaaatgttgcataatcatatttttcaaaaatgactttgcgctaagtatgcatgtgtgcgctgagcacacatccaaagtacaattgtcttaagtgaccatgcactaaatcctaagcatgcgcttagcgtgcattggcatggtgagcatataatgcacattaaattcagtgttctaattttttcaataacttccatacctcataaagaagttaaattcctaattttttaagtaagaaaaaacattaaaaagaagaaattaaataattgtcatgtaatttaaatgtacaaattaaatattctagtaattattacctattaaaaatattatcatatattaaatatgaaaagatttcccaaaatctttagttgttggttaagggggatttaattgttctcaaataaaaatgcaacaataattgatttataatacaataagtttactcctctaaaaaaacaatacaataagtttactaaagatacatttgttttagagattcgctaaatagttaataacatagttgacaagtgactgtgatatcatgctcaataaaaatattagtatcatatattgttttaagtgcataagttatacgtacatcaacgaaatgaaaaagtgcatagtttatacgtgaattctacattttaaaaacgaaaaaaaaatgcaaataaaataatgggatttgatttaggtaacgtaaaaagtcagtctagcaaattaagatttaaattcttatacatttaatacttatcatttttggatttaaactttaaattttccctcaggatatgcttgcaacgataattttaggaaaaaaaaatataatcagatttttaataaaagtataaaccttttttaattctttatgaaatattatattttattttaaaatatgcatgttaatacttaatattaattatagtatattcgaaaggataaaacagattttttttattcagttaaagataaaacttagatgtggtgcttcaatttggttttttgtattatttttattttaatttgaaattaatctttgataacctatgttgactcttcatataaatctttattatatattacatccattttttttttatccgtcgtttacgattgtttttgtagaaaccaataaataaaataatttttttattatgataaaatagttgttaaattttctatttcactcttttatctttttactccacaataaatatatgtgtaaattaattaaagataaaaaacaattaaggatataattgataaactcataaaagtacgtataattaatataattttgaactccgcaaactacatataaacatgaaaaaaaaatctttaaaaatttaacaaataaaaaaggaacgannnnnnnnnntcacacactattgcaattaataaactctttcgataattgtcctttttgggaggtttgaactttaagagttttcctatgaggatatgctatggaagataacgttagagggggaaaccttacatgatcaatttttcgataaaatataatccaattttaacttttatgaaatattttttattttaaatacgtatatttatttatttacgtttcacatgtcaaatttaatattttgaattttttttcattgacaccaaagtcataaataattgatccactgttaattttaatataatcttttttagcatgtaaccttcaggataaattaaaaattaaataaataaataaaatatcatgtagtaattgtaattgaagattgttaacattagatataaataaaaatatagataaataaaacacaaatagatagtgttcctacattagtattttttttccttctatattagccctatatattttagatttacaacattcaaatgagactgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaacatgtttaagcccacttttttttttcttataattattaaaaaattgttgttttaataatcatagaaaaaaccagttctataagtaacatcttttattattcttaaaagttgttataactaattttctatatgtaattctattttgacgtgtagattatacttcagacagttgacaaataccatttggcccactttattaacatgtttaagctaacttgtattttttaatagttattattgaatattatccttctttttaggagtcattgaaccttgtgcttaaatatacttctcaaatctacatcactattcactaacatgttgcacacggtttaaaatctcccaaattgcatccttacaaacaataaagaacatacgtaactaaaaaccttcaccgttattttttataagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgaggtattatttatgattgaattaggacaaaactcacattttaattaaaaatatttttaaattcaatttcagactatattaaaatatagtgattaaattaccattgagtgaaatgtcaaaattaattggttattaaactttaattaacgatttgccaatcaaaaagttagaagaataaagtaaaaattgataaattatatagtgttgcttctcatgtgcaacttaacttcataagtttcgtcttttttcttttgtcactcatttttgaattcatattagattatccaaatccacattgacatactagctagcacgtaagtatttacatgtttgacattacgttaaggaattgattttatataaaaattgatcaagttaaatcgattttaagtttcacagtcaataacaaaatttacactgaactttattactgacatagttttgaaataaaaacatcaaacataatttttaacttaaaaatcagttttacagacattcgtcatggccatcattatgcatatgtcatcaattgttttcattacttagaaaggctgctgctgaaaaaagaatacaaaaacttgcttagattagtacaccaattaacttgacgacaaaacgggaccaagaaacaaaataattagcagttgtacgcttgatagtctgttttttcttgcttagctggtatggtagactaaatttgatcaggacaccatttctatccaacgacgatgacgtgtacatgcaatatatatatatataaaactccatcctatattaataataggtaaagaaaaaataatcttaaaataattatcattttaacaaggaaacataaaatttataaatgaattaattttataaaattattattctcttttatatatttattattattttttaatttatgtaatacctagtgtaaatacctagaacaacaaatattacgaaacgaaaggagtattgcgcttgtagtaattgtatttctgtattaacaatcatcctcacatgcacttgataaatgtaaattgagtctattatgaaagaggggtactaaaaaacactgacactttcaaaatactctatctttaataaggaaaaaaatcattaaatgatataagactcgcaaattgtcatttcttataaatatcaatcaataaaaaataatatatttaaaagaatcatagctaaagcgaggttccaataaccagataacatagtatgtagaaaaaagaaaaacaaacttcaatttaagtgttggaatatttatattagatttgacgcactttggaatttccattaataaacttccacttcaaaatcaaaacattagtttcaccaattttaacttggttttgtgcagcaagagatacatagaacgacgtgatttcactcgatgatgatgattagctacaactgagtaggttggtcatacagcttaaattaggattattttcgaggaaaaaggggaccaacatttaatcaaatattcctcaagagcctaagtcatcaacgctcaatacttccccctcagttagccactagttatttgtatatgttgaagggcacgcatcaacatgttaagaggtcaacaataacctagaatagtattacccatttcttttattaaaccgtgcagaactatgaacaaacactgtggtaaaagccctaagcgccaaccggagaaggcataacatcagtgtgactagaccaggtggtgaagagacaacaaaaaaaaggaaactaaaacaccaacagaacttccaagaacaaacttcacacaatcatctggtgaagagaatttgcagctgctcataagatcatcatatccaatgcttaacctaaccaaaaaaaaaaggggagatgggagcagaaggggaaaaaagaaaacggggctggggacagaaaaaaagagagcataaaacaaggggataaacttagttgtgacccaccaacaggagaaaaaaaacataatttctttagcacctctcagcaacaagctcatttttcaaacccataatttaagttgtgacaacaaataaaatcaacacaacaaaaactcaactcaatcattacgatgacactgaaaatggctcgatatgcaaataattgtaaagaatgtgatgcaaaaacatcaatgtcagcaggacaacatacagaactacgtaaagcatgggacaagacagacaaaataaaattgaagatcctacacaaatagaagaaccacccgatagtttcacggagaattacctgttgaaatcatttgcattacagcatttacttaagtaaaaactgtaactcagccagttgctcaaatgcaacatgatgaaactcattgcagcaacatccaggttcagttgacctttatatagaagctttacctaaccatgacaatttgttggggggaaaaaagaaaaaaacaaaatgaaaaatgtggggggggggggnnnnnnnnnnnnnnnnnnnnnnnnnnnnnnnnnnnnnnnnaatgcattcgcacataatacaaagctaagcagcctaccatattgctctcaacacttactaaaagaaaaacaaatatgctctaaaccatagagcatcagaatctaaccgcataccttccattacacaagagaaaatcaacccagcataactgtatctcaaagctccaacagatttcaatgagaataacctgcatttgttttggatataacatgcccaccatatcacaaaacatgagtaaacgaaacggagcctatgggtggtcacatcaaataatgatgctttcaactaaacaagatcatactacaaaaattggccacatcaactatagaatctagatatgacagaccaatgaggagataaacttaaatagtcaccgaaagttcagtttaacatattattgctatctaaggtccaataagttttagatgcataaaatcgaacactggctaagagggtttctccctctgaactatcatttttgaagaactagaaaccaataatattcagacaccatcaacaacacctttaacccaagttaattgggaaataatatacttaaaaataaatatcaagaccgaaacatagcaaaaattaccttcaataaaaataatagtatacttaaaataacattccaacatacatcaatcaagcagtaaaagaagcatgatataagcgctgcatggttgatcatgagaaaagcaggactcctcttgaaaacttaaaccacaccaacagctgtgggattctacacctgatctttaccaacccaacctgcaaaagaaataaacaatggaagatgttcataagagaacagagaatattctggggaccaatcaaatagtggaggcatcatcctctgagaattgcggtcctcctaagaagaaacagtatattccttggaaagaacttgtcaggaaacctaaatgagaatcctgaattagaatatgctctttatcccataatcattgacaggtgcagaaatcttcaaccacaaaaaaccatggtgcaatgcttttgaaataaatctacactatggtgacaagaaatggtagtagccttgagtgacaccacgtccgattcaagattgaataacagaaatctacactcatagctatgttctttgatataatttagaaccaccactcctgtaagcacagaaagtaaccaagcattaataatcatataatacaagtggatactctttttttctatattcaagttagtcattaccaagccatgtttgcttaatattttccacttcccactttttccactgatatccatcctgcatcaaagaggattctcagatttgtaacatccaactaaaacataattaacaacaatgattgagaataggacttcccatacctgggttatcatcagctcctgcattttcacttgacccttctgatttgtagttaccattcactgaagtcagtgtcccattatcattcaggattgctgagtcctttgcatttataattggttcctgaaacacatctccaaagagtttagaattttcttcactggtagcattttctccatcattcaaatgatgcttttcttcaacagatccagaatcagatggtgattttccttttgaatcatcctccttgtaatttcctcgtaagggcccactcccatcaaattgttctgattttgatttagatggggttttcttttgaggctctgatttttcacctctatttcgatatttatcactggagtgattcttgccttcaggggactttgtcagttcaaaatttctcttatccaagtttaaattgggtgaagtgcctcctttgtcatgcttatcttctaatgatattgaccttgaacgccttctatcacgatgctttgatttcttatctctattttcccctgatttatctttagaacgacgcttcccttcaacagattttgacctgcaccttttaatatcacgatgttttgacttttcatttttactttcatcctctctgacattagtttgatccctattttctgtagatcttgatctggagtgccttttatcactatgcctcgatcttctatttctgttttcatccaatctctcaggagaatcatgcctatcatccacagattttgacctcgattttttgtgcctggatctactttcatccacttttctttgggatgaccggctccttctgtgaggcttctcatccacagataatgacttggatcgccttctctctctgtgtttagactttccatgcaagactttttcatttttgctagagtgaagcctatcatctgaagatcttgaccttgagcgccttctgtttcttagttttttgtcatcaatctttggagaagacctacttcctctgtgacgatttggagagccagaatcagcacgtgactgtttccttcctctatgaggtgaagtttctctatgatgttttggagaaacagatgatttccttgtataaggacttacactcctacttctgtttcttcttgaagcagatgaacgatgatcaagtgatctatctgaatctcgtcttctgtatctatcactatgttccctaatatctctataggaccgcctttccctatcatagcttgagtaatgatgggacctcaatggtgacctagagcgatgatccttagaatgatgagcaggtgaataagagcgagacctcctccttctccgataactgataggagatcttgactttgatcgaaatcttccacgaggaggagagggcgatctgcgaaaggaaattaaattttagattagacagagaactttgtacagaaaagcagaaaatgataatgagtggtagaaaaaattaaaaaaaaaaaaaacattacaacaagatttttcccaatttaattcaaaataaccacgaatccatgataaacaatagacttgccaattgccaggccacccacaatatatttcttccatgttagacaccagttaattctaaatacaaataatttattcagcccaattcttcttaccttttttagcatctacatgcacatacatagccctaccacatctagctagaaatatagaaacttcatatgattcaaatatttcaaactttctatgttgaaacctataataatccagaacagcaggttgattcagttaagtcatgacaacggcatcaattgaaattcatatacaattataacttctctaatgaaaatctccctttctaaaggatctgcacaaacaaggaaagcagaccaatcaacaaggaattctcccaagtatgtcaattcatactctattattgctgcgtcacccaaatgacctccaatactgcaggagggcacaagtccccataactcagcaactttgcaaagcaaaagtggggaggttcctcaactacaatgtacctactattccttatgcacagagggggctaaataaccacagtccaacaaccccctcctcaacccatgaaccacaactatccagtctgttactgccatgcaaatttaaaaactaaaatgatctaagacaagttgcttttccataccaagcccctgggcaaataatctggaattccatgcaagccgctaagaaaatatgttgattgaaagcatgccattcttgcacatatcacagtttactttatcatctttactagcattaagagggtaaaccttggcacaacggtaatgttgtgtctactgtctaggtgacttgtcggtcatgggttcaaatccggaaatagcctctttacatatgtaagggtaaagctacgtacaatatccttcctccttaccttcacatagcaaggagcctctgggcaatggggtacatagttttatctttattagcattaacattccatatatcattcagatttatgacacatcttattaaagcagagaaactcaattcttatttaattcagtaattggaaaacttttatgctagtgatgatggtgcataaaaagaacatgcactttttttttatcaaaaaccttattttctatcaagacctcattaactaatgtgtagctataaatttgttgatacacacatttgatatttcaagtgtgtttgaataaatatataatcctatataatattgggcctgcgcattgtagaagtggacctgcacaggggccaaacttagattgttcaggtggctgccagctgataggtctgtcaggaccagctggctggtttcacttaggatagttggtagagtgtcacatcagttgcaagtttgacctaattacaactgttctgtaacaacataaaagtattgtatcttccattatcccgaacataataagaaatacagaaacacttctcagttttctctctatttttcgcaccatttgttcaaacattatatgagttcatgtctcctacttcctatttaggacataccagaactacccagaacaaaaatcaaagtggttgaagcaatcaaaaatttgaaataaaatcaggacaataagcatatattatcctctaaacaattgacaacagtaatcaaacctggacttttgctttgtctctttctcttcacttccaactccatcaggatttaatttcttacttatttctgcagctcgggctgctgctaactccgtggcagatttcatggttgcagcccgggtagcagcctgctgtgcagccatagattgttgcataagcagtgcttgctggaattgcatctgttgcatcgcaacagcttgctgcatcatcagaggaagagatgatgaagcaagtgaagaattctcaacagatggtttctgtggaagtgattttgccatttcaacatttaaagggcgccccccaacatctatgttgtttaatgccagagcagcagttgcctcttcagcctttgagtattctatataggcaaaatgctttgaatcagtgattgcacattcaacaacagtgccacagaatccaaagagttgttttagctgttccacagtgagaagagggctaagattgctaacttgaagggttttcttcactgcatcatccttactagccttttcaggtgaacctattgtggtagcaaatacaattagaagaaaaaactaggaaacagtaaaacacaacaacaaaaataacatcacagtcaaatatagtgcaaaattaaggagagagctttcatcatattagaaatttagaattgtgaaatgataaacgtaccactaaaacaaaaacaaaattaagataatagcataccaatggaatcttttgcagactgagcttgcacctgagctgcatgtgcttgaagggcttgagcagcaactattgcctgagctgcagccattgcagcagcagaaggtgccataggagcttggctaagtgttcccattgaggttgtcgcagccaaggcagtcattaacaaattatgaggtgggtgattcaacttgcaatcaacttttgcacaacgcccattaaggtaatcacgacaaacttccccaagtgaggccccaattccaggcaaaatagcaccgccagaagctccagcaacaacccctggaatcattcccaacaatccagggaatgcccctgaaactgacccagagtaattcggcatgttgggcatagtttgattaacaagatttggaaatgaagatgcaggagctaaacccagcggccctccagtactattacctacaaaacaaatcaaagcattggaaattgaccaccacgaagatcattcaaaccaaaatacacgcatatagacagcgacaaggttatcaacacaacactccgcctatgcatagccaatctcaagccaatgtaatgggagagggttatgttaaacctttggcagccaacacaaaactcattgatattagatatactaaacacagatcactcactacaggtaaccatggtgtcattgatccatgtagccaatctcacttggtgggataaggcttttgttattgtttgttttatcactactcataattacatcctagtcaaaccaacttattattatacatataaaaggcaaccaagtgaaactgctaactaaccaaaccaaaaacaactcaaaacaaccacatttgaggcaaatgcatatactaaattaaaaaaaaaaagaaaaaaagaaaaagcaaaaaccgtaaagcatatgtagtacctgctgcactgaaaaacacaggaaatgggctccccatgataggcctcccattacactcaacactgaccatataattccctctcttaggcaccacataagtcacagtatatgttccatcccccatatccttcaccatcccctcttgctcagtccctccaacacccaacccgggagtcaccctcacctttatttgcgcaccaccgccggaaaccttcctctcatcggcgtccttagtcaccaccacaaacgaggacggagcgcacgcggttccgccagcgatcccggtccccgcagcggtgcacttggcgggctccacggggccaatgggcttgtgggccaggtcctcgtactcctcctcggagtcgctgtccgattcagcaacgctccctcctcccttgtcgtgtttattctccaaagccttgaaggtggcctcgaaagccgccttcgccgccgcggccttctccgcctcgctcttcagcttcgcctcctccgcctgcttcatccaaatcggcttcgcagcgcccgaaccgcgatcacccattgaaccctaccttcgaaaaattaccaccaatcgctgatagataaatactagtaaaacctaatttcggggggattttcgataaattagtgcgggaaggaccctttcaataataataatttccaagatttggaagattaaagagagagatacagagaaaaggcgttgaagtgaatggattttgagggcattgaaatgattgttagggggattgacggaggatggagggtagattgggaaagagaaaaaatgggaggtgtattgtacctgttcgttgttgtgacggctaagtttggtgctggagcgttgggcttgggcttgggcttcgccttctaacgtctgatggtatgggaaatggagtcttgcttcctacatcagcactttttctaatacattcaacatatttttttattttcaactttattcttatagaaatcgacaattcgtaagaatcatatgaattgtcaatccatatgatccgtatgagtcatacggattgacaatccatatgaatcatacggattgacaatccgtaagaatcatatgaattgacggattgacaatccgtatgactcatacggatcaacgatccgtaagaaatcgaatggtgtatgttaatatgcaacttacggattttaagaaagacaaaatcgatattacactgtacatgttgggtgtattaaaaaaataactagtgtagaaagttaaactctcaagaatgaataagggaaataagatgtataaggaacatgctttacaacatgttataaataagactcattatattttcagaacccaaaattttaaacacaatgaataattattttttattttttttattttcctattacattacattatgaatcaaatcaatcacttgtctctcatctcttccttcctttcttaagttgtaaacaactcaaaattgcccaataaataaataattattttttataagtggggaaatgttgtaaattaaccctatattacacattaaattgttgattgggaatttaaattataattcatgtattcatataattcttcttctaatttataatttaaattatattatctagtgtgaatttattcatagaaaaatatcaaataagaagttttcttattatgagtaatgagaactacaaatataatataaaccattagattatatttgaacggttgggattaaacaaaaatgcacatgatatttttaaaatagttataagattagaatctaatattttattttgatcatctatatatgggatagttgtgaaatctggtccagtcattgatccagacgagatagtggatcagtaggttagtgggtcagcggtccaactggtgggccagtaattggaaaaattgaaaaaactctgtcgggtcaaaccgattcaaccaaaaaccaagtcggattttaccaggtcaacctgagtcggttccatttccggtccaaacatggaaacgacccaatttggccaccgagttacgatccggaccgtttttacaacactaatgtatggttataaattttaaaaaattatagttattacttctcataataagaaacgtttttactttttcacagttgtgataaaagtcgttgtgtgtgtttattcaagcatttgagatagaaaaagtctcttgtaggtaaaggagacataaaaaggataggtgcatgaaactcctttggatagtttgagaaagttaagaatgaaaaggtgataaagcaatttgaaaattcatcttcactatattgatattttttaaaacatcttagtgccttaattatgtttgtcattgttttagttcttttccatcaaatacgatttttatgtgatgatgtgataatcatgtgacttttcatgtaaattactagtttgatataatagtcatgtgataaaacattgttggtttggaatatttttccataaggcattataatttttttggccatataaaaccaccagcaaaaaagtttgaagaattgaaaaacataaataaaaaagatatgtagtaagcaaacgcagcaaccctcaatacacaatttagtgatccattgaaccatatttaaaacacaaaatcaacaactcacactaagtaaaatcagctaaaataagcaaaatcactaatcattgaatccatgaatcaaaaccctaagctccataactagataatccataatatttgaacccttcaaaccctgattccctaattcacttcttaagcaaacactaaacccttccattttaattttgcttgcacaaaccatttcttgatatagtttacaaaaaaaattacacgtgaatatcacattacttgataacaaggagcaaaaatgttaatagagaaataattcaggaattagaaatgatcaaaagtttgattaaggactacaagcaaaaaattgaaaagtttagaaaccaaaaagatattaaaccctatatatgatttatttaaattgaatgtactttattaaaaaaaaatacataattaaaataccaccagacataaataagagttacatattgatttttatgatatgaaaccaacataagataatatcaaaatgatataaatttatcaacttttatacattatttgaatatacatctgagtttttctattttaaaataagttttataaaatattttttagtaaaaaaataaaaaaaatgtttgatgtagattttattatataagtttggataataaattttgtaataataagtttatatgtaaaatttattatattttaaattttgctactataaagtatgttttatgtataattcattaataatattatatattatattaataattgttttcaagtctatttgttttctttcttttaactacttttaaatatatttatgtaaaactaataataattattgaaaataagcatatttatatatattagtcaaaatttaaaataattcataataatacattttataattattgtataatctaccttttctatttttttcagcctttccattataacgcccgagacttgggagttgtatatcctcatgttgtcattaggccaaccataagattaataatggaccttttatactctatctaacttcatcgcactaacgtgcttgatcacgtgaatcccttgttctcgtgcttgatcacgttattatctaatcatatcttatcatgtttaattagtctttctcggaacaattatataatatatttattaaatataataaatatgccatgtttaataaacacaatatttagtaagattattaatgttatttatattttatatttaataaaaacaacaataaatattatataaggaaattcccattcaaaaatatgtttctataaattagattttttaaacaataacaagaataatatcacacacacacacacatatatatatacatatagataactgttatactaataaatttaaataacagttaaatattatatttaaattccaccactcctgttataaataaaagttcatgctgcattgaataaaagtataatatatttaaatgccattacaaataattatatacaaataaatttaataactgttataactaatactatatgagaaaaaaaatacttacattttaatattataataataacactaaatattatattaattaatatttattcacaagtttaattcatacacacgcataagcacgcgcatgcacatacttacccacgtgtgtttatatagaatacattatttgatcatatatttacatatacaataaaattgacttttgtattaatttagttattaggaatgatttttaatcaattgacccacagttaaaaacaatttcttcatatatatatatatatatgtgtgtgtgtgtgattgtgaaacatgatatactttttaagttattattaagatacatgactattagtattgattattctttaacaaatactattcttataagattcactattactacatgtaggggtggaaacaggccaggccaggccaggcttgattaggcctggccttggcctaatttaaaaatataaagcctggcctagcctttttatctatcataggctttttttttaggcctggcctagcctatttaaaagcctggcttggcctacgagcctattaaaaagcctactttaaaataaatattatatattaaaaaaaatctaatgactatatagtaaaacttcgagaattcgcataatacttttgtaaatttaatataaaaaagacacatattcccttttaatttgtgcgtgaaaaaaaataaaattaattagagcactctaatatgaaattaaaatttactaatcacaacaacccaattaataattataattggaatactttaagtattcaacaaaatattgtaaacaaaataaacaagctgagtaaaataccataagtttaatatataagagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaaagattgatttatatctttttagttttaatatatatatatatatatacttttatttttttacaaatctattatagtgtttcaaatcttctattttatttttatcttttaagtagattaggttatttagattttttcttttttaaaaagattgatttatatcttttaattatatatatatatatatattaaataggccagcctgataggcctaacaggctttttttaaagtctaagcccggcctttttatttaaataggcttttcaaaaagcctaagcctgacctttataataaacaggccaggccaggccaggccttaaataggccaggccaaaggcccctgataggcggcctggcccatttccatccctaactacatgctactgactctgaataaataaaaaagccacacacaacccagcacaaaatcgtaataactattactaatacaaaaggtctcagaaaacgtgagttgcggagaggcctaatttgaggtaattgtttctgcaacgcatgcgtgacacccatacagttgcgtctcgtgcctccattcgatcccaattccatgatctcttcctccctcacctttgacatcaacaattaaggcttcaattttcatgcacagacaacccttctctttagttttgtgcgagtcatgattttctagccataaagttgtatgtaaggtgcccaataaggtaaatagcataccccttctaatgtttggatgtttctatgtctatatatgcatatttcatgttatacaattcattcaattaattttcttgttaatgcatttgtacgttgaatcaatggcttatagggtcaagggattgaattggacatcttggccctgcaattgttcgtatcatcaaaggatatttttttggatatcatttacatgatagtgacaaatgggggcgtcttctgacaacgtaactgggtttgttttggctgtctcttccagcattttcattggctctagcttcataataaaaaagatgggccttaaaaaggctggtgccacagggaaaagagcaggttcatgtttcctcacatttttgtttttggtttgctaggtgttaattaccctttctttaatcattgatatatatatatatatatatatatatatatattgttttaatttgatcaggtgcgggaggacatgcatacctatatgaaccttggtggtggtttggaatgatctctagtatgtgatttttagttttttcttaaaaattattttggtgctgcaattactaaattataatatatcatgtggcattttacctgctaaacacatttgacaaggcctaatcataagctacctattttaatttaaaagggatttcttgtgacccattgtattgcatgtttgatctaattcatctttaattttctgtttgtatttattgtattacttcatgatataggcttgtgttgaaaaggtgtctcgtttgttgtctttatcagctaatttgacattttacaattaagattataatggagagtgaaaaaagataaagtgatgcagaataatttctatcacatttcaagtctagtggactaccaaaaattcttgaacccaactgatttaagtttaattcttctaagacaaagaatttttttttattacttttaacttttaagttctaatactttgactatgtttccttgactttggattcaaatgtctttgtacatacatataaatttcatagatataaattttgtgctacatataaatttcatagagcaaattttcaattataactcttagaactctgtaactataaataacaacttgctaatgtccccgacaatcttatgaaaatttcatcaactaattctatatgtatgcttacatttttgtagtgattgttggagaagtagccaattttgcagcttatgcatttgctcctgcactacttgtaactcctttgggagctttaagtatcattttcaggtaaggaacatggtattcttcataacattaattattaggatgtttctgctttctttgacacagatgtagatgcacatcttcattcatcaaattttaatttgggtgctgcttgcattttagaaagttacaaactaatatcatgatgcagtgcaatactagctcactttatcttaaaagagaggttgcacatatttggtgtgcttggatgtgctctttgtatggtgggatctacaactattgtgttgcatgctccccatgaaagagttattcactctgttaaggaagtgtggcaacttgctacagaaccaggtaatattcaattcctgattgcttggtttcaacatatcttttaccattgaatcttgcaaaaaatcaaagtaggaggatacaagatgagtgggatgcatattaaggtcttaatagattcaaggcattcatttatggttaacgaagctgacattgagttctttccttcatcaacaggctttctaatctacatgtgtatagttgtggttgtggtttgcatccttattttctattgtgctcctcgatatgggccaacctatctggttatatatgttggaatatgctctctcacaggctcaattacggtatatcgattatgtgttcaatgctcatatgtgtcatgtaggtcacaataaaactaccctcgataaacctaatgttgttccttgttgcataggtcatgagtgtgaaagcagtgtcaatagctatgaagttaacatttgaaggcaacaaccaattcatttactttcagacctggttctttacgattattgtgataggatgttgtcttttgcagattaactacttgaacaaggtaaactttgacttacatatattagtacatttactgttggcagtcattgtaatatgtcttccaaagtacaacttaaaataattatgtcaaagttaaatatatttttaattttttttattggttattggagtgcaaaagttgaaaacactattttgatttttctctgaccttagtgattaggtggtaatttgtaatgcttaagaaatttaactatgcttttgcaatctttgggacttctatcattatctaaatgaccatgtttgcatttctaatctagttcgtggcatttcgaaaagttataaacaaaagattttgtattgtttttcttaattggcattgaactatttcatttcctttcctttgccgttatagatgagtaatacttaacatgcaatattttagaaatggcatgccatattttttacattagggatttccaactaacttacaactgaacttcattttagtattcgctttagactttctttaatagttaaaaccaataatgttagaatcattgaaataagtgtgctgaattagtaatatgcttatcagttatcaattatattgtaatgctattttatttattttggaatcatgtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatacttttgtttaaaatgtacctgatgatgctactaaactatgcaatcatatagtagtttaaaacaataacaacaacaaaagcctgtttccactaggtggaatcagttacatgaatcaaaagatatcattgtgttttgtcaaaaaaccaattcttcaaaaatgctatttaggatctaaatcattttaatatatttttacttggagtttctattagtattcctctacttagttttaactattggcgatcacttatcttatcaactcttcatatagacatatggttgtttatggaaataaaacacaaactacctcttttcttgttgtgcagggaaaagtaaaactgaaatgagaaacatgaaagtgtgagaaacttagtcatccatagtattggaccaatcataacaagaatttaacttgcataataatatcaagttgaatacaagttttgaagaacttggacacctaagatctattaaatcagacaaactgaatttaagattatatcaatgtgtaatttcatattttgttttaaaagcatgcgtgtttgtttgctagtacttaatagctgaaaattctaacacataaagtttattttgtttatttgttattgttctattttattattttaaggaattttttttaagaaaaaacgaaatgacatttaattctcacagtatatttcatggcatgattaacgtctacaattgtcaattgatcaattatcattattgctattgtcttgttagactcatctgtattattatgagtcttaaataatatcttcgtcggaagtttgcaattggattgcaagtcattatctgcttttctgctttatttatttgctacaggaatgggacacacaagatgcatctcaaattgctactgaggtttgtggctttgtcacaattttatctgggacctttcttcttcacaaaaccaaagatatgggaaatagacccatagagtctcctgtttttatgagtactccacaacattctagtagtcactcagggacttaatagccatgcctttttttttaactctggcctggacgacaatgttatttcacctatgttcccaagctaagcagacagctttcaaatccaatgaagattaagctatggtatttcaaggagaagaaggtcagtgaatgagtggtattggatggttctaacaagcttgtaatgtcagaaaaggcaaaacagaaatatgaagcgtaaaagattacaagaagcatttcagacaatattagagaataatgccgcaatttagtttcttgtaatatttttttccctttaacaatttctgagcagcttatttttatgtgaaattgtgaatagctaatactctaaagttagtcttcattaatatgagatcacaatttgcaggtcctattatggtcttcatatacctcaatgttgtcctgattcacgagtaaaagaaaaaaaaatgaaatatttatttgagtgagagtacatgtatatttagatctttaaaaaagaataaagtcaatttaagaatttctcttctagctaggccaaatttaatttgattcaagagtgaaatagaaacttagaaaataatagcaaattactattgagtaagataatttgttactcattttcattatactatgatatagttatgtatgcttatagcaagatcatatactaatagaatctgagctgagataacatagtaattgacagttttcagatatctaatacagcaactatcagataaagagtttaaaattcttaagacactagaaagttctttactcttaacattccgccctcaaattcaagggggacttgagctaaagaaaaaggatcaaccactctaagtttggtgtacaattcacgaaatcgagtactttccaaagctttggtaagaatgcacacaatctgaccaaggcgcaatctttcttcagcacactttctatgacaaaaaggagattgaactccatttgcttagatctcaatgacaggatacgagtcaaggacactatcctaagattgtcgtggtaaacaaacgtagggggttgtaataggaaggtaaagttcatgcagaagagactgtatccaagaatttctaatgtggtgttggccagatttcaattttcagcctatacgtttgagaaagcaacaaaggctgtttgtttgtccaccaagagaccatgtttgggccaaaataaatgtagaacacaaagatgtggaacgatgatcatcttaagcgcaatctgcatcataaaaaccaaaaatgaccagctgaggggagtctgggacttgaaacaagttgcaatattagcccatggtgaagggtccctagcagatataggtttgaccactttccaatgacctagtggtcgagagagaaattgacatattttgttcacaatatagctaatttcaccaaagatggacctatagaggtgagggttttggagaaaatcaggtacaaattgttagagtttgcactttgcagcctttaggcatagggtgaaggtaactttagctgaggacatattagctttgtccaaaaatgtctctaatatatcttccttaagatagaaacatagaatcattttcgagatacatgacatccatacccaagaagcagtccaaagtatcccagtatttgagagcaaatatggagcttagtttggttatatactgttgaatcagatcaggagaatttccagtaattaaaatatgatcatcatacactagaatttatgtgcaatgttggggaagtggttagtataaaaagaaaagatggatcacacttgcatgagttgaatcaagtcctagtaatttagaagcaaagttagtaaacctttaaaaccacgccatgtgtgcctgtttcaggtcatctaatgccttatgtagcttgcatgcaagcagtctcaaagcccagtgcctaagccctatagacttcttcaacaagaaatccatttaggaatgcatcatcaagttgctgaattgtccacttgtcagtgaaaacaagagtgatcatgatcttaatcgtgacaagatttacaacaggtgagaatgtttcagtgtggtcaaaactatgctgttagtggaagccttttgcaacaacatgggccttgtactttttaattgacccaatagggttttctttgacttgaaagatacatttacaacctacaacttgtcagtgaggatgaagaggaaccagggaccaagtctttttaacagtaagtgtagaatattcatcctacatagcctatttgattgaagaaggtttaatgagagtggttaacagcgtgggcttgtgaatgccttacttagaccttgtttgcataggaaggatgttttgacttttgagccccaatggaggaggattagcaacaaatctgagaaagtagaataagatgaaggcatagaaagagatgatgatgtatcttaagataaaggttgaggtggaaaaaaaggctattgtatgtgaaggatgaaaacgagggtgagatgaagtggtgaaaagattgtatgtatgggagaggtaaagagaatgcggatgatggggtagtggtagttgaaaaataaggactgataggaaaattttagattcgctgaatattacatcttttgatatgtagttatgtactatgtagaatttgctatcaagagagacacttacagcctttacgtagtgcaaaataccccagaaaaatgcattcagttgagtgaaaagataatttatgtgcatcatagggcctcatgaatggataacatgcacaacctaagaccctaactaaaatgatagtctggagcagacttgaataacactgtatggtattgcatcgttaagttaggaaaaaggaagatgattcattagacaggtggggtttagaaaagcatgatttcttctacagaggaccaccacacaagcctcttgtaactgctaacactatgcttggatttatgttctgaggtcccaaacctacgtttataaaagaaaaacatattttcatacagatctaattaatggttcatttcatacactaagaaaatattaaattatttctaattaaattaatggcaacaaatctaatctgtcaattcagaaaataactctatatactgatttaaccaaatatttaatttgtcaaggaccagtccatacatctcaggaaataactctactaattctaaccttggataaagtggtgaagcagttaactatggtaagctcaataatgcaaggtgctgtccgtacattttgtgtcgactatgatttagttctttcagtaatcaagttattggaactacattttcttagctattatgtctttaatacttatcgaaccattatgtataattttctctctcagccagatagatatataacgatacacaaaactttaaggcaaagctgaccaagttaagtggcacaactctctttacacaattaagtcataaatcagattcacacagttctacagttcaaattatagtaagtaacaaacaacatttcaatgaagatgaaattggacaaaactattcactttgcaactgtataaatcaattatatgacatgttcttatttacttgtatacaaaaaaaaaacaagcatgtgactgaggaaggcaggcagggatgaacaaaggaaaagaaagaataaatttttcaatctgaaaagataaaaataattaaataaataaataaaagaatttgtggtttgattagacagtgtggagcacgacagtctcaagtgagtccgggacaaaaccaaaaccaaagagcacaccccattcaatgccttcaagaagtccattttccgtagatttcttcctcgtctaatccaagatgaataacacatgcacttgacattattaccatactagctgagcacatgtttagtagcttccattttttcaggcttcaagcctaacttagcctggtctaaaattggcgatacatcacgtgtgcaattcagaagataaagttgtaatcagagattcccaagggttggaaggcttcaactatggccttatcgatattcttagagatgaatccaggaaaggagacaaaaagtgagtccaacttcgcgatggccaataatagccccttcagtgtaaggatagtttgtgcagtccagaaaagctgaaacaaaggcttttcaattggtaaggggtctgatccaacaatgacaagctgcaccatctccaaacaaggcttgacccacaaggctatcaatatgggtgttgggccgcaagatgtgactgcggtgatcttagaacaaacgaaaagcaagctagcaccctagttgttttcggcaaggtctttggccagaagaagcaccgtgccattggcaaagcagccttgttggtacatcatgtaaatgcttgacggagggacgaaggccttgtagtttggtgagctggtaatcaacatttcctttactaaatccaaattcttttgagttccaaaacatctcaagtcttcaatctacaagctccatatcaccaacgtgttggtggctataacaatggtatggcaataatcatctgatgtggttgagaagattgtgttagttgtagtgaatatcttgatgtatattaaaattttaaaatatttaaaatttttatttggtaaatcttatataaattttataattagatgaggttttaatttgaattttaaatattttaatattaacttttaattttaatctaactgataatttgatgataaattggtgtagtagattaaaaaatcttcaatccaattgatccaactctaccaaaccttgcttttccctctctatcttttaataatattggtgactttttaatatttcatttatcttttaaataacttctaaaatattttttgtttaaaaattaaaaaaattctatccaattacttaattaaatcaatctaatttttttggaccgattaattttgaaatatctaattgatttaaatctattttttttgtcaattttgagattttcaaataaaaataggtgatgtaaatataatgtaattagcatacaatataatgtaaatataatgtaaacatcatatgttaatttgaaataaaataattggtttaaatataatttacataaaaataggtgatgtaaatataattgataaaagttacattatatttcaacaagttccatatacctagttagcatacatgattttgataatatataaatataattcaacggttggatcaataaaaatcatattctatatcaagttataaatataatatgataattgtcaaaattacatcaatataatttgatttctcattattataaatatatttaaaaaaaactagtttgtaaatagcattttggaaaagagctgaaattgtaattaactttcaaaataaaagatgtttttaatagatataattacataaaagtggttttatacaaatatttttttgtatacaatcttagagtcccttcttctaaaagtttaaaccattgaattcttagatgggacatacatggtgatacaagtggttgatgagatgtgttctgtgaaagtgatttttgaaatgattgcaaatcagtgcatgggataagactaaccaaagaataaaaactaaaaaggtattttcatgactttattgatgactacaataaagtagcaataccttgaatgaatgtggtcttattcacacaaagcatacccataacagagtagtggattgtagagaaaaattaacattcacttttcatgacatgggttggatatatgagttaatctcatgaattttgatgtacagttcttgaccaacatttagtatatcatgtaattcattctttaaataaataaaaaaattattttctcaaataattttttaatatgtgctcaataagaatcaaactaacaaaattcaaatattaacaaaatggaagaaactaagaaacaattaatttaaaatcattaatgtatcatcaaaacattctctttgcatatgataagaatgcatacaatatctctctcttatatgtgtataaagtggagcttatggacaatgggttatgtaatttttttaatgtatcaaggtaattgtccaatctcaaaatagaagataaaactcaatcataatagaaaaaaaaatcacaaaaaagaaacaagaacattcaaatcgaaaaggaaaaagaaagatatatgaatcctcctcaatctctatccttgtgttgttgcttcttcctcaattttccttaattatggattctttgaaataaattgtgaaagtctattttaactcaggatctaaaagggactaagcccataacaattaaaacacagaaaataaaccgaaatagagtgtaactttattagaaaaaatgagaaggagaagtaggggtgaaaatagatcagattagacttgcttagacatgatttaaatacataaacctgacttgacttatttacttgttataggtttctttagactttgtctgacgtatttaaaagtctagttctaatcttttttactttcccttcttttcttttctttttcattttatcatctttctttccttttttttctttttctattatcttcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatattgcaaaagccaaatggtgggtgtttttggattggatttttagtatggacatctgctatctgttttcattttttatttttagtcaatcttattcaaatagactatgatcattatgaattggatcaaactagttttaaggagaaaatttatttgaattggatcaatctaaaattatagttttactttctttataaatatatattgaatataataaatgaattgattttcaaaataaactctgaaatctaatccaatctaataaataattttgctttctttatttttttctgttttaatttgattagattgaactgctttatgaatattctatgaaaatgtcccannnnnnnnnnatgtagaatgtttaataaggttttctattttggaaagcttcaatcaagccctttatttttttaaatgccataacacgattctttagttttttttttaaaattttttaatgtgattctttctgttcaatttaacatgaaggcattacgtgaaaattttaatagttttaatcaaattaaattataaaaaaccgccactttatttatttatttattatttatataagtaaatttattaagataaacctttttgttatctttggataagcaatttgaatgacaaaaaaaattaaattttcaactgaatatcaatttatctagttgcatattaaattcaaaaaagttttaaaatgataagattttcataggaaatattttcaaattcaaaaagagaagataaattatttatctattatatcaatagacgttggctcctaaaaacactaattaaatgaaatgcgacttggcggcaaattttcaaagaaaccagcgtaagggctctgaataagaagcccgtgtttacgaaaagaaatgccattgacttgagagtttgaagctgataaaagtaaaaaacaatgtctgggtttcctcagcaacataataacgatgggagtaatgatgaggtttatgaatacactcagttctttgatttcgacaccgagccgtggcagaacctcgatgatgcgtggtggacgccgaacgttgctacccaggttcctctgacggaggacacccaacaccaccaggaatcgccgaacgttgctacccaggttcctctgacggaggacacccaacaccaccaggaatcgccgaacgttgctacccaggttcctctggcggaggacacccaacaccaccagaaatcgctgaacgttgctacccaggttcctctggtggaggacacccaacaccaccagaaatcgctgaacgttgctacccaggttcctctggtggaggacacccaacaccaccagaaatcgctgaacgttgctacccaggttcctctggcggaggacacccagcaccatcacacattggcccaccacgtgaaccagtttgtgtcggctccggtcgagttgcccagccacccagttgaggcgctggtgcataacggtggtggtggttccatgatgcagaatgatgcaggttcatcggttcggcgcaagagagggagaggggaggcatggactgaagaagaacacaggtagacttttaacgttgttgtaatttttggataatattgcaaaagccaaatggtgggtgtttttggattggatttttagtatggacatctgctnnnnnnnnnnaataataataataataataataataataataataataataataataataataataatatcatagtgaaagttattattgttcgtgattttaagtatatcttttcttcatttacttagtgattcttatttttaaataaaaaaaaaacagtgtcaatttttagtcatcacatattaacttaactgttttaaaatttaaaacattgacaaacactaacatttttaacgaaaaattaaaaaaatatatttttaaaacataaaacaccataatgaaattttaaaaacataatatataaaagtgaaataattattaaacataatatactaaaaatcactttaaactaatttaaaaattcatggtctcaaagtggggcttttagtatgcataattgttctcaaataagaatacatggtctcaaagtaaagctcccacgaacaacaatttgatcggaaattggagagttggtataattttattattttatcatgttaccatgatgtaagtctactttcagaagaaattgtgaacatcaatgaatcattttttcctgtaagtttaaagtattgtatccctgaactttttctctcatctaacttctccaaaaattaaaattaaggtgtataaattcactttannnnnnnnnnataatattgcaaaagccaaatggtgggtgtttttggattggatttttagtatggacatctgctatctgttttcattttttatttttagtcaatcttattcaaatagactatgatcattatgaattggatcaaactagttttaaggagaaaatttatttgaattggatcaatctaaaattatagttttactttctttataaatatatattgaatataataaatgaattgattttcaaaataaactctgaaatctaatccaatctaataaataattttgctttctttatttttttctgttttaatttgattagattgaactgctttatgaatattctatgaaaatgtcccacattgtctacttgagcatattgttttcattggttatatatcaacttttttttaacgattcgtagttttcactagcctccaattggatcataagtgttctcagtattgaagaatacaaatattacattgtttggatttttaatattttatttttctgttatatgttgtattctcaatttgctgttacttttcaactaattctggtgaaatgtttagacgtgcacagaacaaattttgttcctaataaatttatagagaaagaccaaaatcccttgtgaaaaatcttgcttatcaaacatttggattgtattattttaatgtattttatagaactcaaatgaactaaaacttatcaaattttcatctcatatttgttttttaatggtaggttgtttttacttgggcttcaaacatataagaagggagcatggacaaaaatttcaaggcatgttgttaaaacaaaatcttcaactcaaattgccagtcatgctcaaaaatacttcaatcgtcaaaatgcctcatcgtcaacaaaaacaagaaaaagcattcatgacataaccttagatgacacaaatagcgctcctcatcacattgatccacataattcaattcctcatccagatcaagacattcaacaagttcacgaaatgcaacaaatgttgccgctgaatccaccaaacagcatgcctcatcaaatgagtggatttgaatattctgatattgccaaccaacatgttcacgaaatacatcaaatgttgcggctgaatccaccaaacaacatgattcatcaaacaaggggatttgaaaattctaatattgcatatcaacaaattcatgtaatgcaacaaatgccactgaatccaccaaatagcatgactcatcaaatgagtggatttgattctgatattgcatatcaacaagttcatgaaatgcaacaaatattactagtgaatccatcaaacagcatgactcatcaaatgagtggagtgaatccatcaaacaacatgactcatcaaatgagtggatttgaaaattctgatattgcatatcaacaaattcatgaaatgcaacaaatgccgctgaatccaccaaatagcatgactcatcaaatgaggggatttgattctgatattgcatatcaacaagttcatgaaatgcaacaaatattaccagtgaatccatcaaacaacatgactcatcaaatgagtggagtgaatccatcaaacaacatcatgactcatcaaatgagtggagtgaatccatcaaacaacatgactcatcaaatgagtggacgcggatattttcacccctaaattgtgattaattctttactcttagcatatattgtggtctgtcctaaggtgtagcagtagtgaacttataaagtaattagggattttgataattgcattattggtgcaaattatatttatattcatttgtcattttaggatgtgagatgcgaataaatataaattatctttatatgcattttttttagtttgatataatttgagtttctttaattcaactaagtaatattattgccatagattttatgaaaatgtgtatgacttttctttgaaaaataaataatatgtttcttttatctcttaatctgcaacttgatctgatttaaaattattcttggacttgtgggatttagtagtaagtagagcaattatattcggtgtcattgcgtttagatgctaatgctctattagagatattgcttgacataatacaaagttgttttgccaccattctatttttggaatttcatcatggatatgattctttaatggtagtagagattgtggtctgttttaatgtgcaagagtcatgaattttctttcttgaggtcatgatgtatagtttgagcttgtgtatccaaatgactggttcatttttcttgtttttagagccagcattttgaagtgggataaacattcaaagatgtgagatctcatgactttgataacgtttagtaataatgttacaattcatttcattcttaaaaggaaagataaacttctattttttataataaattttaaagatcgacttaaatatattttagttcctaaaaattaaaattaatttttggactttatatttagtttctaataaaaaagttcttgacttctggtcctcaattgtatatatagataaattgtctgtaagcttaattgaattaataataatatgatacgttcttatttactgatataaaaaagaagcatgaggaaagaaagaatacattttttaaactctaacaagaaagaaagtaaggatttgtggttggtctttctaaatacaatatatatgattagacaatgacacaaagagcacaacagtctcaatagtgcgtccagggccaaaaccaaatagcataccccgttcaagaccttcaacagttgtgccaagtccattttctatggagttgttactcatctgatccaagatgaatagcacacatgcacttgacatattaccatattcagcacatgtctagtagcttttcaggtcgacaccgctggtggtgcaaaagatgagatgggtaatcttggacttgggttgaccccattccttgattgccttagttgcagtctctcttcccaactttggtacctccacaaccaccgtgtcttgccttgcatccaatgaaggtgccatataagcacaaacactcggattctccatcaggatctcttggtttaattacatgcatcgcttcttaatcattgacttatcatgtattattagtatgtattactaatcaaatcaaagatgtatgttgaaaataaacaatatacatattatataatgaaataaagataggctaaatgagagagagatataccttacacatgcgcttgaacttttcttttgagttcggtcatgtgtgctcactgttggtgatgcggaaataatagtcaggataggtactctgatcgacgcagttgggaggagtggcggtgccaatagtcatgacagtggcagggccttcaacactcaccaaccaaatgaattggaaagggaaggtacattaaggtagatgcagggcatgcttccttcctctgactgggcttgtggtgtgcacccaccgcatgtctaagtagactgctgactctccccttatagttatacttataccaacccattttttctgtttttttctttcctaatgatcagcaaataactgtttttttttttttttctttctccgtacgtctttgcaattgctagtcataattttggaattacttttctattgctgctttttaaaaagagtttttagaaaaataattattttcaatcacggtgttgtttttcgtttcccctttagtttattatgttataaattatttttgctttcacaattaagttttgaaaattttatttttgtcttttatgtttttgaaatgtatcattttgatttttttttcaatttttcgttagaaatgttagtatttcgataatttttaaatttaaaaggatcaaaatgatacattaaaaaacataaaggacaagaatgaaattttaaaattgtgtcaaagtaaaacaattataaaatataatgaatcaaaagtagcattaaacattttaagataattaattttacactatggaggctaaaaattgccacggtctttgttttattcttaaaaaacaaataactaaaaaaattatcatcttcttcaacctcttctagatctaaaaaggtaaaaaaaaaagtgcagcatcacatatatggaatgacgtcaacacataatcttgttagaaccaccgaaaatttgtatactcctcactagaaaccaaacctttcacacaattatgctataggaaacataagcaaggtagatcggagcaagagttctcttcggcgaaagacaaaaacatggtcctaactccccaattaatccatatttgaatgaggaagtcaccatgtggttctttgtgagatctgcgagcaaaacctccactattgtacacgtttgagttggacaagtagaggatttctcagttgacatctacaatcgggttgagcgaagacaagtagcacaaagagggcccaaacggtgtatttttttggaagatgattatatctaacttgactgatcaaacctcatctacaactggatgttgtcagtattcttcttcgccttcatcaacgcgctactgccatcatggtaatgagcagttgttgttaggtgaggcaaaaatttcagttgtataaggaggttgcaatggagacaaaagtgagggcaagacaacagtctttatgcgttgacgtgaaaggtggatcgacaaaagaaaaatggacccttacccattgtgattgagaataattagtgaatgtaattattatcgttattaagtaattaaattgaataaagatgatgatgataacaacaacaacaacaacaacaacaacaacaacaacaacaacaacaacaacaacaacaacaacaacaacaacaacaacaataataataataataataataataataataataataataataataataataataataatatcatagtgaaagttattattgttcgtgattttaagtatatcttttcttcatttacttagtgattcttatttttaaataaaaaaaaaacagtgtcaatttttagtcatcacatattaacttaactgttttaaaatttaaaacattgacaaacactaacatttttaacgaaaaattaaaaaaatatatttttaaaacataaaacaccataatgaaattttaaaaacataatatataaaagtgaaataattattaaacataatatactaaaaatcactttaaactaatttaaaaattcatggtctcaaagtggggcttttagtatgcataattgttctcaaataagaatacatggtctcaaagtaaagctcccacgaacaacaatttgatcggaaattggagagttggtataattttattattttatcatgttaccatgatgtaagtctactttcagaagaaattgtgaacatcaatgaatcattttttcctgtaagtttaaagtattgtatccctgaactttttctctcatctaacttctccaaaaattaaaattaaggtgtataaattcactttaacttagttgaaagtcgactcattctacttccttattttcttcaccaataaattcttgttaagaaattttatccaaacttaattggaatatgtggaccaactttatcattaggcaacaacatttgataattacaaatcaatatagggataaacatggttgcaagtgaaagacaatgtaaatagttgaacctagttactgtaaatgttatggctcgtggttaaacaacaaagaatatgaaactctagtaaacagaactgaaagttgtgaatgggcattgcttgcgaatactcacccccattatctttatcttcacattggtatgggtaccaacaggtgggtatacaggaatatttctgttacggcatgagatgtgtgtataccaattattaatattgaataaaataaacatttatcaaaacatgaaaagaaaagaaaagtataaaaattctggtaaaattatgaatcaacttcattcatatgtcctactataatcttgtaatcaaatatgaagaagatccagtaactaaagatacacagcagaacatgccagagtataggtgagctttgtaagaataaaaatgtgaggaaaaaggataattaaatttaaatgtatatctaaatacatctctcaatttctttaccccataagaacctctttaaattttcattttaccaaacgcacagtaacacatctgacatgtgcataagggttaaaacaaggcaaggattaacttatagcagaatatttggaaagaatataggacatgaacttagctaaagtatagcaggaaacaataacaaagggtgaataagcctagatgtcatctgttgtttcattagcattacaatgaattgaattgcacattaaagaaccaacagaaaattactccttgaatatttttttcataggcttcagataatagatggtttgaatagaagcattaaagcatgtattggacaaaaaatgtggcctttacactcgcagcttctgagtttcatagttcagtacagacgaacacaaggaacaaaaagcattatttatatcgattagttacactaaaatattataaactaaacatagtatacaacaatacctaactgaagaaataccaattaagaatgcattcaacaattatatgcacttttcgccacttcttgtaacagaaatgttcctggactccccagcacagataaacaaaatggcagagatacatcatccatcaacaatgaattgatcttcttgattatctccctcaaccctagcgtcactgtgaacattcacatgatgcaaattttgcatcatttgtgaaagataatggttgctagcactagtatgatcagataggccagcaggttgggcaggccactgcgagaatataccaagcaattggttagtaagattttgttgctcgtgaagaaaacgagtctgcatctggcccatttctgctcggtgctggctcagcatctcgtcaaccctcttcttccattccagcctcctgcagttcattctctcctcccattccctctcatgaatcaactcttcctctctccttttcctttccatatctccgttttccttttccatggcttcccactccgccatcccctgcctcctaagcttgtccctctccttctccctctcttctctctccttttccctctcttcaagcttcctttcccactgcttatcaagctccactcgcaaattctccctcctctgcctctcgcgctccctctccacctcgcgctgctcgaaccgcgtctccatctctctcaactgccccagttggttagcaagaattcgccacgccttcttctccatccccttcaccaccttcctcttcttcttcaaacttgaccccgtcacctccccttcctcctcaaacacaaaaccattctccgcagcatcctccctctcccgaacaccactcccattgtaattcacctccccttcctccccctcaatctcaaattccaaccccatcacctcattgtccaccccatccaaagcagccccaaaatccccatccccagaatgacccatctgcccaaactcaaccatatccatccccccacaaccagcaagaaacccatccccattatccccatcacgatccccgtgatccccatcctcaatccccatcaactcattcccaccatgaccaccaacaacaagtgcaacatccccaaacacatccttatacctaaggaagttagaccaatgagtaagcccctccacccaatcaaactcactcccctcatcacaatcccctcctcctccggaccccgaaaactcaggcctcttgatcttctgcttcacaagcaaatactggtgccgcatgttctgcaccttcgtcgaaacgtccttccaactccactgccaagggtacgcaatgggatcgcgcacgtggtgcaccgaattcacgtgacaagcaatcggcttgaacttcttctcccgagtccgcatcttcgccagcgaaccgtccgccaccatctccccgtacttgtcgattagggttttctcctccgcctcggtccatttcttccgcctgggaggaatcatcggtaaccaataatctctacgccgacgctctcgcgatgtttttcctcttcttcttcctcctcgtctttttcttcctccgcgagcaccaaaaccttttccgatagcgattctgattgcatcgagaacgcgaagatcgtgcaggttgtttcaatttttatttttatttttatttttttgctttttcaatccacgattttaaccaagcgattaaccaatcgaatgattctctccgaaactgtaaaaataaggaaaaagaagaaggatggagcttgcttaccttttcggagggagaggaggagcggagtgattttcccggaaagtgaaattttctcaagaaaataatatcgaaataataagtcactggggaacgaatgaagtgacgaggagctgactaagggatcgacaaccgtgttcgattcccttgcaaaatttcaaagctgagactgaaaatttcccgaccaattttattttccagaataatagcaaatttttcagatgatttttgtttttgggtttgtatatctgtaatttataataattataaaatatgaaaagttttgttcagtcttgtgtacatgccggagtggttatcgggcatgactagaaatcatgtgggctctgcccgcgcaggttcgaatcctgctgttcacgcttttagctattctattttctgttactttgcaacgagatttcttgcatcctctaatgctagcngcatgactagaaatcatgtgggctctgcccgcgcaggttcgaatcctgctgttcacgcttttagctattctattttctgttactttgcaacgagatttcttgcatcctctaatgctagctagttttacgtaattacaactttgtaaagtttgtactacttatttttttttttttacttatgtaggagttggatttgatcaaatagtatttcacacttgcatattgttttattttttctaggagtaaggtattttatagtagaagtgattttgtttctcttaatatttttttttcatatacataattacaaaatcaaatttttgttaacatgttatgtttgaaaaattcaatcatctatcaattatgttaattttatcgattcattgtgttgatccttaacaccttatttatcaaattatttaaaaactcaatctaaaaaggatttatcttataatttgaaagtaaaagtgcaccactttatttaacactgttaactcaaacagtgggtttgcaggtgaaattcctagtatatttttaacatgtatccttatgcataatgccaaaaccttatacataaggatacaattaaaattgtgtatagtgtgttgtgtaggtgtttggcaattgtgtaaaatttcataattctactgttatggtctttgatcattggttatgaaagtagttcctttagataagagatttattagtaacgacaaagtaagaattattgaagaacgtaatgttacttattatgtctacataatatttttcttagatataaataatttaatgttttggaagtataattgtaaaatttagtttgatcattgacccagtcgagataatggattactggtccaaccgatggatcagtaattgactcgatttgacttaataaatattaaaaatctaaaattatatatgtatctattatatataaatatataactaatattatttgagtaagaaaagttcattcatattctaaaatccaaaataataattgataataataaaacatcaaaaaaacattgtagagatggttcattttttttaaaccagatggaatggaccagttcaacctggatttggtgacctaacctatcagatttgaccgggtcattacgggtcaattgcgtaattggtccaataataaaattggtctgattaggccaccaaagcagaattgaatcaatccaatataaatgtaagaattcagccctagttcatcaaaatatgaactatgcatattctaactctggtttttgctttcaatttcttacattttccttttttcagcagtagtataaaatattaaccagtttcattagtccattcttttattgcagcttattagaatttggatttaggatcaaattccacccaacaaaattgacttaaagacgaggattgtccaaattttataaacattaatttagccttatttttagtcaatgtaggactatatgtctatatctacccgtcacacctatcagaataaagatgcatgagacagcaaattaaggcaggccaagggtgtccgcaattaaggcaacacagttgttaaatgattttctttatttgtatgctcgttcattagtgaattgatgacaaaggattatccaatgtgttaacattaatattaacagcatattcctttccatctgtatgctttgtgacttttataactattttcttctacttcttttaacttactctcctatcaaacaattgagggataaagattactgatgatacatatattcttatttgaaacaatgttacagaattgtggcgcttttcttgagaaggatggagcagggattagaggtaaaataaagatcacaggattcgaaaatggagatatagatctttcaaaatcattatggacctatcaggtccataatatttaaaccctaaactgatccaaaagaacaatatgaaatattagctggtttttagaggaaaatactatttgatgtagtacactacagatgtattctgtaaatctgtacagttagtaaatatacagtaaatacaccggcccaagacacatgttttctctttctctggttttctacatggtaccttctggaatctggacatattacaattggtcttctgaattcaaatgaccaactagcaaacattttctagggtgagtcaattagttagtccatagatagtgtaagtactaggtgtacataagctatttaggtatactccagaagcactctctttgtaaataaaccggtatagttagtataaatattgtaaggactgaagccaaacatttgtgtatttccattcaataggttcactctcttattctctccagtgtgtgtgtgtgctctgtgatatggatactcatttctgttattttggctctttaacctttaaaataattagggtcagcaacaaaggacacatttcaatttttttgtattaaaaaataaaccacttttgtcaaagtaaataagaactgcaaaaggatgagtgcagtaattattgattatatgtaatccaatcagggcttgattttgagctatttgggaattcatgctttagagatgttttggtcttagtgtcttacaatatccgtaagcaaatgagaaaggaatttttttctcaatgtgcttgagtgttttttccaccaagcagattggacttatttatattcaagagtattccaaagataagcaacgcccaaacaatttaccagagaaccatgaagataccactacttcctaagatgcattaaacctagctataccagaaaaattctgatggcaggcagataaagttgagggaaaagttctgacagtgggcagaaaagtcatcggaaattatgacaattactggaaattttgctggagaattctagaatttttggacgtctgacagcttcaagagcccaatcagaccttctacagagaccattttttttgcagaaacaccccctctccccagattaggatctttaataccatgtgagaaaatggggggcaaaaaatctcaatgtacttgagtgtgttttctttccagaagaatgagcttatttatgttcaagagtattacaaagataattaattctaaaataatttagaagagaatagttaagataccactaccttttttttaaaggagatgccactacttcctaagatgcattgaacctacctataccaagtacctaggctacttgctaaaataaacattaaaagagctcttatctcctaaaatattcctaattccaacaatatcttaccgtagtataaattggattgagattctatgttcctgtataaaataggcttttgaatcttaagtttgggttacatgcccttgtaggaataggttgtttaagttgcctatttgagatttttttgtctttaaggatttcaaccttgccatggtaattaaaagatataaatttggaaaaagtattcttagttttgattatttgttcaatgtcagttggtctttctagttctgccttcactccaaagaaacttaaaatgctgctttaatggcatgttttcttggtgtgtctcaccttcattatctttattctaaatttgtactgttctataattttcatcttcatatcatcactttctatacttgtgagattgtacttttcatagtccgaggaatttgaaaaatactaactccactttattcatttgtatcccaggttgggctttagggtgagttttttaaatttttcagtgaagagaatgaaaattctgaatgggtagagttggcccctgatgccatcccatccacatttacatggtacaaggtaactttgagctgttgaagtgatatatctataagaactgttgtacagtgaaagaaaatagaaaaggaaaagagcctataagttatttacgttgattagttataaatataaaatcactcatgaacctccataagagcttaagcttcttagaaagttgattcttgacatggtattagtttcccccatgaccaaggcagaagtttgatactagttgcactctttttttctagataaagctagatttaagcatgccagaatatctgcaaaatatttataaaacgagaatcatgcataatgattaggataattcatgttataccaataattgtgtcacctaatttttaggagtcttagcttgttaggaatcttactttattcttagagattttatcgtttctttagtaagttatagttttgttatttacttagatttggaatctagtattagtattaataggactatttggttagcattttgtttcatgtcaaaataaatgataatattatttaaagtcttttttttctctcacttatcatatttctctaacaaaatgctcatttcaacaaagcacgaggtaaaatggccatccattgtccatgcttcaagtccaaggtgtcaagaaattttgaattcttggtttctttgattctgttctcatccatatatagtacaggtttcatttacatccgttagtgacacaaaaattctaattccaaatttgtacaacctaaattaggaagtctaattgtgtacaaagtacaatgaatgacctggttcgtattcctaatatatacaggaaacaataataatgactagttcccttattgacatccccgctcaaattgatgtggctggtcaggaagcatcaatttgcagataactgatgacgtggatgaggaacagccttgataaagatatccataagctgaagttgctaggtgacaagaggataggagataacttgattctccaatgcctcctgaatagccgaatagaatgacaatccatctaaatatgtgctcatgaaaaactagattagtagcaatttgtattacactagtattgtcggcatagaaatgtgttgcagctgtttgagacaatccaagctcagccaaaagcccacctatccaaataatttcagaacaagctgtagatatagctcaatactcagattgattgagtggaggaattagagacatgagactgctttttacttatccatgaaattaacacaggatcaagaaacatgcaccatttatgtttaagctacaaaatatttcctacagtagacaaattcatgaataatataaagtgtacggtcaatgaagaagatgattataaatttatacgcatgctgaagttctttaaggaaagcagatgatttggaatgaatattttatatatgcccaggacatttgtttgttctgtgttgcctctgaaattgttcaattatctatttattgtaattattatccccaacgcacaactacggagtgagtgaatctaaaatcatgatacactactgagattttatgaaggtgctattaagcccactggtcattctttcccaatgctatttttcttttttattcgaattcagaaacaacttctttgtatatgcaaggataagactgcgtacaatatctctttcccttaccttcatgtagtaggagcatccggataatgagttacatagttttttttatcacaacacaacaatttaaaaataacacctatttattttaagcagacatactttgatgtccctggtggcagagattcggttgctcttgacttgaaaagcatgggaaaaggtcaggcttgggtgaatggtcaacatataggaagatactggactcgggtttccccaaaaagtggatgtcaacaagtctgtgattatcgtggagcatataattccgacaagtgttcaacaaattgtggaaaaccaacccaaaccttgtatgtagtctcaaagtagctaaaactgttggtttcatgatttcatatgactccaaacgactttatcgattaattatgaaatgtcgctcaaagcatcatttgtctcctgttgatttacacctttatgtacaacattttacaagaaaaacttaaattctcctaaccaatcctaataattactaaattaggaaaatattgaattttttaatattccaattatattaaatacatcagctttttaatttaaaactttccttgtaaagtattgaaagaattattgtaaagatattttaggagaatacagcatcacttattgtactatcatacttatcattgcactttccttaacttctgagttattggtcaatctccaggttccatgcgccatgatcatggttgaaagcaaccaacaatttacttactatcttggaggaaactggaggaaatccctttgaaatttcagtcaagttacattcatccagaataatatgtgctcaagtgtcagaatccaactatccacctttgcaaaaagttggagaatgcagatctcattgaagaagtttctgcaaataatatgatacctgaactgcacttgcattgtcaagaaggacacacaatttcttccgtaacatttgctagctttggtactccaggaggtagttgtcagaatttttctagaggaaactgccatgtacctagttcaatgtccacagtttctgaggtaaactctatattgggtagcttttcactcttcactatattaccttgggggggaattggggacacagttctctgcaagaaagcaaaagctcctcatgattttgctgcaagaaagcaaaagctcctcatgattttggcattgtggacttcgataaaagtgatgatgcaagatattttccaaaatgcttaaccctatactttgtttaagtattacgattacaaatttattgttatcactgattaaacatttctgtaggcactagaaaagtgatgagaacttgtatgttaagtgtaaggtcttggctaatgttgatatgcagcttggaaaaaacagggctgtagtgttatgcgtctttttagctgcaggcttgtaatgttttgatgaaaaatattctgcggttcaccaaaagaagaaaaggggggaactcgcctaataagaatggcccaatacataaaactgaagcaaagaacttacctgtcattcaattttatgaatataatgattacaaatcccctttacaattcatctttagaaagttggttttgggtccaaaataactttctaaactttgggttgattatatttattgaggaatgaaatgattcatcggtcagcgtggagatactccatactaatacatgtctgtatcaggcaaaacacttgtgcgcatggttgacaaaacctaacttttctaggttgtagaccctcttgatatatactttctatattttgcaggcttgccaagggaaaagaaattgctccatcaaaatatcaggctctgtattcggtggtgacccctttccaggtgttgtgaaaacgttgtctgtggaggcaagatgcacaacaccattgagtgatggtttctttcaagaggctgtaagcagcttctaaaacgagaggttcacactagtcaaccaactggacaatgttactgaccacaaatggtccttaattgtgttcaccctattgtgtatatgtatgacacttcgctggatgtcatgatttagtacataatacttggtcttttgactttggacagcaaataaataatctctgctgatcaatgattctcctttgtgcatgcgataccatgggttctttgatctaaaatccaataaatcatacacgatttataattgttattaacgtaactttttaagtaattattataaaattcaataaatcatacatgatttataattaaacgatagtgaaaatattttaaactataaatagactatttactctaaaaataaacagttatatttcatcaactttttaagtacttccaacataatgcttcataaaacgaaaaatattagaactaattttaaaaaatcatcaggacggcaactcttcactccacaccaaaacaggttttccaatagttgtcagaaagcaatttcctagagttgcaaatatttataatactaattttgttcatatacagggacaagcttttaaactattttcaggaaggataaatttagatcttcccttcaagatctttctacaaatcattctatttactaaatacaaaagaattaaatgcattttatatttccaaaacattaaatgcattcactattttacttaatacttagtactttataaagtattaaaaagattagtaagatgaagaaaatagcattagtcttccaagaattgtaaactttccagtgagttttttaaagactagtcaaaataaccttaacgaaggaaaattcctagaggatagtattcacagcgaattattccagggaatgttatccataacccttaaacgttgaagcagacacccatatgaaataaagggtgaatgcgctacaatatcatcataactcataagtcatttatacatcactcaaccagtaagtactactgatgagtactagacagttcaatcggcagatcaatgacaaacacttggctgaaatcacttccgcatttgagatagcaagcattcacatcatacagacgaagagtatcatgctcataacgacggcaaggaaggagagcaagtttcacttcaaacgtctgatctttttggtcgcattgataatgttttgacctatctccgggtgtttaaactccaacaatttatcaagtttaagagaagcttcagagaaacagctatcctcaatacaggactcagatttgagagcaaaatgaacctcattgacgtcctcgtcaagctggaggcagaagaggtggctgaaaacctatgtaagacaacagaaatacaacagtgatattacagaacaactagactctaaatacagtaaaaaagaaacataactttcagttgacaagacggtgttaaatatcttccacaatcaacaaaaccaaaagttatgctgaataaatatttatatacaacaacagcatccagggtatatagtcaacaacataataataagtttcttgttagtaaacaagctaaaatatatttgtgatcactaataaatatccgaattgtgtttgctccttggtaaaaaatttctttgcattgagttttgttttgaaaaaggctaataacaaatgaaaaaaaaaaattcagggagcaaacacaaaattgctaatttataagggactaaaaaaatgtgtcagagaccaaaaacaaaattgttattttatcatgaagaaaaaacgaagaacaaatttattagaaagcaaacacaaaatttggatatttattagaaataaccaacatattttagctacaaataaaatatcagactagaaggaataagtttaatttttttgttaaaatttaatacagaaacaataaagcgtaaagcataaattattgatatagcatttgtaatcttcaacatagcacccatcccactatcccaatctatgccacaatgcaggaatgatacctatgggtacatccatcttaacatttccaatctgaagacttgaaccaactaagtactatattgggattacagttgtgaagttaaaaacagtaggccatttcacaaaggaaatatgctcagataccagcttgaactcttcagaataataagaattactagagagaattgatctcagcagtcagcacctatgaatttgtattaaaggattacaattcaattcgctatataagataagtcctaaattttagaaacaagatataaggacagtatctatgcaaacaagggttcaacaactttaaagtaatagaaatatttcattgaaaatactaatgtttcgtaaccgagttacaccaattataaattgtgtcctaaagtctccattttctagcctctctggaattctaaatccccttataagcacaaaagattcatttggacatttttcattagattagtactctaatgctgtgtagcagaatggtagatctaactaaactttgtctcccgatgtctgtgtaaagttttataaattcagaaataactaacaaccataatcatttctacttctcccagcaactagttatatttgggagggttttctttttataaatattggttaaaccttcaaaatttggagtacttttctttgaaaagctcaccggttttagcaagaataaggtgagtgaaatgaaattttcccgattgtgtatgattggataaacaatacctaaagcacctaagaaactgcatttgagttttgtacaaagagaagagagggaaaaaaaatagagattttaaacacatttgtaataaatatctgattaaacaagatacagcatcagacatcaaaaatcaaagtccaaactaaatattattgcactcatttgtttttacctttttcatttttgagagagccatatccttaatggcttgggaccgtgacaccaaattgacaacaaagagaccatcctctgaaagtttatcctttacggtctcaagaaaagactcatccaaaaaatccagagcagggcatgtcaatcctgagctgtacaaaaaatgtaataaataagtaggattctttaaaatcatagaagataatgatattattatttctaatcccttaatggccctaataccatttttttcttagccattatatgatagtttaatgtcttaaatgcataattcaattcaccttgggtctgaagagtcaacatcaacaataattatatcaacttttgtcacttctacaccagcatgagacgcagttgaactttttccatgaatctgaggtgctccagaactgtcaatctcccggacaaattggatcccatcagctacatgcacctggattctccaaagcaacaagattcaatagccaatgttgtgatcaccccatcacaagattaattcaacaaattcttatattatattgtggttcttagtattctgcacacagcccttctccctcccaacaaataaaaacagaagtcactttatctgcagttgccatatttttattgccatccatattttaaactggtgtttaaacagcaaaaaaaaaaaaaattcatgaaatcaaaataattacttgcaagagtcaacattgtatgattcaagtaggcatggagaatcttttcttaaaactagttactgtttcatgtggatatttcctttgatgtaagttagcaatctggctttactttggttagtcctaatttagatttacacccccacaacacctcaagaggaagacatgaatgtatatttaactacctttaggcgtttatcctcaaccaaactgaagtagtcccttgcaatatcaacaatcatggggtctaactccacagtctgtagataaaaattattatcaaaccatgtcatatgaatcattcagaagaataaatcattagggactaaatctgaactctaattatatcccctccctaaacaacaggaaaaaaatataaattacctcaatttcaaaaaaggggatacacccgtgaagaaacatgggaagtaaaccagctccaagacctattattactgcttttacctgagatatgtcacttgaatgcatcagcaataatgaatgaaagaatgttttagagcatctgaagaaagtgagacaagttaatttgccatgtatttacaatttgctattattggaaactacagtccttaatgtaccaaggaactagtagattcatgcatcacattaaaagtcagaaatacttgccattttcccacttgatgccacattttccatgtaagaagatattagcgtgaatcctgaaataatccctgtatgataagaactagctacatagccatgatagacggtcaactggctgcttgctcctgcaacatcggaaaaaaatattacaatggcaggagttataaacaacgagcaaatattgaaaactagaaaatgaatagtttcaaaactgtaaaaatcctctgtttctgttaaaccatttttaaacatcatattcatccaaaaccatttttcagcattagaaaggcttcaaaaaaaactatatagataacccaaaacactgtctacaacttttttttaaaagaaaataaattagcaaaatgaaggataaattaaaagagatgattcctcttaggcctcgttacgtttacattgaaaataaatttcacataccatgtaggcatgcacacatcccaatgtaaaatatacagctatgattaatttggacacacatttcaatcatgttcaatggttcaaaaccaattctacaaaaatataaaataaatggaaactttatgatatacaacagtaaattaacaaattcgggatttgacaataatgttgaagcaacacttacaggagttgaacagtaatcttaaataaaccagaggcaagaggaaaacaattaccaatactgtgtctctgagatccactttttctagatttggaagatgcattgtttttcttcctccctgtctcactaaccaatttggtagctgactgttcatcttttagcagagcttcagactgcaccaaatttgcagctctctcaaatacaaggcgtcgaaacaccaactctctagaaggaaaaatacaactgacttcactatcaacattttcataaattacatcttcaacaataattgatccagttaatgaagatgggacctgcaaaacacataatcataaatgatataatgagaatgttgggatcattttaaatcaagcaaagccatcaagagaatgagcatccatgtaaaaagtaggaatcacaaaagcaaaaagactagtgaataaatacatttttgtttcttattgataaaaacagcatttcaaaaaacttaatagaataaagacgtgaaattactcttagatcaataaagcgggtggataaaaaaataaacataataagaaatgagcccagtaggaccccaactccctctaatgaacaatggaaccaagggctaaacaccataaaaagaagctcagtaagaagttaagaatgaagtttcttgcagaatactagagttaatctcacggccttaacagacagagagttcactagatcaaaataataaaatagagacagtattatgtatattgttacaaaccttgtgaatgatgtttcgctccttgatcccatcacttgccatcatgaaactgtagacatttattcaagaacttgtgagaaaaactgaaattcatagtgtttaaatgtgtgtttggttcagcctatgtttgccaacttctagaaagagattttggcccaaaaaaatattacttccacaaaaataatctgaaccaaacatgctataagtatgacaacagcacctgaaaaaaaatggtttacagtatagtaattactgtaattcacaatggaacatgtttgaatgttttggcatgaatagaaaaacaggagagaaaaaatgaacatttatgttaacattgctcgaaataaatgaaaaatcacaaaaatgcaactggtacaagatacagacggtattttagctccattctcattttctgcaggtgccaactgcgtaaccaatggagacaaatccttctgaaaagggataacagacacaattcagtaaaaagcaacatggttaacctgttataatggcacgtccatgaagcataacttatgaggatgttctacctgaatctcctccatgctggtatccgaatggctggcatccaagtaaacctaaagtcatggatttgcttggaagcttcaattagaaaagtaatttggcatacaaaaaatacgaacaaattataattttataaaattaatagcatagtaccattatgagacgagctgctttagagcttctgaccaccatccactgtccttcttcagaatagaaaagccattcacgtgcacgagtctgagatttaacattcaatcatgaaattcaaacagaattactgcataatttgatgccctaggtgtaaactgcagatagatataaaaaaaaggaaatctgaaatcctgtggaatcagctccataaatgaatattgatgcacattgcaatccaaaaaattaaaaaaatcaaatcagatgaaaaaaacaaaaaatgaagaacttgagaaatactagaaactccatatctgccaggtaacaaaccagtgtccctaactctataataaacaaataatcttatcctatatgcaacacagcatagtacaactgatgaactgaatatatattccaaaacaaaacaattacagttttatcattttcagtatgaacaaggttgagactactaagaatagaaattaaaaaagaatcagaaaatttgaaaataacaagtatccaattgtccattgtctttcctagtttcaaaaaaattgtcagcagcagattctagtcaaaagcaaattaacaatggttctttacttccaataataactatttcacatttattcatttgttaaaactactgtgcttgaatctccagagaaggatcactgattcattttgaaacttcatgagcataccatgcgagtttttttttttttttttcttgttatgaagttagaaggaatgcatgaacaaaaatctaaagggatctccgctaaaacacaccttaggcacaatgaaaaccccacagtgataggtaaatgggtcggcctgttcctcggcatcaagaattacagctctgtaagaaaaagtggagtacccttgtccacccagagttagctgcaatcgccgaccttgagaaagctttgtcaactcctcttgcagatcttccacagaatataatatatcagagccactggagtatttttcacgaatttgattctcattttgaagagcctcatgaagtccagaaaccttgcacaaatgtgggagaggggggggacataaacataagacctaattctctgtacaaataggcattagtacttcataaatgtcataatattcagagcattttctctctatttccccttccctgcataaaccctacaacctttaacaaaataactaccccttctctgttaataccctagagtaatactatctatagttatatacgactaacagatgtagcattaatcatccataaatccttatttaaagaaaactcttatgtccatgagaactaaacagaatgtacaaatagcccagatagtctacctgttttgaattacaatgaagtgacngggggggggggggggggcaagacataaacataagacctaattctctgtacaaataggcattagtacttcataacttacacacatcaaatcaatgtcaaaatattcagagcattttctctctgtttccccttccctgcataaaccctacaacctttaacaaaataactaccccttctctattaataacctagagtaatactatctatagttctataccactaacagatgtagcattaatcatccataaatccttattttaagaaaactcttatgtccatgagaataaacagaatgtacaaatagcccagatagtctacctgttttgaattacaatgaagtgatgaattatggagcaatgatgtaatctggtgcactaaagtagacagctccttctccacaaccaccataaatgtttgaaggctaggtttaccagaagactttaaaggtatggcatcaacactcattttccacccaagtcggaactttgagaaaagtagatctggaaattgtgaaatagtgatatttatcctccaatgataccaaaccaatcacgtaaaaaatgaaaaagataaaatgcaaaaacagttccagaaaatcatttcattgcaatgcagagtaacaaagcacactgtccaagtgcactacaattaattcttaaggtaacacaggatagcttcttggtagcatgtttcttttttagcaagacgtccaggagttaggaagggttttgtgcaaaccctcttccaagtatcattcacattcaagtattattttcttatggctaatacacaaaggaaagtctaaaatgtgggtaccacatatgaaccttgttccatgaatctttcaataagagtaaaggaaaacaaaacgtctgcaattgaaacaccatcacaccttcttagtgttttcaattgtattctctacgtatcacacgtttttctcttattattcacggtgaaacaaaattaaggaaacttacttagtacatgagattcagccaaggtaaggcacacaaactttcccccaggctttaaaactctcttcacctgacaaaaataaaagggctaagttaccaaaaacatgaactcgtaagaaataacaaagtagagaaacgtacctctgataagtactggtttcccaatttcgggccaagttcgggctccatcaaagcatccagtccacctttgtcaataaccgcaccgaagctctcatcctcgaactgcatggcggtcatgtccatgatgcgccatcgcatgaggggacggtcgcggacgttgcggcggagcatgtcagagatgacgaccttggagaagtcgatgttggtgatggcggtgtggccggcgtcgtagaggtgctcggagaggcgggagttgccgcagccggggacgaggagctgaagcgggagaggaagggttttgaggagggagaggagtgggtccctgaggttgggccattcggcgtaccactcgaaggaatcgccgcggagggtgaagaacttgtcccagttctctttgctcgtgaagtctcctagggtttccagaatgtcttccggtgaacctttcttcttcccctttgaacccattcttctgtcttctctgcttccgctctcactcacttcacaaacctcttttatactgctgcgcttcacttcacttcactgtcttctagtcaagacaacttactttagcctaatgtctaattaattaaccctcctaatctcatatattttaggaaaatcatcaatgtctcactcaataatcaaaatttctccaccacaattaatcatttttatcttgttcatacatatatatatgatccaaataacataaaagatattatattaacatgtatttatgagaaaaaacattaataatgatgttttaaaaaatatataaatttaaaataactaattttttaattatgaaaaattaaattgaatcttatatataagaaaaaactataactaaattaaacatttcaatagttacataatattattaaatatttatgagtaatatttaataaccttaaaaaaattacacaatatttaaataacttcaaataaataattatttaataaataataaatttaacaataatatttattattaatttaacgtgttaaaatagagatatcatctattactaaaaaaaaacaattatcaattcaaaaacttatttttctttattagtattttttaaaatttaatttttaaatcccaagggagggggcaaggctcctctactcccacccctcagatcagtcgttgggttcaatcaagattatttatcacaagaagacattttgtattgttaaaaattgctaactctgtcaaaaataaaaaagaatttgctaagcaacattacaaaataagtaacaccaacccatttatttcaattgagcaccattgattaactaagatttttttaagtaaaatcatggacatattaactgaaatagcatgtgagagccctcaagtcatggtttacaaagagttggatttgaggaggaacttccttaatccatatccaatcaaaagtagaaaaagtagtcctcgctagacggtctgcaacattgtttctcgttcttctagtatgaactaacaaagtatcgactccaatcctgtaaaacatcctctaaatgtgtagaatgttataggaatttgttagaggatttcgcaaggtgctgattcaaactgactcaaactcagttgtgaatttggttatgaagggagttggttggtcccatcactcccatgtgtgttttatgtatacataatggagtattttgacatcattccctcttttcttgctccagtcttattggctgatgctagttatgtaaattggtctgggctagtttctgtttggcctttgcccatgttttaacagaaaatatttatttatttataataatttataagctaaaaagttttgtaggaaaatatagcaaaaggatatgacattactcttaaccgtggtatcgaaagtacaaattaataccgctaattatttgaaaatcaattcaaataaaataattagaaatgagatattttacaccggtgtaaaactttataataaagttttacaccattcaataactttttactggataagtattttataaaattcatcgttagattgaaagtttatatcatgtagatcacatatatcaaatttcacaaaaatccaaaatcatttgtgtagtgatatcaaatagtctaattttcacatattttagaaatacatatacagttaatttatatatatatatatatataaatatcaattagggttcaaatgatttcgaatttttgtgaaatttgatacatgtgatctacatgatataagctttcaatctaacgatagattttgtaaaatataaatacttatccttttacaccagtataaaaggatttcatttcaaaattaactataatattagtcatcaatttgatgacttgacaacaatgaaattttccatgttttaataaaacttttaattagggataacagcgttggttcgctttcgcttgaccttggcacaaactaatagagcattagcgtttctacttcgtatcactcccgcaacccttctggattctgactgtgacattgattaaggagttcggtaagttttcatttttttgttcaattggaattggttcacccacatccttcatcctctttactgagatgggtgcactgcaaaatttcattttaaatctttgattctaatatttctgattttgttgtgttgttggaatagaatagtttactcgtgagatgggagagttggcgactgagaaacatgttcgatatatattatcagttgaaaaggtgtgctgtgttacccatttatacatggatgctttgtaaactcttctttaatgcttaataggttgtccttttatggtttccagagaaaagataactttgaatctgtcgtaatggagcatctaagaatgaatggggcatattggggattgaccactctggatcttctaggaaagcttcatactgtcgatgttgatgaggttgtttcatggttgatgagttgtcagcatgactcaggttcttcaatgttttatttgttcccttatattcttttagacatcagtgtcattcatagtttcttatgagaaaatgtgttgttgtgaagggggatttggtggaaatgttggacatgatccgcacatcctctatacactaagtgctgtgcaggtgttggctctctttgataagctggatgttattgatgtagataaggtcacaagttgtatccttacacacatattgcctcactttgaaggtcccgttatctgtattaacaaatattttatgctgcagaagaagctttgttatttttgcaatttttttaactattgtagatctgttttttttatcaggatatgtagcttcagttggcaaaatactttgatgttatgattcaattgcttgatatgtttcttagaaagaaaaaattttagtacagttcgatactaaaactacaatagtaaaatttaataaactagaaagcataccggatcttgtgtttcttactatttatgtcagatattgtcagtctgcaaaatgaagatggatccttttcaggggatatgtggggtgaagttgatacgcggtatttttcttacgattcttttttattattgatcatgtaagagcttactgtatttttaactaaaatccactgaattatttgtcctaggttctcatatattgctatttgttgtctatcaatattacatcgcttggataaaatcaatttggagaaggctgtgaagtacattataagttgcaaaaatatggatggtggttttgggtgcattcctggtggggaatctcatgctggtcaaagtatgccataaattattcatgatctttagttagttattaatttccctacgttacttattcaatgtgtgtactaatactactttttcctttaaagattgtgtgcttctttcccacatgaagggagtgctttatgtggtgaagggcatagtttgaaattttaagatgttgcttaaatttgtgggtataagaatcaattttctccttggcagcacagtatagctatgtaacctagtacttacattatccaactacttggtagttttcctgataggaatgatgtactttccttttgttcttttgtggtcaaaatttactcatgttaagcctgaatttgtctgtttaatttttctgttttctgaatttcaaatgaaagaatgaaatgggttgtggacttaaatcatccttctaatatatttgcttttactattgtcagttttctgttgtgtgggggcccttgccataacagggtcactagatcttgtcgacaaagaccttcttggttggtggttatgcgagcgacaggttaaatctggaggtctgaatgggcgtcctgagaaacttcctgatgtgagtaaatcttttcaaatttaggtttagtgctgtagattttcctttctcttactaggttttagatcttctcaggtctgctactcatggtgggttctttctagcctgatcatgattgatagggtacattggataagtaaggagaagcttataaagttcatcttagactgccaggttagttagttgagtgtcttttctgtgtttataactctgcattcttttttctttttggggttttaattattgtcaggtagtatttctgaaatattatgtatgttgaaactgtaaggacacagaaaatggtggaatttcggacaggccagatgatgccgtggatgtctttcatacattcttcggggtggctggtagagtacctccatcatttcacctttttttgttccatttgttgtgctaaaatcttgttatctaggggttccttggtttgtatgggaaccacctaatctctcccattcccatgactcaatgtgggaatgatattaaccagtgacttcattcggtcatcctgtttctaaaaagagagatgaaaaaccatttttatagaatccttgtggattcatgttgtgaagttgctagcattatgttccgaattcagataagattaatcgtattgttcaacatgcttataataattcattagaactggatatttaacatgattctatttttattttagttgtttggaaggtttaagtgagcatatatgtgaattataagctagacatcgctatttttccttttctgacagtgcctattgcttttacactgtaaactatggacgcttaagttgtgtttttgcttgcaggactttcacttcttgaatatccagggctgaaaccggtagatccagcttatgctttacctgttgatgttgtcaatagaattttttttactaaataaggacttaagtagttaagttcgatgataattttccagtaatgacaaaatcttgggtttgtaagactcaccgttgggagttggaccccctcctcccatccctagcccaaaaacagttgatttcttaaaaacagtgttaacattttgagcatcttttagttaaattgcagtggtacgacatgtaaagattaaagattgatcggtattgtagtcaaccatcaaatttatgttactagttactacatagaagtataatttcttttgttaatatagacatagttatcatgccatcgttttggtgactttgttcttttctaaagtgatttttttctttaaaaaaaggagaataagcagaagtcattcactgaatacaattaaattcaaccttctggtatgattagaacgacttctaagtttagatgcaatgcaagttgcagagtgataaaaaaaactccaacagaagacaagatttttttgttcttttaaaaatgtagattgatcgaaattaatgctcataaaccgtggacagaaagaaggccaccttgggcactgttgtcgttaaaatgattattgccactgctgtttttttggcattcaagtgcttgcttctaccttcattttaagctctcgtccagcttctaactagcctatgtggtcttgaagagttgatatccatgcaactaacggatttcgttcactagattacgtatttaaaccttatttttcttaagaaaaagtgtcaagtagacaaatttactattgtttgcttgcgaattcacaagtcttccaatggcatagtttctgtaattatcaacttcatcattttgacacaactacagaaccttacataaacatcaaacagaccatacctctgccaaaaagattatcctgtttaatccttcattttattttatttatttattttaattctttattttttcaaaaatttattatgataatatatcttttaaaattaatttaaaatgatctgtttatctaaatttgataccattaatgaaataaaagtactaacgattcaaaatcataaaaaaatgtaagtttttttctcatcatcttttcctttctcttcttctctctttagatctcaagctgcagcagtgcacaaccaccgcggccaccccaacctcgatccaatactcaccacaccagaaacccaattgcctaaatttctcgtcagaccttaagctgcaaaatctcctcctcctcgatggcatcgacaacctgtctctcttcaatcctcaagctacagaacatcctcctccttgactcctccaacggcgaagaacaaacctaccactgcaactcttccacgccccattaacataacaacaactcagaacgttcgtcaaccagatttctatcgattcgtgtgccagcaagacgacgtcgtcattttgaggaagagaatttgtagaagcaccactgcagagtgagatagaggccttggggaaaatgggacgcagaaatatgagaccagttgcatccacgtcgagttggggagggaagcgttgtccaccatgtacattcaatttgggaattagggtgtcattttcaatttgaaaatttgttttgtttttcatttgtgacggttcagtatctgtatactacttaatggtgttaactttaatttgacaaaagaatcatttttgaatattttaaaaacataaagaattgaaattatttttttaaaatataaaagatcaaagcaaataaaaaaagaagataaaagagcaaataatcatttggaaaaaaaatagttaatgcaacaaccatgaaacacaagcaacataaaaagaatatctacattatttgtacaagtgaaaagagtaaccatgttgtttggctactagaatttccacccactatgatgtttcttttacatgttgatgttgctgcactaccaaaacacacgctctgctttcaaaatctgatgaagcaagcaaatcaccaatgacacctaactctgaaaattcactccaagttgtaagcccaaccgtctgaggtgggtttaactcatgtcttctcccaactatgaaaaagtgatgttcatttactatttggcgaagaagaagagatgtctctggtccaccattcactatgactttttggtaacttacatttcctaagtgtggtttcttaatatgttttagtgcctcattatctcgtatatactccatgtctggtgtgtgttccttaggagcaaggtggtacacaaccaagttgacccttggattcctcgttgctcgtttggctaagcacaaagcctctcggtcatcttttccgcccagaaaaatcattgctacccgaatgaatgagtcactatgaattgcagaacgaccaacaaggattccaactgagcatggagctatttctaagagcttacaatttaaagccctcgtgttcttgtcatcagattctatggcaccatcaccagaccatcttagatggaatggaagaattataatggatgccactttgtccaatgctaaatgacaaacatcctcatgcatcagggagggtggagatatggctgtgtaaatgtgtgcagttactgcacccatgttgtcatgttcatagaggtcaaaagcaagaataacatcatctgaataagacttgtggccacttgatgaaatcgttctttgaatgcgatgggaaatgaaaatgggagaggcccttccaattagctcaattagatgcaatgcatccacagtgatggggtcttctgttgttggacaacaaaggtcaaggaaatttttcactgcagatacatggtgtgttttatgaaggcaggcaactactctcagctccgagtctggttttaaactctctatgttccttttctggtagccagcgtattttcttgatggatcatacaatagtttcacagaccatttcactaagcttgcaatgaccattatgttgatcatcattactccataagtaggaccattaatagtctgcatgcacatataaatgaaattttatattgcattaaatatagaagatagtgataagacttttcaaactcaagattatggttagttttagggtaaattaaattttatccattgatgcttcacgctttctcaacttactcctatattttttgtatcactaaaccctctgtacctttgtttttaccacatctagaaccgtgactagtgagtctaaaactgtagttaaagaaaaaaaagggagggagggagggtgtgttcaatgacaaaagaaagaattggggttacttagtaatacaaaaagaagcgtagggaagtaagttgagaaagtgtgaaattataagtataatttacccttaattttattgaaagacaagttaaggtggaagtaaatatattaccccttcgtcatataagatgccatagatgccgacttccactacgcctttaacgttcaaaatgaggccaagagtcaaggcatctttgaagggaatcttgcaaaagagggcaggtatagtgcatgctattactttgacaaggtgagtgaaaagagagctgaaagcagtgatcataactacttttgatgaaaagtgcttggaaaaatctgccttcatcatactgcaagttacaaatattggcaagaagaaacagttaccaaagaagtgaagcttcttgaccaatgcagatcctaatggaggtccttctggcacagccaaccccaacataaaagctcctaggatgaattcttgatgtatttgaactgcaacccaacctaatgcaaataccattgtgatgacagcatagacataaccatcattcacaggtcttccttctgcagtacgtttgatgatccaaaacattgctggtcgaaaaaataatggaaccaagatgccaaaggcaatcaatgataccaagagcacaaaaatattctggttttcattggcatccataaagatattggcaacacatataatggttttgcttaatatgtcactcaccagtactgaggataacgccaatctgccaagttcagagttaaggattttaagttcattgaggagggaagcaactactgcaaatgaaattacagtttctggtagaactatagtagtaacattaaagatttgatattcaacaggaagaattaaacgttcaatgctgattatggttggaatacaaataagtatcggcacagccaatccaataatagcaatggtccatgccctgtgtcctgtcctggttatcatgctcaaatccatttgcaccccacttgtaaagatgaaaaatgcataaccaattgatgttattgttgcaagtgtgtcctgacttggaaatgaaaacaatttcctcttgtatttgtccagcatctctacctgaacagcagggcctagaatcaggccaacctgcaaatggaaacaagttatgaatcaattaatgagtcttcctatgtgtctccaagaggacatgacattggcctagtttaacaaggaaatataaagtgagttggatggttaagggaaaagggagaagggatgagagaaaagatcgtgggttcgatccctttgctaataaactaacatttgcagattaaaaaaaaaaattgatttagtttatcagtagttataagtaacaagagagacaacactctatttgtattaatatgaaaaattctggacaaaaaaaaggcaaaatttaataattcagctagatgcaagagtggcatatggatgaaatatgagaaattaacatttttccctaaacaacttttacattgcatgctacacgtgacaaatattctgagtgacctcacctagagagagaaaagaagttaaagaggcaatatcaagattttaaattggtcccaatttcatctgattctataatattgtggaaaattgtggacaaatgcagccgatgtggttacaattacggttatagacactccaaaaatcttaacattatggccgaagttatggttgcaactcgtttttttaaaaccttggctaatactaaaggagtgtaaaggggagcttaagtaaatatggtgttaaaatcttaaggttgataaaagttaaaacagaggtgcatggcactcatcaatccaagattaaaaagaaaacacgtcaattcgtttagtaaaaaaaattgaccacctaatattatataatgcgtgtggtctataatgacctactatttattatgttctatcatatcactttggtcatatatggtggattggttttaggccatgatgtgcagaccataaggaaaatccttttaaattagtttgttctctattttatgagaaacattaattaactatgtgaacaaggaaattttaatttatataggctatggctcaaagataaaagatagtaaaagaagaatacttactatcatttgtgggataaattgagggaagtcaaagctctttaagaggaattggcagatttgggtgatagcaaaaagtacaagcacctgcaactcaaacaatgggagtgaagatttcaatggagtccgtccattaagttggccaccccataagccatctgaaacaatattgggtggagcaacagtgcacacattataggtgaaaaaattgattttatcaaccgacaagaatagggtctcatttgcacttaaattcattcttgctgacaatgccaagttaccaaagagagaaatgagaataaaactcaataaagagaaagttataggaaggaagatggctcgatagccagctgtattggcatcataacttctgtcaccaacttttttcctttttgttagcatgttagagattgcaaatgtgagctattcttcgatattgtaatgcaacagaaaacaactaaattttgtgttagaccacgaggaaataacagcactcaatcccataaataaataatctttagaggttgtatagctattttcaatatatgcttgagacagaacatacctatcagaccataacagtacatatttatccaagtacacagttttctatttttaactttataccattattagatatcttatagttatagctaccctttttataataaaaaaacaaaacaatgttactgctactgttttataccttaatgaaaagaagagacatgaaaggcctttttgcatgtatactaaaattaaacatcttacaaacttagaaatacggacacttctaaataaccatgtcagagtcggatgcatatctatatcagatactgtattgacacttcaaatactttaattaaatttaatcataaaaaaaagaagtcactcaccatggggctcgaatccacaatcacaaggttaagaatcttacactttactaactgagctagatagatacttaattttatttttttaataaaattatagaataactttatatattattttacagttatacaatatcaagtagtannnnnnnnnnnnnnnnnnnnnnnnnnnnnnnnnnnnnnnnnnnnnnnnnnnnnnnnnnnnnnnnnnnnnnnnnnnnnnnnnnnaaaaatttggcatgtttctgtttgttttgtatcctgtctcgtacagtatttttcatgccttgttgtcgaacagtatttttcctagtttacaaataatttttcatgccttgttcttgtactactcactttttaaaggaactaactcatacaaaaagttaataaatatagatttactaacaactatgccatcagtcaaaaaacaaaaaaacaactatgccacatatgcactgatgacaaaattaagtgtcagacttttgcataatttttttcactttttatttcttaactaatgtctttatagtactaattaatttttctttttcagaataatttcccaaattatgtaaccccaaattccataaaatacccttttaattataatgtattttttaaaatttgttttattaaatttttgtaaatatatttatttatattattttctattcagtttattattaaaaaagttttaaaagatggtattctctaaagtagaaattcaactatagatcatgatccatcacaaattagcaactggaaaactaactacttgagaatgaacaaatctcgtctttagatggttactacgcttagtataccatatttttacctcaagaaatttaaaacaaaaaatacctataacgttgtcataattttatcaaaaggaatacatattcccgtagtactgattttttttccaacataaccatcttttttactatataattttgcgctttgcacattcttgcattctctcctcacaattatacattcagtgttgcaccgtaaaaatatgaaagctattaagctcgactcccattggccaacgaccattcaactaagggaggaggaccccaaatggtctcacaaaactcatttaattggttttgaattccaaaaccctaaacaatagatttattaggtgatttttctttttattcttctcatttcacctcccatctttcctctcttaaactgaactatttggaaaactcaaatttcaaatctataagatgcttagatttaaatatattgttaagtttgatacaagtgaaatcatagttttaaaaatcgaaccagtgatcgaatcgatcaaggtactggatcattgggtcaatgatcgaaccgataggttactgattgactcgcatgactcgatatataacaaaaaaatttaaaatttttataacataaactaaataagtttaaatataagaaataaaatcatcaatacaaaattatagaattataattctcactcaataactcatttttagtcaaggaaaattataatgatattatctcatctctatatcatatacatacttatacttaatttattttcattttatattaataatttatgagtattttagaaacaaattttatatatctaaaaaataaagaaaaataaactcctatatacaccatttatctattattaacaggcttaaaaagtattcattcaatttaaaattcaaagtttaaaacacttttgttaaaaaaaaattaacccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgatgtgacgtgagtgcttggaaggagaagcagaagtagcggacgaagcctgaagaagacatttttgtttttctttcaaatagtgacccagtccgatttgctggatcagcggttggaccatagacccgaccgggtcgcactgggttacacgggataaaaaagatccattgatagactcaaaccagtccagctagcgaatcatgatccgaccggccaggtctaaaaccataagtgaaattcatttaagatgggacaaccatattttcatttcgaaaaaaaaaataattaatgacttaatttatttgagattaaataattaaatttgatcatttatcttttaaaaaatttaatttaatccttattttttttttcaatttaatcatttaacttttttaaaaatttatttgattctttatcttattttttaattcaatttaattttttattctcaacttgattcttgtctatttaaaattgacgttattaataatttaaaaataaacttttttatccaattttctcccttctcttcacttcttttttaacaaaaaaaatattcttgaataattaacaatgtcgatcttaaatggatttcgaagactaatctaacaaaaaataaaagataaataaagataaaggactaaatttaaaaaaaaaaaaaaaaaaaaaccaaatagttgatttgtcctttattttaacaagttttactaaaccgaagaaccgtgggacacgggaaaggaaatgtgctaactgcgagctgctgtagcttcattttctccgcgtgacatgcaggtttgtcatatctttctttatatactgtactaaactctacaaaatttattctgcacttctgttaaatataataaaaacacaaaccattggctcaaaggaccaagcacttcataagtgaagtgaaaactagacgtgcaatagtacaatttacacggatatggaagttctaactagtctaaagcatcagataaactgcttcagaaattctgtagctacaagcctcccccttgtgttcaccgacattttcagctcgcttatctctttatcaatgtcctgcaatttgaaggccattattatactaaattacaaacaattaagcagaactaacatagaagacagcaaatttttaatatttacaatatcctatataacgtacaacagatcaatgaaagtagccactttaaatgttgggaaggtaatagaaaaagcaaacaaaaacatcatcttgctctgtttcagattatcagtaaatcttttaagttgattacaccaaatatcaaccacaagtacaagtaattggcaggaaaagtctgtaagcaaaacagttatacaccttaccctatttgaaagttaatgtataaggtctagtatctaatatctaataaagaatatcaaaacgttgttctatttttttatagtttattttatttttgcaagttatgcttttctttgcatcaattatcctgggagaatcatgttccatagaacctttgctaatgttttccatagtcactccatagatcatacagtatccctaatttagataactactataagccgcaaaataaaatgcaaatccaagtaatagggtcaacaaaattcttgcctccataaattgcacaataaagtcaataagtttgtgcttctgcatctcctcaaagtgataatttgttataaggaagctaatgtcatatccctgccaacagaagcaacaggatgacatcaatgatcactgacaagttactaagacaaatggaactatgtaaattaatgctaaacctgaacaggctttctcctcagtacttggaaagcctcggctctcattgacagaaatcttagaaattttttggtcagtatgttttcaagttcatcagcctgcttcacctgcacaggatgaaacagaataaaattaaaacaacgaattagggacaaattaaatgtgaatttgatgcttgaaaacaaactctcattcaaatattagtttaataaattgctgataaaattaaactgtaaggtgatataaaggaatctaacattataatagaatatagacaacttgttctggcaaacccctataacactcatttgcaactttgcagtactcatcatatatgtggacctcacaaattggaatttctaagattatcggtcctgaccgtaaaagtaaaggcattaaattgaaatttattaatttttggacaggtgccagttgcacaaagtttaaatgcactgtcctaatgcctgcatatcaattccagtcatcccagctgaatttaattttcacttcagattcagccaccttatcagtggtccatccaagcacagtgaaactttttctcttattattttcaaattctactcaccttctctacctacctattttctatttagttattctaaatttccaacacactaagtataacatgtttcaatattcaagagaagtagagactgcacagtacatcaatctgaagctttacacattgttgatatgtagtacattaacagcaaactataaaaaaggaagaagcataaagaaaaatcattaagttaatgaaagatatcctgagctttaatggacagttcatgtcttaaaaaaacacccaaaatttaatagcctccggttaggggaagaaattgttacatcatcgtggacatagactcaattttagatcattttaacaaagcattagtctcacaaaaaagaaaaagatttaccttgagacttatccgcaatgaattgatagatgtttctattaagcatttttcggcctcatttcgacatatcaaaacctgtaaaaacaattgcacacatttttccataaagcatggatgcaaaagtaatatatcacttaggaaggtagagcaagagaagaaattattaagacacaattaccacctacaagagtctgcttaatcctaatgaagtatactcatttagaatggtagactaaaagaagacattaatgcataataaccatgataatagttagcttaaaacattaacctcattgtttacaattgaatgctaggcactatttaaattttaaccacaaattatatgggctatcttaaatctagtcatacagctaaaatatttgttttcatcacttcttacaatttttcagccacttttgcttgatgttttcatctctctttttttttttacatataaaaaaggatctctagccccgcttagcaccccaaaactgtacatcatgtctttgcattcaattaatatttactattatcccaaaaaagtaaaaaaataaacatttatttttaggagcatttgcatcctatctttctaacaatatattatttcatcccacatcctcaccactaaacaaccttctatgttgatctctctctctggcctctctggctgcgagtatttatttatgatacagttatttttctcctttgtttttagacaagtctcattttgtgttatttttcccctttcagatgaaaaatgcttcggaaacaaattataatttcaccttaagctagcattataaattgcatgaagcctccatcacaaggaaaatggtggaataaggtatctgttgaagtccaacactccactcaatccagaaatactagtgtttagagaatatataggacagtgacaactagctttccttctaattggaatctgtaaaacagcccatcacaacaccatcaactcaagtgctgaagcacaaatccactccttccaacaaagagcaggctatctgcaccaaatttcccaagctattacctctgagaaacagatggttaagcctctccaacctattggtgcatgtgaagaagatataaagaaaaggcatttacaaggtcttctaatttgtcaaaatttgatcatgtaacacttcacaaaagctctgagccattaccctcacaagtcacaaatcacaatgaccttagaattccaagaagaaaaatttaaagtaacgaacaaagtcaatagacaacacaagtgcaaagaaggttatcaaacagaagtttggagtgaagtatcacaaatttcgcaaaagctagactccaaaatcctaaatactggccaatttgaagtttgaagaaggaagaggttttataatagaacaccagtctcattcttaacataaaaaacccaaccatgaattatgatttgacttgcctactttctttagcctaaggccaaaggttctatcaactacttgccacagcccacaaggaatacctggcaccctaacttctcttttcatactgtgaaggaaaagaaaagaaaatatcatatagcagtttggcaattcagaaacctagtcacgtaatcttaaatcatactaatcagcattagtaaagcaagtggaaattactacacagtgatatgaattaagatggatcttaccggattgagcaggagttcagggctggttctgcacataaaccaacagagttcacaaaatcgaccacttttgattttttataagaacaacatcgtgtgaatcgtcgtattaaatgtggaaaatgtggaattaaaatacattttttatttcagtatatggttttccattatcaaatagatttagaacagtaatatggagcaaatgtgcaatgaagtaaagaggggagagagaacgtacttgagttcaacctcgggcttgttatgcctttcgacttcttgacagggaaagttctggaagcataacgaagaagagaaaaaaacaacagaacagaacaagtgattattttgttgatgccaaaagaaacgaatattgatagtggcgttgacgaagaaggagtgatacctggaggcacattgcggcctcgagcgtgttccgaatgcaggtcaagtataaccgcaacgtgcttgcctgaaacgtaaaaagggtgtgattaattatacacaacagagattacttataggattcattgataagggcgtagcgtaccatgaggttgggtctgaatctgaagaaacgctgcgtttcgtttgggaatgagtgatgatggaatggaacaggagtcgtagagtgtaagagaggattaaaggaatgaatgaaagaaaaaggaaagcaaagctaagcaacaaaaactccgtccagtgggggatcccaggaatttcaccaactacgcttttctgctttaccagattcgcttcattgcggtgcctttgacggattatgattgaccccaacacacaaaacaacaatgatgttcatgtacacctactactacttccgtagcatttttattatctcatctgtttggtttagtcttataagcttaatctttatagtttaataatcaaaaaattaaggcttaaacgtaattttgttccctttattttttaaaatctttaattttaatcttctgtcttaaaataaatacatttagtcctcatacttttaaaaatctataatttttatctcctattttaaaataaatacatttaattctctaattttataaaatatacaatttttgttaattggtaagaaattaatttggtgtgacccaaatttagtaatgtgatataagattattgtttaatttacatcataattaatgttaatatcttagtaattaacacttttagtttgacggaagattaatatcacatattttatgaatgtgaagaactaaatgtttatgttataaaatagaaaaattaaaattacggattttgagaaaaaaaaaataaggagatcaaaattgtgaattttagaaaatataaaaattaaatatctctaatttaaaaggaaaccaaaattacaaattttaaaaaatagaaaaatcaaaattatatttaagtcaaaacttaatttatgtgatcaaaaagttacaaaatatattagtttttcataaacatttttattatttcatgtctatcattgaatcatttgcttataaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgaaggttgtagactttaatagcattttaaatttggattcggagcatatctcaaacctacaaaatcaatttataaaataagaattgtcttttatatattttattttggttatataatttatcaatgtagaatcttccacaaaaataattatttttttaaaagattcttaaaatagaaaaaaaaattcctttaaaataagttgaatcaaacacaaattacaaaaaatacttatttgtcaatatggaacatttataaatgtagaacaattttgcaatattatcctcgatttcacaattaattacttttatattttaaaataactttatacattaattttagaataaaacctcgttcaaattcttaaaaccataaacactaatcactttatcattttgatgcgaaaaatcattcatttaaattttttattttaaaaacaatattacttcttaaatttgatttcaatttactcaatttaaattttaaatattgatacattataccaaaatatatctttcctttccaaatattgatgtgtaacgattttgataacttatttctacaattttgtcttcaattttaaaatcttatcactttaatttatttttgtttatacattacattttatttaaatttaaaaaatatctgtataatactagtatatggataactagctttacctaatgtcttagcaatgaattggtcattttagagtggacagaattgaatgtggtaaggttaaaaaaatacctagagtataaaataaaaaaataaaataagttcctgctattataagcgtacttcacccaagctcacattgacccctccccccaagaaaaattacgtacaaattataagttaaaataatgaataaactgaattaagtgacggtacttcacccaagctcacactaagtcatttacaagcactgaatttgaaagagaaattagagatacaagagcaaaatgcaacatttagactgactgtacgcgaaacttgttggcaacatagagcaaatgactaatgtttgtggtgggataattttgcagcaacttgagattagaagtgaaatcacccgcaaggaggcgcttacgaacgagaacaagcattgcacagcatacccgaagaagcgtttcctgcagagttaagtgcgaagtagatcaccattatgaaaaaaacaacttggaaaagcagtctaatagcaaaatatattgttgataaaaacttaaaattgtcttgatttactcgtcaatggtgctcacttgaactatactatactcatgtagagccaaattctctcctctttcttttgtcaagtaaaagtagctttatatttttttttatacaagaggcagtggaccataagtctaaatgcaagtccatcatagtacaaggttaaatatgaaatgtacctgtggaccatctggatcgcttaaaagagtatcccaaatgtgaaggctgtccgcaaaattgaattcctgagtcagcaggagagtaatccacctaaatgcatagaattgaggattgacctgacattcagaaccagaaaaaatgagcaatctgataaactgttcaatagccaaaagcaaatacatggttgaatcatccagcaggtgtgcatgcaaaaaatgtattatgataactagtcaaaggcccgtcacttaactagttgagaaacataaaacagtataaacagacagaaaaacagtggccaaaataataattctaacatagagaaggtcataatgaagcacgaaggagccacacttgtttatttattatttagcttatttaacaaatttataacagagcagtacacaatgctagcataacagtagatattgcaatcatgcaatgtacaaataaataattaataactaattataatatcaagaattaaaatactttaacagaaatgcctatcctctcacaatatttccaaatttaaacagaaagggaactgtgagaagatgaatatatactaaaactgtcttaccttagaagtaacctcaagatggcgccacagctcttcatcatgttctctcaaaagctgggacaatctcgtaatggttgaacggattcccacaacactattgtcgagttgttgaacaaagttatctcgaaacccactcaatagctcaacaaaacaaaagaatgcatctgcttcagcagaggcctgcaaattataatagggaactgttgagcagagtcaaccaataatacagtagaacatgacattgttaatgaatctacattattccaccatattgccacctaagcaaattgtttacaacaaaatcaacattcccatgttcatattaactattttacatactttctattttatgtatacagggcaatgccgaattacatttggtaaaatttcttgtcccaattcccctaagcaatgattactttttaacttgtcacacgtgaattttttatttgtcttccctttccccattctagcagccccttcttctattaaagcatacactggaaagtatcaggcaaatgaatgaggaaacatgaactttttagaatgtatgcatacaaaaggtaaaagactgacagacttgcatacagatatagtgcatctgatcagagaagaataacaaaggaaaagtacttcttcaaatgaaatttgcaaaatcaaaaagaaaaaatgaaatttgaaccaattaatctttagaaaccacatacaattaaaatcaacatactatggtaagtggtgttaatagagcatgaattacaaacaaggacaataacagagaatcaggtgtttgataatgcaacccaatgatgatagatcatatgacaaacaattaaaagattaaaagcatatactcactgcattttcctcatctgggtcatttttgaaaacatagaatagaggagccaatatctcattcattccttgcacatatcgtacacccgggtttaactttgcaaaaataattaatatattcttcaaagcctcctgaaaatgcccccccaaaaaatagtaataataaatcaaagggttcacggcagaaaatacttgaatttggagtttgtatgaatttcaagacaaagaaaggacctgattagattttgcaaattgggaatcaccagagaaaaagtgcatatcaggatgagtgcgctttacatctcagtcaatttgatcgatgatctctgtatcctacaaaatgcaaagaaggagatttgcttcacaacagcctttgcacagagtattatagtgcattagcatgagatttatataattgtgatacaataatgaacacaagagttcattaaagattaaaatattgacagtagaaagaccattaatagtatgtggtaacaaatttgcttagcccaatttcataaagacgtttcattattggaagtttagaacaaatagatcacagggtcctcttgtactgtcaaaaaatttagagaagcattcatagtagacaataaatgattgtcattacagataaggtatatgcgatcaatccatatttttttggtaaaggaagtttcatgaagaattatggttttcagtgacacctgttcatgtaaaattaaaagtgtcacgaactgatgcatcgtgagacaatattgatggagtttatgcaacattgtcaaaatgcattgtaatttttacttaattttagttgtgagtattgttatcaataaaagtcaaaaattgctgggactctttacattgtgactctttatctcattgtaacttgtcatttaagagtcaatcatctatctataaatatgtgctactgaaatgtgaaagagaattcatccccaaaaatactctccttgttctatttctctgcacaatttttacagtacatacagtacagtccaccatatcctataattccttgagtgttttgaaactttcacaccaatgctagaataccaccaacggttttaagctgaaaggcatcgcatgatttttcctttaaattttaagtactagagcactttacaatctacctggaagaactgattccatacactggtcttcccaagactcaaaggatgctccccatgagtgatttcggatctagagagcaatgccctcgcacagttggcatcatcagtatcacaatttgtcgagttgaacatcttccttgtgatttctgactagctagccacagaaacattcagagagccaaatagataaagcaaatagaatagaatatgcatgacaaatcactaattccacaaaaattccacttgtacacacatacaccctatcaattccacgttgacacacatgcaccctatcattgtgagtttgtgacagaaagaaccaagtaaactacaattaaattcaaataattaatgtgacgacatattccttagaattatctctcttctacaaaccatagtctgtcacaagaatcaaattcttttcttcttcttttctcttctcctctcaccattcttttattttaactctatttctctcttttgctttattttcgatttatcattgggttcatctaccaccgaccccaattaatttgggttaaaggtgctgttgatgttgatgttgattctaaagctcnaaaaaaaaaaaacaaaacaaaagtttaacaaaaataatgaggatgatgacactaaggcatcaaagctccctaagcaactaacttacaggattcatgaaaatctcctctttgaattgtttgtactgtgaccgcttcttggctaattcagctgaccaaagccctcgatctggtggaagatatccaagcaaaagctgcaagtatcaaaaagcataaattgcaacagcattccatgatttcacgtccatctttccatcaataaaggaaaaaactcttgactaaccaatagcaaccaaaccatatccttacttagacttatgaacacacgacctgtttggttggaatggaatggaaataaaccactcgcatatttggttagatgatttggaatgcacatccctagtgcagaaatccttgctccatttttcctaaataaaactaattcacctaaaaatatcagaaactaaatttctattacttttctttcttaatttaaatatccattcaagcgtcactgcattcctatccatgccaaacaaccacttaagctggatttaactatagtatcaatttcatcacacacaccagaaaagaagacaataaaaaattaattagaatgcactgacactgtatcaactaaactacactcgagtgtgaatctatcatgcaatcgcagattttcataaatggtaagtttatagacttactattttaaaagtcgtatttgacatgatttttcatctgttgataatgtataaatctttacagtaatagtgcaggaaaattaaactccttaaaaaaaagactaaaatgtaggggaaaaaaagaacgaaaatgcaacctaaccttccacacagtagaacgtatcccagcagcatcaggtataccttgacacgcgaggctccgcaactcgctcatatccaccaccttctttgacaactgaaccaaaccaaatcatcacaaaatcaacactgttactaaaagcactaatcaacaaaacttcaatgtcgttttacagaagaaggcggagagagggaacctcggccagcaattgagcctggcgagacacgtcgtgcgcggaacgaaagccctcgccgtgatcttccctaggcgaatcatcgattctctgcgtcggcggaggatcgtgggcggcgggaggcgacggaggacacggcggcggctcggagggggtcacgacggcgggggatggaggacgcggtggaggtggctgttcgaaggggctggcgacagcggatgagggaggggacgacggcgacgatgaggaccagagagagctgttgagccaatcggggaccttcttcttcaccattttggtcggggggattggggttagggtttgtcaatcgtgatgggagagattaacagcgaagcgcattggattggtaacatcaacatggccgtgcgaggttgattacatggatgaactagcaactctccaattattcttaacttgattactttcgttcttaatttaatccctaaatttaaatattcatacattaaaaatttataaaaatgagtaaatagtggatgtaatatttattcattcacaaattttaagtttgcttaaaattttaagatttaatacaagaggatgttcctgatctattttaattaagttcttaaacttaaaaaaaaaattgaattttttgatcttttaaaatttgtaattcagttcttagagttagtaaaatagccctaaattattatttttgtgacgattttgactttagaaacttaattacaaaaaatttacaagaccacagacccaatataaaaatatcgcttaggaatccaaataaaaaagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttggaaggtaaaagtgtaatatattgcacatggtaggcaagtctgtacaagaaataaagttgcaaagttacatacagaaagcctattcacaaaaaataaaaataaaaaatcatgtaagatattctaacaatgaggaaaaacaaaacaaatgattgatactctatgataaaaagatcacaaatttatttcttctcttgtacaagaatcactgtcaagaagtgattttagtctcttataagagttttactccttcaaaatgttgttcacgaaaagcaatgttgtttttggtgttccatagacaccaccaagtggcaaaccaaataaaattcccccaaggagatggtaatactaggaagaggtttgcaacaaggagatttgttatcttcttatcttttcatcatttgctcataggagctctcatccttggtaacaaataataacgaaaaaaaatcctaaaaataatctccttagtcttcaattttgtttagtacattcatgagttgctactactcaagtttaacatgtttcaatatcagttaaattgcgtaattttttctgataatgtaccatatcagttaattaaacaaaacaaactccaagcacatctcatcaccaccacctccaggttggtgtctcgcggcatagatctcagcaccatcttccatattaagctgaagtcatgatacataaatataaaatattaaactataagtttgttgtatgaaaaaaaataaagaactatatgcaaaatatgagatctaaatattacttatacacaagcagtagacgcacagttcaatattaatttcattttcacaaattttagtgtactatgagactatgagacgtaaataaggtaaagaaattcatattgaagtaaaccgaaggtgtattcccaaaaaagacaaagttatgcaagaatattgagcagggcaggcctttctgatttcctgtgcatttttgtgtcttatttatattaatgataggggtgagtttctttaactttatttttttaaataagtattttttaaataaaatatacaacggatgtgtttgtttaaactatttttacttaaaataaacagtttttttaagaaacaaatagaatttgtttcttaaaaaaaataaaaaaaaatatttatataaaaatacttattttaatttatttattttaaatttaagaactcacccataattttaactctcaactaaataaagaagcaaaacaaattagaaatatgaaaattaagaagaagaaaaaaaacttatgctagatatttttttgaagagcctcatgttaagatacttagtcttctagaaattgaaacaagcaccaaacatggaccctgaacagatgaaaactgagcatatcttatgcttcaacgtatagcacagtaaaaaatacccaaactttgtgtgacatgacatgttatgaaagaaactaactatttttggtgtatgttttccgttaatgtgaataccatcgtataggaactgcaaggtctcgtattagatggtcgacctctggatgtagtcatgttcttctacacatgcaattgaagattgcacaaaacattttagatgagtgggaaaataaaacatcaattcaaaccaaaccacactaataagttgaagaggggtacatgcaatttattttattcttgaatcggtgacaaaggaagagaagaaaaccacaccagtgtggtttcaactcttgatagctagatctggttatggttgtaactcctagtgtttgtttcttcagttcctaaaatgtgttaatgaaaaaagttaagtgagtgatgtagattttcatatttttaaattgggttaaatatattttctctctcataaatatagaaatattttgaatttttctttgtaaattttgaagtatattttttattttcacaaaattaaagtatattatgactttttaaatatgtaaaagtgacatatgtttacgttgatctgtatataatcgatgtaaaaaaattatgtaaatatatttcttgttccaagcaaaaagttaaaattttacataataaatttcaaatatttttatatttataagaactaaaaatattttgttgtgcaaattttcaaatctgtgttcaggtgttcttactgcagagggaattgattctctttgtgacagagcatgatagctttcaacgttgtcattctttctattatttctaatgcaacaagcctatacttgaaattgacctgttattaattaaaagcgtcctcaatttctttaacagtttgcatttttatacaaaagaagaaaatagtataaataaatcaaaatataataagaagcaaacttttgaggttctattaaattagaagtattttacagtgtaaaatgcaaaattcatttacattcagaagatgcgaaaggaattcaaaataaaacaaatgcactgtgatttttacatagtttttgttgtatgagtaacgtgctgtccactatagtcaattagtgttgtgccttgtgactctttatctaattgtaacttcttgtagtttaagagtcattcatcttatatatgcctatgtgctgctgaattgtgaaagagaaaagaaacaaaacagtaaactattcgatcagcccttgaaatactctccttgttctatttttatgcataattttacagtacctacgctccacaccatatcctataattccttgagtgtttttggcaacttagcttgtgctatacacccacatacatgtcatgtccatttctcttcccccacccaccttcattattccttattcatattcacgtgacatcattccattgcactatatatatctacaattcaattattgatggatatcactaactagtgttttaagtaaaaaaaattatgaacaatgtattttatgcatcttaataatttttttttaaacttttagtcaatgtcttcaaaacatttattagtatttgttattgtttattattcaaacctaagggtcagtttggtaccgcagaaggctgataaagttttcatcactggaatggccggatttggagagtcaccaaactaataaaatggtaatactaaaaatactctccttagtccttagtcttcaattttgttcagtacatttgttactaatactactcaagtttaacatataaacttgatatacaaacagttaaagtgcgtactttttctgataatataatgtaccatgtcagttaagcaaattaacaaactctaagcagtacaacaaacatttcctagctaatgcttttaagagtcaaagtgccgcagcaccacctccaatttggggtcttatggcgacgatctcggcatcatcttccatattaagctggaatatcaagttacaataatataaaaaaattaaactataggttagttgtgtgaaaggaaaaaaaaaaaggactatatgtaaaagaacagggatttattcccttgatttgtattgaaaataatttaaatggatacacaaatagcacacaaaattgacgaattattttattttgtaaatcaatttttttttcatttactgagaaagtgcatattttaccacaatcttctttcttagtagtaaatattacttctacactaacagtagcgatgcacagcaacaaagtgaaataggttgaaataacctctaatacacaacactattgatgatttcaaactgcagtagtatgtatatatggcgctaatcatttaagaaaactgaattttttttcttttttaatcaaaaggtatttaggatttttatttgacattcaacaagtgtttcttccatcaaatcgatctattttggaataaaatgatatttttacttgcaactccattcttaagacgggaatttattaaactccagatcttcagtaagaaacctaaatatcaaatcacctgtgacaatttttggttatttactatctctattgtatattacagcctcctagaagggcatattaatatcattttcacaaattatatatagtgcaatatgagacgtaaagaaggtaaagaatattgtaagtgcctttctgatttcctatgcattaggcatcatctatatatactattctgccaatgtcctatttttgttgaacttatgaaaaaaaatactttgaatgatgttttattagaaattgtgatatattaaaaacttactatgtgatgatattatatattaaaacctaaagcattatgtcttatttatattaattataatctcaactaaataaagaagaaatcatgaggagtgctagtatcattctctttaacacattctaccacacattttactattggttataagaaagacacattaacataaagaatgtgtgtaaaagagtgcattagaaaatccattacattattaacatttctcaattatgagatattagaaaatatgaacactaagaactttgtgtgacttcttatgaaagaaactaaccattcttgctgtatgtttccccttaatgttaaaaccgtcataaatgaacttcagggtctcgtaatccaacttctgtcgatcacagaactctttaaatacattaattaacttcatatcccggttcaccttgaagaacaaattacgcccatcctatggttcaatgaagaaaagttaaggtgagaactcaaatgttgtattcaaattccattttgggtctttcagtataacaatgtacggttataatctcaggtgttgcaattgcatgattttagtcttcatgttccaattgtgctaattgagtctaaattaacacatttgtacaactttaatcctccacacacacacacacacacacacacacacacacacacacacatatatatatatatatatatatatatatatattatttcatatatattaacaaaaatttgttgttgatatttgtgctacctttaaaatccaattggtgaaatgtgaggattaaaatagtaaaatcacatttcggtgattaaaatcgcactgctatacctaaaaaaaactaaaagtacaattaggcttacaaaatttaggcagaacggttttacgcacagtttcatataacatttgtcataaaaaaaatatcatgtaataatgatttgatgcatgaatataactttcgttcaatatgacaatcaatatctttatagacattacaggtctacaacaactggccaatacatacttatagaagattggtgcatactgttatgtatatatgtgcagactctgctaaaaaattattacgaaaaaacaaaggaatattgtggaaagagtcaggcatacacctgaagtttgatttttaaattgacaggctcatcatctgatggagattttctcttaagtggaccattggtagccatattcttcttctgcacacacaaaggggagagatgtatgatttcaccaacctaaatgcaaaacaaaaaagttccaccaatcatgagtttctttcacaatattgaagaataaaacattttttttaattatattagaactataaaggccaaaagctaaggtctcattcccaaatagcatttaaaatcgcacaaaaactattgagatgggtagaaaaaaaaattgtttctctgtcagaatgtgaaacaaagcctccaaaaccatactaagttgaagagggctacatgcattttcttaattttattcttggatcagaaaggaagagaaaggtgcggaggaataaagagaaaaaataaacccaccaaaaggacagagaagtgagcacaagaactttttggtttcaaatgaaagctgaaaccttttatgattgtgcctgtacgttgtagtgtttgtttcagttttctaaaaggtgttaagtacgataaattattagggctcgagaactattatgatccctattaatttttataagacatatatttttttggtcttaaatgttattaattattttcttatcaattgaaaattcttggtacttactactaccatataaagattggttgagattatatacttgcggactacctaaataaatttctcgttaatgacataaaggttccttaagtagtactgagtttcaattaccaaacaagtcacacaaaaaaaaaaactgattattcatatgattagaaaacaagtagcatgtattttcaaggtagaacttcaaatttattcactaaacattgcaatccgaacatataaatacgcgatagtgagctcttcaaaagagctatcagcaaactatttcaactgagtaaaaagctaatcaagcgatgaacctggcataaaaattggaaaaatcacaaaaataaaaatgaaaacataaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaactcacctggaaatagcggagtaaaggaagtcatagaaaagagagagaagtttgaagctgagaaaaaggctttcaaaaaaaggtagaggggggagagggagagaaagagaagtgatatttagttaagataaattaatttattaacttcttcaagcagtttttctctttcagaattttaaaatgaattgggaaaataatcaaaagatagtagtactatttagcaaaggctgcaatttttcaaagctcctagttcccagaaataggtgattcagattctctccatgtactgaaactctattgtgtaaattttcaaattgatgtttgacatccaatttcactactgctcttgcttttcataaggtggtgacaatacattgctgcagaggacattgattctctttatgacagcatgatagctttccttctttagatttctgatgcaacaagctacaagcctactaaattaaatgtagtgctgaaactgacctctcattaattataagctctctcaatttcttggccaaagtaccaaaagggaaaattttaaaaaaaatttaccatttgggacaaattttaatctaacatcaatttttggataattcatagcatatattataatttctaaattaaaaatcgtaacatttgttataatatcattttttttacattgaagtcataaaatattttatgattttaatttttttaattacgactttaatgtggtttgagttttttttatgacattaaaatcataaaggataatatttttttattgaagtcataaattaatcacttcaattgttaaaaaaattatatataatttttattttaattatttaatgaattaatgtatgctttcttttttaattttatttaatattttctatatttttttatatgattttattcaatatttttaatattattttatttaatatattttctatatttttatatgattttatttaatattttcttaatttttctatattattttatttaatacattttttatattttaaataaggtaatatttatattttttatattgttttattaaatatattttttcaatttaatattttatattctttattattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattttaataactacttttattattaaattattttttattattaatattaaaataatttataaaataaaattaatattattatacaaaattattaatttatttaatgaaaattgtaaaaattagttaaattttttaaaaaattaatattatttgataaattataagtgaatattattggttaatgttaacaataaaatattttaatatttttgtttaacaaatatttaatatgttttaatatttttatttaaattgaagttttaatttacaaaataaataaaatgatataaaaaatattaaataaaatcataaaaacataaaaatattaaataaaactaaaaaaataaaacatacatnnnnnnnnnnnnnnnnnnnnnnnnnnnnnnnnnnnnnnnnnnnnnnnnnnnnnctatttaaattagaagtatagtaagtaataccgtgtaaatttagtaagaagaaaatttttagatttttacattattattcacttaccattatgtttaaattttaagaaaactgaaacaaaatattgacagcctttctcctatcttctgatttaccttgaatagcaccctagagagagatggattgtttaagtgcatgtttaattaaaatttataaacataagtttgggtcaactttaagtttgcaaagtaaatttacaaaaatatttaaagtcttgtttttccaaaattaagtttccaagcaaaaaatttaactcaaatatattgttagagaataactaaacatgactccaaattatactctcaaagatacttttaaaccctctcaatagaagtccaaacacaccctaaaacattattagttggtaccttacaacaaaggcgcagattccaggaaatcaatttctatgtgcggcacattccagaaaagccttttgacacacaaatattatatatacaaaatcaatcaatgaagaaactgaaaaataaactaatcacatcacgtactaaaatcaacaaaattcgataaatccttacatcaccgtttcccatccgaacagggatttcatccttgatttcgcaaaatgttatgtattcctccaaaagttgccttatacatgatatgcttgcaggaatgtatgacatttatgttcttctcaaagaatatatttttgacagtggtgtatactctcttttttcaaagaataccaaatccattatagaaagtttgactccattttgatcacaatgctacaatggaaggtgcaccaaaaaaattgcacccggacaagaatttaaaaaaaatcaatttacaaggaagttacaatagagaaaaaatactactagatcaatttgtctattaaagctgaagactagatagtccttaaaagctctctcaaattagccaatacatggcgtggtcccaaactcttggcatcaacgaaattcaaaagctgttctaaatcctacagtcagaaaagcacgagggaaaggagctgtaagtcaaggttaatcaggacggataatgtgtacacagtacaatatatatcaaatatcgttcaaacaaccacacttcaaaaaaaaaatcaacatcaacatcaataatacctttaatccaagttaattggaattaatggtagatgaacccaatgatagatacaaagaggttcaaaaaaaagtggaagcggaagggaaaatacgataaaagaaaagaaggggaaaagaaaaagggaagagatgaagaggaaaaaggctaaaaagggaccatctgaaatatagagataacgatgagtctaaccctccaccaagattatagtttttcctcatttcgtcctaagacacaccgtccgccaatttatatctcactccattaagtcttgtttaactactttttctcatgtaagtttcggtctacctctacctctctttgtgtcaagttcttgataacaaacttttgttcagaggccgtctcattatgggtctaaaccaccatagtctatattccctcatcttttcactcaccagtactattgctacctttcgccaaatatcttcatttcttatcttatccatctttgtatattcacacatccaccttaacatcctcatttctgttacccctattttatgttcatgttgcctatgtacttcaagaaaaaaattaatgacagaaaacaaaggcactaacaagtatgggagaccatatttgagatataatatagaattaaaagtctaagacaacctgccagccaacaccaatgcaaaaccaacagcctgtcaatatagtaaatgttaatcttgctactcaattttgggaacaggatcacctacagttgtttgtaaactgcagggtcctgcagttaaaatcaaatggtctaaaatgttgtaaggtgcaacttattttatttttcagtgtatgtaatgcatttttaatggtgatgatttcttgacaatggaaattcaactgcagaacaatcatagttttgttttttggtaggaggaaatctttgggggaaaaacaagagatgagtttttaaacagatgtttcttagaattaaagcatctcatgtaagcataactaaaaaacaaacttctaatctttcatgccatgaaacgaacaaaggcatttggctcctctggagtaagtaatctcagctgttgagtataaataaataaaaaagcaacggtcaatattccaatacatccccaattggttatgcatgtgcatgtgatattgactcttgattttctcattgacaactgagatttgttactctgccctcttaagtgaattgctcacttttgaaaaatcaaatttcaaacaaagagttgggaaaacaaaaaatagaaaagaaaagaaaaaaaaaaaactaattctggaggaggacctgtcctcacttccagttagctaacatatacagtagtgagctttattctcatagtaaaatggaaatctgccaattcagtctcttttcattacagagaaaagcacaagcaaggccanacatatacagtagtaagctttattctcatagtaaaatggaaatctgccaattcagtctcttttcattacagagaaaagcacaagcaaggccaaaataatttcttaatcaaccaacatgttggaaattttgagtagagtcccaaaaaaagtagaatactttctcttacaaaaagcaacacaaaaatcatagccagaaagctaattacgtgaaacaaatgggaagtaaactctaaccatgcaaaagcaaaacacagatccggcaatcttgcaaaatatggtaatgcataaagtcatcaacaaatataaaatgtccatgatccaaacaaataaattagataaatgataaggggcagaaagtgtcagcaaaaaaatgcactaaattgttttcttgggaattctgaaggagacaatgaacaagataagactacccctgttatgttttgccttagttcaaacaaagcacgtaaactcaacgattgagagtaactacaaagcaaaaataaatagaaatatataccttatttagtaagaaaacagcataagctgctcttgtggtgtcttgaccttctaaaaaaagagggaattccacatgtttggcgtttatgtttgcatttgatgaagcttcagaagatgttagctctgttgaaggtgcattatcaataatatatgaatgagaagcacccaaccgtaaaggatatcgcaaaggaacttgcaagtatgaggctataagtgaaacagcctgcgagaaaatcagtctagtaaagaacatttcaataaataaataaattttcgaaaaggaagacatttcaataattattagctcaacgatcatccacttgagctacaataagaaatgctgcagctggaacacagaagtttggtatatgatacgaaaaagcattgacaattaagtttgccatatacaagacatgtcaaaatatgaaggcttcaaatacattcttcgtcccttcaaatatactagttttcggttttaatcccagtaactttatgtttctaatttgttaacatttttagttttggctcttcccattagtcatgaaagtgtttttgtaatggaagaccaaaaaacagaaggtttggacattataaagatcataaaaaaaaatgtatttaaaccatgatctgtatatgacaatttagaaaccactatattagtaaaggatggaaaaaggtatttaaaccaaatatgtatatgaaaatttagaagctgtacatcacatattttggaaatggatcacaaaaggcataagaaagaataatatgaacagttctgaggcaaaaaagggccgggtaggttctaatacttacatgtgcaacatatcctagggctgtagcagaattctgaatttcctttttatcagtgaaaaagctcatcttcctaaaagatagcacattcaaatgcagaccatgaattgttaaggatccttgattaattggttttagtccagcagaagtccctgagtaatgaaataaatgaaacttttacaataaaattcagcaaaaatatcccttagaaatgcagtgaatattagcaaaaaaaaattgtgataatttaaattagcagaagataaactatacttaacattcaatgaatagctatggtcttctagagcatccaaaggatcaaccataccaaaatctacagtaccaaactaaattataaaattataatttaaggccgttgtcaatcagcaaaactagtgcagaagcatgaaagaaaagaacaagatatgaggcacacacatcagacagacgaagtacagaatgaaagacatcctttcaacacaacagtccaacttacagaagaactatatccaaggtgccagtaagaaattaagggataatgattgaaccatccagtacctcaagtttcttagtttatttaaaggcttaaatatgtttttaatccttcatatttgggtaattatttttttagtccttcaaaaaaacacttattagtcccttaaattttcaaaaagctactttcagtccctctttgttcattgtgtttatggtttcaaatgtggcagtttttaaccaccaaaataaatatttttaatttaattttttaaaaaaccatttctagcgattttaaatcgccaaaatatttgactcatggattgttggccgctttttacatattttggtattttaaataagaaaaataaaaacatggatgttgaattgtgacgcttttttacatattctagcgattttaaactggcacaaatcatttttccaataaattaaattaaaaaaattctagtgatgagaaatcgccacaaattgggacaccattaatgcaaagaaatagagggactaaaaatagcttttcgaaaatttgaggaactaataaaaacattttttaaggactaaaaaaacaattacccaaatttaaaggactaaaaacatatttaagccttatttaaattgtaagttttgtattttgcatgaccgaagccatttttttaccttaggggcactatccacacacaaaaaagactattattgagctaaccattacctgccaggctgcctaaaggatatgcttcaagctcttgctcttgtgctggtccaaccaagatcttaacaggatagagcattgaaatttgagatgtcatgtattgttgcctcttcctgagcatcttttgcaattttatcagatgaacataaccattttcttcagacagaaatctacttgattcctataataaaagcatcatcagctttctagctactagaataacaccagtaaaatacaaacaataatcccttcccctaaaacaaggaataatgataacttatatatatattcagctaaataaattcgtcaaataccatttcttacatggactaatagagaaaagaaagcttttaaaaaatgaggaaatttgaaataaaacaagaagttcatttctgaaggacaggtacaagtggagctaaggaagatatactctattcaattgaaaataaaatcagtcaaaagcaaaaaagaacaatactccaaatgtcaatttgtaacacatacttcaatatcaataaaatgaatcaatctttttaatcaagacaacaatgcattcccccttgtgaggtgaccaaaaaagatataattgatgctaagtcgtgcatggcattgtggggtgatgccgataacaattgggaatatcttccagcaatcaataaggctggtggattactatgcatatggagcaaggaggcatttgtgttggataacaagatttcaggggctggatttatttatttggaagggacatgggtagcagatggcagcaaagccacaattgtcaacatatactcaccttgtgagttatctatgaaaagaaggttatgggaggatctaagacagctgagaaatacaaatatggggggtttatggtgcattataggggactttaacaacatcagaagaccacaagagagagtagggatatgtcagagataccaagatgaaggcactgtaagagagttcaatgaatggatagcagatatggaagtagatgatgtcccctgtatcgggcgactctttacatggtataggccaaatgggtctgccaaaagcaagctggacagagccatggtctcagcagaatggatcgctaaatggcaggatacaactcagttcattctagttcggaatttctcggatcattgtcctattatactgaggtcatcgctggctgattggggcccaaaaccatttcgggttttggattgctggcttcaggataatacattcaggaagcttgtgcaggaagggtggaattcaaagcagatcagtggctggggtggttttgttttaaaggaaaagcttaagaacatgaagcagaaaattaaggtctggcacaaaacacattttggagacatgcagctgaagattgaatcactacagtcagaacttaacaagctggagactgaaggggatgacaggcattttactgaagatgaggtgctgaggcgaaaacagttacaggaggaattatggaccgctgctcaggcaaatgcctcaatcttgaggcagaaagcaagatccaagtggatcaaggtgggggactgcaactctacttactttcacatgactgtaaattggaagcgcaatagtaacatgatcagaggcttggtggctgacgggagctggactgatgagcctcacagagtcaaagaagaagttaggatgttctgcaagaagaaatttgaggagcccattctaaacagacctaatttagatggcactaacttcagtgccattgaacaacacaacttggagagtttggtggcaagatttgatgcaatggaagtcaggaaagctgtgtgggagtgtggtaacgaaaagagtcctgggccggatggctttaatttcaagtttattaaagctttttgggatatcatcaaagccgattttctccgtttcatggatgaattctatgtaaatggtacaatccctaagggtggtaatgcatcttttacaactttaattcccaagacacatgatccacagggcctaaatgatttcagacctatttcactagtgggctgtgtctataaggttgtggccaaggtgttagctgcaaggctgaaaaaggtgatgccatctattattgaccaacgacaatcagcttttattcaagggagacagctgctgcatagtgttctcatagctaatgaggtagtagatgaggcaaaaagatcaaatagaagctgtcttgtgttcaaggtggattttgaaaaggcatatgactcggttagttggacattcctgtcatatatgatgaagaggatgggtttctgtcctaggtggattatgtggatcgaggggtgtttaaaatctgcttccatatcagtgctggtaaatggaagcccctctgcagaattcacacctcaaaagggccttagacaaggtgacccacttgccccactactgtttaatattgtggcagagggcttgactggattgatgagagaagcacaggcaaaaaacctgtttgatggctataaggtggggagaaacggagttgatatcagcctgttgcagtatgctgatgataccttgttttttggtactgcatcaaccaaaaatgtgaaggccattaaggtgatgttgaggaccttcgagatggtatcggggctgaagattaatttcgcaaagagcagatttggggtttttggtagggatgatcagtggataactcaagctgcaacatatctgaactgtagaaggctggttttccctttttcataccttggaattcctattggagccaacccaagacgtcttgagacgtgggaacccttgattaaaaaatacgagcgaaaattagctagatggaaacagaaatatttctcttttgggggaagggtgaccttgataaagtctacgttaaactcgattcctattttccttttgtcttttttcagggcgcctaagaaggtcatagcttgcattgagaggattcagaaaaggcttttgtggggcggaactgatgagcaaaggaagattgcctgggttagatgggggctgatctgccaatcaaaggagcatggggggctgggcattaaagatttaaccaaatttaatcaagcccttacttggtaaatggttctggaatctttttcaccagccacagctactatgggcacaagtgttacaatcaaaatatgggggatggagaagcttgactgaaattacaaggaatggtaaagagtccatttggtggagggatctcagctcattgtgtaataatgatgagaggcactggattagaagcgggattagctggaaggtgggaagtggaaacaggattttattttgggaggacggatggaaaaatgatggaatcaccctgatggaaaggtacccaagattgtaccagctttctaatcaacaacaatttttcattcatcagatgggcaaaatgactcaagacggatgggaatgggagctcagctggagaagacatttcatggagggggaagttgctgctgctgtaaatttcatgaaggacattcaacatgtggtaatacacttacagcaacaagacacttggagatgggcggctgatttgagtggaagttatacagtgggaagtgcctaccactacatcgacagtgaactgaatagtttgcctcatgagggtttcttcaaggtgttatggaaattaaaagttcctaataaggcactatgctttgtatggagattgtgtaaggataggttaccttctaagatgaacctgtgtagaaggaatatggaaattattgataacacctgccccttttgtagaaatagtgaggaggacgtatcccacttattcttcagctgcagtaggatcatacctctctggtgggaatgcttgtcgtggataaaggtcgtaagtgtatcgtcagcaacccctatagagcactttacccaacactcctcctatgggaatattgaaattagatcgatgagatggcagacctggtgcgttgcattgacctggactatatggcgtcataggaataggattatcttccatgctgcgacgttcaacagtcaaaatctgatggaggatgcgctttttttatgttggtcttggcttaaacatttggaggatggctttactttccctttccacttctggtcctctaatatgggagaggcttttgttatcaggggagggtagttttaagctgtattttttgttatcctagttataggtcagaactcaggaggtcttttccatgccttcatggtttaaacctccttcgttctgttgaacactaggttctttttgcaatacctcttgtaatgcagaaactttttcatatatatatacatattatttttgctggtcaaaaaaaacaatgcattccccctagaactactgaactttttacatttaataattatttccaggaaagaaaagatattatatgaaaattcaactacaatatgacataaactcacctggagatttctgctggttacagaaagagtaccccctgccaccaaaagtgattgcactgcaccactaagctgctcctcctgcttgctagcttcctcctttgccagcctagaacgtatagacatattctccatcaccattttctttgattccaatttttgacgcatctcctcaagttcattcaaccaacccaatgattcagcattgacctgttaggcgggctcattaattagggaccagtaaaaaaacaaaaaaccaaccatgcacctatatattggaaacaattagtgcaaaaaagcatcccaaggtgtaaacaaaaactaaaccactcaataccctgacaagactgaattggtgtgctaaaataaaatcttagcagcatggttatcaatctgggataacggcacagagcaaccaaccccaaaacggccacagcaagatagcagatagtgggatgactactattacaaaatttattgatataattataaattaaaacaatgtgcaagtatgtgcacgcgcgctaaaaaaatatacccacagaatgagagttccacagattgttagttggctggaaacgcagttgagagctttcggtcagatggtttacaacgaagagagaagagaccaccccctttgatgtgaacagaacagattgcaaaggatgtgaaccaagtagaaaccacagaatggtgtgccagagttccacaggttgtgggttggctggaaactccagagtgctacggtttggccagcaatgcagttgagagctctgtgtaagatggtttgcgttgaagaaagaagagattaatgagagtaatgtgttatttaaccttagaaaggagtgaaagtgggaaatagtttgtgttctgatcaaatataagagggggagggggaaaaatcccaagattgcccctcataaacagcaccaaatgacattgttcaagggggcaaaaagggggtttcgtctttgatgcaatgacaaccggaattcatgccactccaggcacaacggtgagttgcgacatgacaggcttccttggagcaggccatagacatgacattccacgacaccactatagcgtgactgactattacgctttgcaggctattctgagttggaatttgggaatcaagcatttccctttgttcagatatcatggatctactcatattggacacattaaccagttaagatccaagatatgcaacagaaaaaattcatggcacactaatgattgtacacctactcagacccactgataaaatttaaaacatgaaatgatcagtgtaaaatcatatgtttgatcatcagaaaattatttctcttaaatcctctccaaaaaaaggtaaatatgcctcatactataatttataatcaaagttatgtagttctttctccttattctgataaagaggaagattaagtaataaatatttatactaggacaaaagaaagtgcctagtcagagataatgtgttcataagtaatcaaaggtaaagaaacagactgaaaacacacgtcatcttaacatgactctccaatctctgtccacagacctttccagttaccactgacaaggctttcaaaaaaaaactgacaaggccaaaaggtaaaatttaaaagcataattaccaacagaaacaagtgtattgtagatccatattaactaattattgacaaagaaatgaagccaacaaagattgatttagttaataaggatcaaagccacgtttgtaaggcttaggtccaccccccccccccaaaaaaaaaaaaaaaaaaaaaaaaaaannncccccaacttaactttttttttgttacccaaaacaatgaaaaattagagatcaactggtccaaccacaatacacctcagccctattagatagtgatgtgtgcttccaagtctctcgctaatgaactcaaacaccactacccaagaccaacagatcacagtccattgtaaggcttaggttcaatccctgcccccacccccaaataaataaataaaaaaaatgtgttgcccttggaattatacacatttggtcccaatttttccagagaaaataaccgcactgtaatcaaaagttctttatggaagccggcaaaaaagagactatttttccaaaacaagctgaacaaacatgtacattttcttcctccttaactttctattaccaagaacaaaaagagagatgaaagatcatccagtccaatcataataaacctcaaccctcctactggaagctaacattagctctttgtctcgttcttgaatcgattggaattgaaatggaataattaatctatttctccgcctctttgctaataaatccgtagtatcatggaaaatagtaggatgtgtaaaatgattgaatttgaagcccctctcagctaccaacttaaacattacaatccaaaaccaaaaaagtaataaaatagcctagttgtgaaccgaaggatctgcttaaaccctaaatggaaaatgagccactaataaataagaaaataaacaatttgcttctaatttatgatataacgcaacgaactcaatcccccaatttccgattagatagtgatggacttaaagcttctcagcaatgaactcaaacaccactgtccaaaaccaaaaaataaccacaatcccctctaccctaaacacacctgcaagcaaaaatcactataaaccatcattaaggactttagcatgccttggcagtggaattaacacacatttggatcccattttttctgagaaaataatcactttgttatcaaaagttctttacagaagctggcaaaaaacagattatttttccaaaataagtggtgccaaacacctacaattacacnnnnnnnnnnnnnnnnnnnnnnnnnnnnnnnnnnnnnnnnnnnnnnnnnnnnnnngccagtccaaccattataaactcaaataccacaatcaaaaaccaacttatcatgtatttatgacttccctggtaatgccttaaaggcagattttgctggtgtttcctttccaagaggtttctaggttggttaatatattgaataggcttataaggagagcccaaatgggccacaagtaatacaaaaagaaaataaatagtttgcttttaatttatgataaatacaacaaaaatcaatcccatcatttcccattacacagtgatggacattaaagccccccagcaacgaactcaaacaccacagcccaaaacctgaacaccacagtccatggtaaggcttaggtcaatctcctatccccccctgccccaaacatacacacaagcatgaaaatcaccttgaatcatcatcaagacctttagcgtgccttggccttggagttacacacatgtttggttccaaatttttccaagaaaataatagcttttttttcaaaagttctctacggaagctgacatagggagattatttttttccaaaataaccagaaccaaacacatacattccctcccccttaacttccagtacgtttggaaacacatttcaaacacttcaacccaaaagatatgaaggggttccttccaccaacttaagcacagcaccccaccaacggatttccaaacatacgcttactattaccaagaacaaagagagagagagagagaagagatcatccagtccaaccataataaacttcaacccactaaacagtgatcgagatttgaagtctcttgctcaccaacttaaaaaccacaatccgaaaacaaaatcgtaataaaacagcataggcataaatcgatgtatccgcttataaggtgaaccctatttcgcaaacaggcaacgagtaattagtaataaacaaaataaataaatgcaattatattcgtctcccttccccaattctatttccttccgccaagaattttcgtaatcaaacacagaacgcgatacgattccccactcaagctcgcattttccacgagaccaaacgcgctttccctccagccactaaattccaacttcatttccatttaacttttcattcattacagtaaactcgtcaaaagcgcaaacacaatttccgtaactcaagaaacgcaggataacatcgtcatcataaacccagtttcggcattttgcaatggctaaacctaaaaccaaaactaaaactaaaaccctacctgaattagggaatcgagcttgtgctgaagattccgtttcctctcgttggcttcgtggagggcggaagagagactcgccaaccttgcaagatcgtgctggaagtcgtcccactgaatgaccttcacatgatcaggatcagttgtggtggtccgcaatgacagaatctggcttggttccatcgcggatcgaactcaccatcgtcttcgagtgagtgagtgatcagcgtctcaacctcatcatcgacccctcttctgattttcttgggaaaatgacggcagagaaggaaaatcgcgtcttggtcctcgataatgaatgttgcaaaagttaggctttttttattatgcccgcgaaatagtggacacgtgggaaacatgcgcggtactttttttgcctttgtacatttggtccctcgcgtatttggatttttctagtatcacaaaagtgaggaaatggattctatgcaacggtagggaaagtgattatgaaaaaattcagcattatactcttaaatatattgttcttaacatactttcttttacaaaaaggttttggtttccaaattatttaatttaatttccaaaaaaatttaagttctaattagatcctcaaattcttaaaaatatatcaatttcattatttccatcaaattgatgtcgttaaaattcgatgattttatttaccaatagtgacgattaaaaattatcactatatttttttaaaaaaaaccacagaaaaaatatcagcacttagactcctccctcctccgtccacactctacaatgttcttcccctcagttgcaaactacagaaatgtcactccatttgtgtgcgatcaccatcgatggtacgaggtgcagccagatctcaaccccgaccacaaccactgccaaatcttgtgatttttatggtgcatatcaagcctctttggtgtcatgctccattgcacttcttcacttagtgtatggctggttggtggctttgtgtatgctggtagtggttgtgggtcgtgcaaggtagtttgcagttgtggggacaaattcacgttatattggaggttggtggttagtggcaattggggtggcggcgatgggtcgtagtgattggggtgtgcggtggtgtgttgctcgtttcgaaatattttcatgtttatattgtaaataagaaaaatatatagcggcgatttttaactgttactatttgtaaataaaatcaccattatttcaatgataacgatgtcaacatcattttgacaaaaagtaccatacaaataggataagtatgatacacttgaaggctagcaaaatctctagatgccctagacaactggagtcactggattagcttgcttttgaataaaataaactttgtagtctagtttagaacttagcaacgttttgcaaatattgatgatgttatcaaactcattcaacttcatcttctgacaactgatacttaagactattgttgccaatctatttcgataaccactttattgaaatgcagttcctaagcccactttatcgcatgaagaagagctagtgcttatccttcgtgaatactagacacctagatacaaagttaattatcaacaacatcaatatcaacaactactttaacctaagttaattggggtaagtgatagatgaacctaataataaatacagaaaaattaaaagaaaaaaataagaaaaaaaaaagaaataagataaaagaaaaaataataattatataatagtattttcttacatcctcttcaaatcttagtatctctcgatgacccctgagtgtatgatgaatttcctcttatgagtttcttctagaaaattatactatcagtcaataaagtacaactctattagttcacaagagattgcaaatctttttttaaagttttatttcttttaattaactacctaaggtcgctaccaaatttaacttgtgcaggttcacacttaaagcaatgagagacatccaaattcacacatctaaactcattgtgaaacccaattatactaaggtacattagcctatatccaacaacatccaataactttttccatccaaaatggaggtaactcatctcattcagatatattggcataaatatgttttttagtcactcgaatgtgagtcattttctttttaattcgccaaatttgaagttacttttttagtcctagaatacacaaaatattatttttgtccttgtgtaaaatgtaaaccaaacagaaaataagagactcacattttttgacatgatttggcacggtcaaaatcaagttaataaaaaaatttcaagcaatttatatttttttactaacttgattatggcagtttttaaccaccaaaagtatactttaaaatacaaaacaaaatcaaattttggtgtcaaaagttgtcacaaattgcatttttcttattctatgttaggctcgtgctatacaaaatgactaaaaataacattttatggatttcaaggactaaaaaaatcaactttgaatttgaacgattaaaaaatgacttaactttgaaggactaaaaacacatttaagtcataaatatttcatcctgaatggtaatatccttcatttaattccaagaatttaatgtatatttatcattttttctcaaaaggtaatgactgacccttaaaataacaaaaatatataatttttagtaattatcaattagattctcaattcttatcatgctaaaattctcatcaagaaaaacaacgaacaattggatttcaacacacaaaaaagttcaccttaaaatcctgaaaattcttatgaaaaccttaggagtatgtttggatgagacaatttaaaattctaaagaatttttaattctaagaatttcaaatgcttcaattgaaattttttcattttcaaaatttagtgtttggataaagaaattaaattttttcattttcaaaatttcgtctaattcagaatccgacccacttcgaagtcagcgatcttcacatgcttctgtgagtttatcagtagattcaagggcttgatgtccctaggcacaatgtgctgtcgatgcaggtatatcagtccctgcagaatcttgctaagacaaatctgctaactgttgctcttgcaggaagtgtttcccctccaacgacctttcgtccataaactccagcaacacttggatttcgctattctgatagtatatttcgtggcacttcatcacatttggatcatccacgtcatggaggatctaccactgcactgactcctcgtggtgaccatataagcgcgtacacgcgtccgctggtgtagtggaccatctgagaacgggatcacatgttgcgccgtcactgccgtcaataggggagagtaagtggcactgccaagttggtgtcccgctgcagcaacgtcaggtcctttcgatggcgctggggacgtcagcgacaaaagataatttcaatttctcatgttttagaagaaaattaaaattctacatttttagttatttaaaattatattttaaaatttcaaaaatttcaatttttcatataaaaacataaaaacaatgaattttagattaaaatattttaaattttctaataaattactttcctcacttaaaattctttattcaaatacactttagaggaaattgcattcctcaataaataactaaatgaaaaacaacaattgggttgcacaaaaattccaacattttcttatcaataacccttaataaaatcacatccactaaattcattccatgaaaatttagaaaagatattgttataatcacttcttgaagacctttaattaagctcaaagtttatctaactgctgtgttaggattttttccccaaaaataaaggcttgggcctgagagaaactcattaaggaagttaagagaggttttcagaatggtgaaataagtggtgatgagggttttgattgtctttctcaaagattaaataggtggtgaaataagtgtgtatagattaaaaaaaacttcatttgagctctttctcaaggatggtatttattttcatctgcaacgagattttcatatgcgaaattgaggagtacatttcatatgatcggtagcttttattccaacatatttatcgagcaagcaactcatatgcggactagcttgacaaatcatcatcttttttgcctttgcaaaattgagaattttgtccctaactcatacacatgcttaatcgatgtagcagacatctccatggtgagaatttgacttctcttttctttttcttttcatgttttcctactagtaagaaaacattttagcatgtttccattaaatattggatgggttaataggtgaaccaaaattaatatatatatatatattaaaacagtaggaacagattaaaaaaactatatatatatatatatatattaaaactgtaggaacaaattaaaaaaactaagttactaaattgtgaaataatgttagtaatcacaagggtaatttaagaaggaaaaatagacgataaatacatcaattttctctttataaattagaataaccagtattttagccttgcacatgataaatatttttataatttaaaattataatttataatatttaaatcatattataaataaaatttataaaaaataaatattttttaacatataaattatattttaaatttattataaataatttatattctgacatattgttattattaatcattaataatttcttttaagaaatattcaaaataaagttagaattaaagatttaaaaaataataaattaaaatagataagaaattaaattaaatcgttcagttgatattattgttagaaagatatataaattttgaaaataaaatatatatttgaaattttttaacgtctaaaataattttttaggacgaataataatgataaattaataataatttgttagcggtgttgttgcatctccactttactcctgagaaagcaagggcaagcagtcgtcgtaggtgctgctgattggtcaaaatataaatccaattgttgaaatttgttacttgcactgcgtttgctgcatcagaatcaatggcaggcgtttctctcaagtgcggtgactgcggtgctctgttgagaaccgtagaagaagcgcaagagcacgccgaactcacttcccactccaacttctccgaatccaccgaaccggttctcaacctcgtctgctccgtttgctccaaaccctgccgatccaaaaccgtcagtcccactctctccgatcaacatttcccgattctcattttagggttcaataccgcaatttccttttattaatatattattattattaactgaatatgttactgttggttggatcacgaacataggagagtgatttgcacacgaaaagaaccggccacaccgagttcgttgacaagacttccgaggccgtcaaaccgattagtttggaggctccgaaggtggatgcaactgcttcgtcggaaaacccttccgctgctgcatccactgaccaaagtgaaggtaatttttgtttttaagtttagttaattaaaatttaatattcctaatctatgattgttaatctataaaataaggacgtaattactcgtttggttatcatacctgcataatctttgcagtttagtctctatacctcgaattattcgttttagttccaatacatacactttttaactcttattagttcttacatatacattttttaatctgttttaatccctacgatctttggatgccaggaactaaaactgattaaaaagtgtatgcataaggattaaaactggtagtagttttaggtgtaagaactaaaacggaaagattgtgtaggtatagggaccaaacgaataattaaacctaaaatggtttataagctcagtggttaatggtgatgtagttttattttgtatttttgcctgattgtgatttatgttgtaaactgcagaaatggttgttcccgaagtggacaagaagctgctcgaggaacttgaatccatggggttttcaacagcacgggcaacacgggcgcttcattactctggtgaatttacatgcagtcctattcttttgttattgaccatagttgtgtagtgttctttacgggttcaagatagagatattctcttatttctggattttttttcttcttacttgttttttgctgtctcatgtgagacccttcaggtgagcttactattaggttgacctttggcaccttaattcgggctgttaccatgtattaggttgccaaagttctggtaggctccctgggggtgtttttctttctcagtactacttgtactcatctttattatatatatatatatatatatatatataatattatctttgctgataaaaaaaatgtgagaagaccaatagaggcttgtgtagtttaagtggatcaaacggaggatggtccaagtaaaagaaatagaggaagaaccaatttagtttaccttgccctgaagtgttttattgaaaatatgatttgcaatagagcctaggtctagtgtgttgattgatcgtggagctgatcccacctagtgtgataaggcttgattgttattgtttctttttactttttctgtctgtccaagtgttatcaatggcaaaaggccaaatcctaccatataaacacgcccatggcgccgaaaagcaggcctccctttacaagttgcttatagcggttgccaatctgccatggtgaccatggctgtgccatttaacaacattgttctgtcttgaaaattacgtttttatttttattggatagttcgtggaatagagaactgtagttattaatgcttcatgggacatttatggagtatgttagctgtttcatttatacctaagtaattaccatttgttctaatagtgctttttgtcacaggacattcttggacgttcatgaaatatttttggcgtattttattaaaaaaatattgatatttgtatccattaatcattattgtatcacagagcatctatttttgcttttttgaaggaaactttatgatattgttggaaattagggtgggttaacagagagaagtgagtacaatatagccaggaaagggacttgtttattcaaagtttataatatttatatatgatggcaaatttgatttaaaacttattagacgtaaatcttagtttccttatttacggatgacagtctttggatctaggatacatgagtagtcaatttaaagggtattttcaatacaccattaatgttatttatatctggacattgataattattgagtctctagatattaaacctgggttctcccttctacaggtaatgctggccttgagtctgccgtaaattggatagtagagcatgagaatgatcctgacatagatcagatgcccttggtacaatatttatattttaatatcacttattgtcattatgtgcttaactgcttattacttcatgagtaatagatctgatgttgcaaacttcaacaaaaataagactagttcatattatgaacaaatcttaaaatgcattcagtgtaattaagtcacactctagtttctaacctgctgattaatgattcactcaggtacctgccaacaccaaaattgaggctcctaaaccttcgcttaccccagaagaattgaaggccaaacagcaggaactaaggtataaaactgaattcagataacattcatactaaagggcgaagttatgaagctattttagagttttaatattgttatggacaaagttctagagaataattttagatatgtattgattcatttgatagaagtaatgtatgatgatgacctagggtaatccctattctgctttcacctgacctctaaaggaaacagttgatgcattctggtatttttgtcagtaccataggctgattaagtgaacacctaatattaatatcattgggtattgcaccctgatttataagtcttgaagttgttaactgttagagattagaaatgtgtctgcatatttctttgtcctctatcattgtgtgcaagttatgtacatgccattaatatataacagtattaatgttagccaaattcgtgtcaatgcattgtgttctggccttctgaacttttgctcagttgatattgtcatatgaagtttttgaaaatttgtagtttaatacatgcctacatgtgtccagaactatagtttacgtgtgcttacttttaagccgatttattattactggtatatttgtagtctatgtaatcattgattttttaaactataatctcaagggagagagctcgtaagaagaaagaagaggaagagaagagaatggagagagaaagagaaaaggtatattgcagattcatccatttgattctcacttatttcttgtgactttcattactgatatacacatgtatttaaaatccattatggaagggttccatacttgttgctttgcctcacctggtcaaaggttgaatttcagagcaagatagagtgagcttgttagtgacattgcaagcccaaatgactcttctgaggggcatgttagagatataaaatcatttatgagcctccacttaatagcttaagcttttgggagagttggtcctcagcacatgatgtagtattgcttcaaaaatcaataattttttttgtttgtcaattattgtttttaattatatcaaagtctatattgtaaatgaattgttgttcctgtaacatggtaaagtttaggttgattaaaagtaatagattacctcatctcagtcatctgtgtattagtatattcttgaattgaagttcacgttagtaaatgtaaaaaaaaaataattctaggctgttaatagtattttgggaagttttattgttttcttgttttgtaaattgtatctaaggtggtttgagggttttggtagtagttttatgacccctttgttttagattttggaaaagataaaatgtgcccaggcacagaaaataagatacttttggaagatgcccaacaccagttggggttggtagaagtgtaatccaaagtccaaacaggtccatgctccatagtcttattatagatgtataatgcctgcgttttttaagttgtaacacaactattcaaagcagttttagtgaatctagtttgcattcccctcaattcatattaatcttttcctattagctattttcacatctccttgactcagaccaagaatttcatcacaacctaattcgtgggcgaatcattcaaagtccaattttaactcattactcctgcattgtttaagaattctctctctctctctcttgtggtcttgcccatttgtgtgtccatgaaggtttcatgaattcattggttttgtcaccctggttattatctagtaaaagacaaatcattagagttgatttcacaataacctttaagtatctccaaaggttattgtgaaattaaactattgaaattaattgaactcaatatcagaaatagaagagcctatgcttaaagcctatgtaatttgtttgaagaatctcaagacttcacaaaagatatgctaaaagagggaaaaaagcttcacatataaatcaggtcatctttaattggttattggcttaaaatgttggacatcttttagactaatttttctgctcttatacagtctagttactctgatttgtgtgtgtgttttttcattttatgatattcaagctgtcatgtatctgtactgtgttccaaagtagcaatatctctttagttcaacatcaacatcaacatcaacagcacctttaacccaaattaattggggtcggtggtannnnnnnnnntggcgaggaccctagctcttttttcgatacatccggggtccgatgtaacgcgtcgctatgaagagaacgccccaacgaaatatcataaaggttcatcacataagaatagctaactttttatggccggttcgcaactcctgacgccaaccctcctcctttatcctggcttgggacaggccatgcatgcatacacacataggcggagttagcaatatctctttagttatcttgaaaaattcatgggttaatttttgttgtatatatgttcttaggtcggaccagtttataacattgtaatatagtatttcttgatacttttgtccatatttgttaattactttggatcttcattttcttatctgtcatgtttttaatgcaggagagaattcgcattggcaaggagttgctggaagcaaagcggattgaagaagagaatgagaggaaacggtcgggctaagctagtaaatttgttgtcgcacatcttgtgttttgttttgaatgcactcagctacaagaaaaatttgcttcctcttgcaggttgttggccttgagaaaagcagagaaagaggaagagaaaagggctagggagaaaatcaaacaaaagttggaagaagacaaggttccaacatttcttaaccattttgctctgtcttgttcttttatcgagcctgttcttatctgactcaagagtcagatcatataagtggtttttaattagaattataattagaatatgaatgccaaatgcttaaatctgtgtccctgacctctatttagaattagaatatgaacgccaaatacttaaatctgtgtccctgacctctatttagaattataatatgaacaccaaataccttatgtgcattaaatcctatttttttgccatctggctgtagttggatactgataatactttttgagatttgttttcattttccatcaagatcatttactttgaaaacatagttgtttaacttattctctcagtctctggtaaaagatcacaatacatagaagtgtgggacattaattcaggttgtgtatttaataaagatattgaaagataagccaccatttgctatgcatggttgtctaaaatgaataaaagaccgtactttgggataaaatatatttagatctgatagatttatattgttttgaattggttgacaatattggtttcattttggaactgcattccgcttggcattagcttatttgaattataggttagatcaaaatggtagaattatcctccaacccacaaatcttgtgttctgcaatctgcatatgaatgaattatacttcaaagaagttttgtgaaaaggctaatttctgttttgccaattttattgttttaatggaagaaattaatgatttgggcactgcactaactcggaatatcaagtgcagaacaaaatgttttgtgctcaatgaaagtttccgcaatgcatatttccatatatgttataccagaagaacccatttagaaaatgacagtctacttagtgtcattgctgatcaaattaaatatgcattttgaacaatttttttggcaaagaaaaacaatttttggagcctgctactactacttttatggctgcagtagctttagaggactttagtcccaagtttttaggaagacttgaggagtacgatgagtcttttctttcaaaagatggaatggaaaattgaatatcttttattgggagatttgaatgaagtcaatttgtttctctattatgacaggcagaaagaaggcggagacttggattgcctccagaggaactctcagcagccaaaccttcacctgcacctgttgtggaggagaaaaaggtatgagcttggccaaaaataatggtttcattttttttccccagctacatgcatgcttatttgaaatttgtgcttgcagagttttgtgcctgttaggcctgccacaaaagctgagcaaatgagggagtgcctccgttctctcaagcagaaccacaaggtacattcttggggaactccgggacctgtttagtcgacagtattaataactattcgatagttaatgaaccggtatcaattgaacatctaatggtaatagcataagaggtaccatagcaacctcaatcagttgatgctaaataatatattttattacaaattatgcagatagctttacatccaaaaaagttttgccccttgaatctttctatttaggttcttactgcaagtgcaattgcataacctttttgtgttcatgagggacaactggcctaccttggcttttgaaagaatattacgtttttttcagaagccaagaaaagaattttattatttttatgcttctttaagaaacttcttttagcttcatatattacctttatgcttctcaaaggggtcaatttggttgcattatctttttgaaggaccaaatttatattctcttatcatcaacttcttgatatgatttcaattattttctttttgatttctagtgcttttattttggatggccagagaagtatactgtataccacgtgccatgcaatctggaaaatgaggccatttttttatatacagtagtgataatgttaactgcattttacattctgctaaaggaatttgattacttacctcacatcaatgcttctcaaaaattgcttgttaaaagtatcttctgcttaaatattgtgataccttagcctatttacatgttcacttattcttggagcaggaggatgacgccagagtgaagagagcattccaaactcttctaacttatgtagggaatgttgccagaaatcccgatgaggaaaagttcaggaagatacgtcttagtaaccaatcttttcaggtatatggccccatctttctcttgtctaaacgaaagttgggttttcaatactaacctaccactagatcatttaaatacgatatatttatggtaagtctgtgtttatgttgggtgtgttttacaggacagagttggttccttgagagggggcattgaatttctagaaatttgtgggtttgagaagatcgatggtggtgagtttttgtttttgcctagggacaaagttgaaatggcggtcctgaattcagctggatctgaactagactctgcaataaagaatcccttttttggagttctttagatgaggcaactgttataatcagaggctcgataattgtagtttcttgtttcgaagtctgagtgctaccgtttgtttattaaagagatactctgttatttatttaccttaacttatgctcgaaggtatctatggagagatttgttacttggctgtcataactcataagttaatgaggtttatacaaatttgtttcataacttcatcttatatctaatgatgcatgtgaccgcttaggatttccgaagcagtttaagcagaatttatacaataacttacataaagtttaagcatacatatttttttatttgaaaaaatcaaatcaaaaaatttataatgactttatgcatcttgctcaattaatattcaactaatttgaaagtttagaaaataattaattttttattgatgtattatacaaaagtaatgtattaaattttttgtgagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataatatatttaaagtgcattttttttgtaataaagtgcatgttatttattttattttatatttgttacttttgtttcctcctaaattataaattttataataaattgataaatgaatatcatttgatacttacaataattcgatggattttaaataatcatatagaaaagtccaaaggattggactttgatggtaattcatcaccctttaattgattcctttttttaatattccatcaatatgtataaacaagatggaggaggttgaaatgacatttatcgtggannnnnnnnnntttgtttattaaagagatactctgttatttatttaccttaacttatgctcgaaggtatctatagagagatttgttacttggctgtcataagttaatgaggtctatacaaatttgtttcataacttcatcttatatctaatgatgcatgcgaccgcttaggatttccgaagcagtttaagcagaatttatacaataacttacaaaaagtttaagcatacatatttttttatttgaaaaaatcaaagacaatatcaaaaaatttataataacttatgcatcttgctcagttaatattcaactaatttgaaagtttagaaaataattaattttttattgatgtattttacaaaagtaatgtattaaattttttgtgagaacttaaaaatcaatggtaaaaagttgtaatttttctttcattagtaattagtggtaagacgattttggattataattacataatattttatactaataataaaataaatgatttaaatttaatattaataagaattcaatttcgtaaagattacatgaagtatataaattcattgatcctgtatttggagggttttataattctaaagaatcttaaattgtaagaatttcaaataaaatatattgtttttttctttgaataaagaaattaaattttttcaggaaataatcaaaatatgtctaaaatttctaaatcagaagcattgaattaactgtaatagtctaaatatacaaaagagcatgtctttctcacaccttgaatacttgtcttgtatcatcctttatcttatatcatgcttctcttttacgttctcatcaagatgtgttagcaatagtttatttaatgtttttgctaacaagaaacacactcccaaatgattgtgctataaaaggataatgcaatcgaaagaaaaaactgacatgaaaaaacacaaaaagaaaattatataagctaacgacattgcactatttgtaaaacataataatgtttgcaaggagaacaattaaattgaactattgaattaaatttgagccctatagtaaaggccttgatacaatctagctctgctctttcctgaataaaccatgtttgccatgcttaacttgttcataaccttatacattaaaatagtggcggtgcaagaggtagttgcataaaataaggttataaacaaccaaagggagcctttcaacttctgacaaaactgtaagcctggcccaagatcttacataggctaagagataatgaatataataagagaggaaaaaaaagctaaaaaccatgtggctgttgcttctgaatgtgctctagaactgtcagggaatggagtgctcattccaggagttagtccaccagtgttgcccccaccaaagattggtgatgtggtagacgttggcacatttgggttgttcattggaggggttgtggttggtgtatttggtcctccagcagcactgaacatgatacgaaatcaaattgttaacttttagactccataaagtacaactataatttaagggatcaatgaaaaacattctcatggcttaacacaaaaatcagttcccaaaaactagcctttcactgaataacttgtattttttataaaatgttctttcttgttcttcttcaattgcatgatgcatctcttaagtcttaattcgtcactctccatggagctgaagtaaaagttgtaatagtatattgtaataaccatgtgggtgtgatccccctcaactgatcaaaagcactcacataaaggctcatcatgacacgtgagagggcaaaatatgcctagaactcgactagtatggccccatcattgtccgtggtctctatcagcaattttcttacatgctgagtcataataaatctaaaggggtcaaacacattccaagtaatgatttgatcacaaccagcgtctttattatgtgatcccccccccccccctgttnctccatggagctgaagtaaaagttgtaatagtatattgtaataaccatgtgggtgtgatccccctcaactgatcaaaagcactcacataaaggctcatcatgacacgtgaaagggcaaaataagcctagaactcgactagtatggccccatcattgtccctggtctctatcagcaattttcttacatgctgagtcataataaatctaaagaggtcaaacacattccaagtaatgatttgatcacaaccagggtctttattatgtgatgcccccctgttgtgttcaacaggcatggttcccttattgctatgtctaggtacagcactcttttagcacattaattaagtacatttgcaaatcaaataaacatttatggtgattattcagcactcttttatcgatctaaaaattcctttcatgtaatatatgtcaccctactacagtactaccaaaacggtatcttcaataagatactaaagaaaaagttatgtcaaacccgtttactatgtaccctgtatctacttttttgtctttctttttacaaaacaccgagtaaaatttttacgggcttaattttacgtgattaaaaagtatttgtaaattaatctcaatcatagttttctatattcaaatatgtctcgatgtgtgaaatacaccgaatgctgattaaatatgtaccaattactctttgacataaagttggtgtttctacactgaattataccaaataaagattcaattttttccaattgagtctccatgaactgcactaccacatcccttatgaagtaaaaattcaattatagcttttctttccaacctcaccatcacatgcaaatggatgctattaacttgcaataaagacaaaagcctcagaaacaagaatcagatgaatgaacaaatgaaagaaagttgaaatgtagatgaattgatggatgagaatatttcacccattgatgcaaagtgcgcaactaacaatgctcatatctatggaaatgtggattggatcatggatgggtcaatttcaggattgagaaagaacatctgaagaaggtgctaggtatgtcattttccacagattatttattaatggtaaagaaataacagctgacataaacgtaagcatcaattattactacactacaccgttgcatgacttgcatcagatattcccacaatcacttttaccatgttataaaaaaaaaaaagtatcacacataagacttgtttgggttagattgataatgaaaaataatcaatttaatttttaaatcaaaggcaagaaaaagttatttctactttttcataatctggccgtgattttatggagtaaattgatttttatgagttattcaaatacactaataatgtgtacaaatgatggtcatgattcatgagtgtgaagatcagcaaggtacggttaaggtgaatctaagccgttggatgaagtgggccacacagactcatccaacggtctaatcacaaagtgcagaaaaaagtaaccaacacactctgggagagagcacacagtgtcagtggaccaaaattgagcaacccaagattttgaaaatttgaactttgaagaaccaagaatcagacacagagaacacaaattgcctgtttggttccaatgttgaaattcaattggatccatgttcatatggaagctactttgtttttatacgatttgatgccgaataaaaggatacgcgcacatattttatgcccaaaaaagggtgtataagcatattttcaacacacatccaaacaaacttggtagcgtaagaaatgttaattataaattatatgtcttaattgattttagtttcaaaattttatatgtaaaatatgcgacgccatctgtaagattgatcgaaagaggcacacaaataagggcctgtttacacttaactatgattaaatcttttatttctgaaaaattcaaaccaatgttaccaaaaaactataagtaaaatagtttgggtaattgcagcagataaaagaaagtttgaacagaaaaggaggaaaattacgttacccacccccatgcacagtgacacgcgtcacagaccattcaactcacattcaaacaaacatttcctcttacaaaacaaccatcctctccatcggcgttccttgtcgtctctatcgtattagggacgccatataaaccagacagaagaaaggtaccaaagagaaataaaggtaaaaaaaaaaaaaaaaaaannnnnnnnnnnnnnnnnnnnnnnnnnnnnnnnnnnnnnntcactttcaccaattgtaactgaactctacacaccacactcaataaaataaaactcttcataccatataatattaatatcaataggcgtattagaaacacattccttgtcacacttttattgttagttaaaataataagaaaaacttgatatattaaacaagacttgagatactcaacaaattttagagaataatatcagcatttctttaataaaagtataatattagtaacagagtaaaaccatacagaaaaaggccataccttgcagaagaagggtacacacaagatccatagcctacaaacaccaaaacaaataaaaataaataaaaatgagatgacactgatccactgaaaaacaaaaatggaaatgaagagaaaagttatatatgatactgggatcactggtggcaatggtggcagtgccagcaaaatcacaggagccaggggctcttgccctgcgctgatagtagctgttgaaggcataagaagcatgtgcctgaatggtattagggagaaaacagagtccatctggctgaagaggaagacaatccccaccagccccacatgcatagtccaacgccgtttgaagtgcgtagttgctagcgtcactcctcgccacacaccaactcgcttgacccaacacattcttgcttagacccattgttattatggttattaataacagtaaaggaaccggctttggtgctgccattggagaaagttatattagggagagtgctaggtgtgattgtttgctttgcttagttggtaaaggtggagagagagagagagagagagggaagtgtttagagaaaaaagagaaaattatattatatatggtgactgagtgagtgtggaagagatgggaatagaaggcgctttcgctttctttttggtttctctttttctttttatcagagcatgatagtgtatctcaggtttctatgttctaacgttaatgtctctctgcagtgcactgtgcacgcagtatgaaaatcaaacctcgtttgctagctagcttctgaaatacaattcccacggtctctccttttcttttcttttggtgagaaaaaatacaaataccataacgcccatcctctccctaataaatatttttgaataggcaaaaatggtaacaagtaacttaaggatattagttaaaaaaaatttaaaaatggaagctgaaaaattatgtcgattttttaacatttttttataatttatacaataaatattttttaattctttaattaatgtcttaaaagacatctttttttagtataatacttttacattatcaataataataaaaaattaaatacgttttccctctgaaaaataactgtgttttgtatttttttataaatttatttgacttttgattcttaaaatatttcttccgtgtttgtcccttataaatacttaccttataaatacttaatttacaaatatgtttttatcatgtttttcttttagacaaaatagtctatacatcattaatgtaacagaagtttccagtgtgacttaatcatatttttatgatattttatttttaaaattatcaaaaaagtatatatatatatatatatatgtatatataattgcatacaaggtgtcagttaaatttctgaaagtcgaatttgcttttgtgaaaacaaattttgacgatttttcctgaaaaaaatggtgacattaataagccacaagaaaagtgaaaaaaaaaacatcataaattgatttcacaaaaaggaaagaaagccgacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaatattccatcaatatgtataaacaagatggaggaggttgaaatgacatttatcgtggatattagagaaattatgactaagaacttaaaagagatctccgtgaggttggtgagaatattttttttaatcgataaatgttaatcgttgatttattgttaatagagaagttgaaattgtgatatttttctctttccttttttttcaaccacctaattaaccttatattttttaattgatgagggtgtggaatgtgtaaatcttgtaaataaatgctagcaacatgtttttgcacaaaatgatagtaattgactgaaatgtgtttgaataggaaaaagatttgggtttgcatattaatttaggtgactataatattatcacaaaagattggtgggtccataaaatatccaagccacgacagttcatcagtaatggttaaagcaacggggtgatactagtttgtctacttttatttgatgtgttaaatgaaagactcgtttgattatgagaactaaagcttgtaaaagtaatcgttaaagcaatggggtgaataacaactatatggtctagccctagaactgttaatcttgacaattgctattcaaataaatgattaaattagttattaaaattggtaaaagtttattctgtttagtgtctaatattatgagtttgtaaaattaaatttttggcttgctcaacaatatatcaaaattatgttatcaggctcagatttttttgtgtgattaaataaaatcaagtttcgaaatagtaatatgactttttacatccaaattatctcgcaaagaattaatgtatattcggacaattagaacttagaaactaaggattggcaaaattatttaccaattaattgtattggataatagttaaaaaaataatcacaatattgttgtgaaattgatgatttgaataatcaaagttgaacttgattttttccctttttcaatataataattttaaacaatccagttcatgtaatttatttccaattcacaattatattctaatcctaatatcttaggtggaagaatataagttatttaaattaattcctaatttgtttaaagtgagtatttaaaaacttaaggcattcctcttttctagatggtgtgtaaaaacttagattctagaccaaagagcttgccgtggacatttacatgtgagaatccgaatttgagtttaatttttaaatgttttcatgggccatgtagtagtttctaaaggcccaaagttgttagattaaaagtactattcatggtccaacagaaatatttgacgtttgcagggccggccctgacagggtgaacagggcacctggccagggtctaaaagttttttcacagataatttatataaaatttatttttttaaaaaataaaataaaaataaaatctatgttaggagtccattttatatgttagggtccattttttctatcttttaattttaatattatttttattttaaaaaatttgtatattagagacccatttttttcattccttaattttaatattatttgtatttcaaaaaattcatatgtcaagggtcattttttccatcccttagttttaatattatttgtatttcaaaaaatttatgtcttaggagttcattttttgtgtattagagatctattttttctatccgttaattttaatattatttgtatttcaaaaatttatgtgttaagtattcattttttctatcttttaattttaatattatttatattttaaaaaaaattatattagcgacccagttttttcatttgggccttcagcaacggctttcgatactgatgagacattacttatttcattaagcgatgagtttccctattataaagacctgaacttcaggttcgtaatttacgagtataactcctcagttgtactatatattttgtatgacaattgactgaagtgtaatatatgcatgactgtgctatttgttctagtttataaattcatgtcgtgctactatttgtatttattttgaatttaacttcaattctcttaaaataaatcaacagtaatcaaggccttatataaaggttgaacagagaaagaagacgttctatgtttgatttttttttattagtaaaaactaattaatattgactgataaaaaaagtcaaacgataattatctcaactaaaatttatttattttatttgtcagattttttctttgaaagttaattctggttgaattcttcctatcaaattatttattatattataaatataccaattatttagtattaattataaaatttaaaatatttaataaagtatattaaattatttatgaactatactacttattctgctattcacaactttgcttaccttatttttgacttcagttcgtgcttgtaaataactaaaattaataaatttaaagggacattgttgttttgtacaattgcaattgaatttctcactttttttttatacaaaagttaagttataaataactgtccttttcaattctttaaaatgcttatgtcagctacggtcaatctttgatttttttttaatagagaaactttaataatgaattctttgacatttattattgagtgaactaaatgtaaatgtcattaacagttacttaataaaaatatataaaatacattctgaacatttaatgttcaacaagttaactgaataattatagaggtacctagtcgcctcggacatttacttgtggagtttcttgttgaccccctatccttcggcgaaaaatctgcacaattgccttttttttttccggttcctttaccacattcttccatcatagtgaacttggatcccacttggaagcataaatgacttgaataaattttgaattagattatggattctcttatttaagttttctaagaatgtataaaaaaagtgatttattatttagatattttataaaaaaaaaagcagaagttgcattttgtttaagtcataattataacaaattgttttagttttaaaatatatgacttgttaattaagcacctaattagtacgtgtttctcatgcaagcattcatgcatgttactaagttgtctttataatcgaaaggggaaactaagttaaattattttcatgtaagttataagttagtttcataaactatatatatatatatatatatatatgtatatattatactaatgaacttattaaaataaaccgaaacaaagtataaataaatacatctttatttatttatataaattctcttaataaaaaattttgtatcataaaataacaggttgataatttctctgttgttattgagattagcttgggcagtattcaatcctccttgttggtctggtcttgtaatatcttgctgttcattggaagccccgtgagtgttgtatcaactcctccatcagtgctgaaaattaaaaggaagaaactctttgtcatcattcataaataaaatgagtgacaagagatagcaggaaaaactacataaatttgagaaggaaaattcatttaatccaagaccgacgagcagaattaaacggtttgaccaatttaaaaaacaacattacaagaaaagaaagaaaataggccatatatatatatatatatataccttgaagaaggtgggtacacacaacgtccaaagcctaaacacatgaaaacaaagcagaaagaaacaacatatggttaatcaatgattttcacacataaataagagagaaaagagaagatatgtacatactgggatcagaaacggcaatggtggctgcaccaccaaaattacatgcaccagggtttttgccatttctctgatagtaacagtcaaaggcataagaagcatggttttgaatggtgttcggattgaagcaactgccaccgggttgaattgctctgcagtcagctccatgtgagcatgcaaagtctaaccctgacttcagtgctccgtagccagcgttgctccttgccacgcaccaagtgtttgcttccacaatattcatcatcatgctccctactactattaacactagagaaaccacttttgctgttgatgatgatgatgctgccattgaacaaattactcttattaatttgcttattggtataaagaacaagtgttcagcacagaagaatttatagtggctgtgaacactggtccaagtcaatcacccataaatatgcatattattttaattagagaaacgctcctaacattaatcacttttcttattcttatttttcttggtgatagccgtgccaaaattttgtcttccaacatttaatacggttacatatttaaaaatttaaattccaagaccaatgagttatgtttgaacaatccactcaattgatgtatgcgtttgatggtactaatactcctcttataataataataattatattttgtcagatatttaaaaaatcatttctggtgttttatataaaaaaataattaattcattcattaaaattagtaaaataatcaaattagttgatcttaattttttttaaaaagttgattttaattaagacttacaaatttacattttattttagaaattttcattaatttaatgatttaagtaatcgttatattaaatgatgttgcttataattcaaaagttattttttttcaataaatacgactttttattgttaataaattaattaacgcatttattcacttaaaataaagaatgggtgaattttatatcaataaattttacaataaagaatggttgcatttatttcactagcatttcttatatgtaatttccgttataactgtccttcttaattctttataaccgtttggtttgtaatgtcaaccggtcaaccttgatttttcatgaatatattaagaatatactagtattttaatacttatactcttaaataaattttatataattaaaacttaaaaaattaaaatttcccaaataacaaaaatacattaaaaaaatgtcatgtaaccataattgttgcatcacatctaagagcatctttagtacaagatgttgaacaagaatcttgagttactatatcttccaataaagaaaataaataaatctctaatataaagaacgagtttttgtgaaaaaattcttgttcaaaaaagaataatttttattcttcttcctaagatctcaaagtgagatcgatctatcataacaaaaatagaaaaaacacttataaatctttaatttttttacatgacactatcacactatcatatgtatgaaaaataatataaaattttaatttagaatttaccactataaaaattaaaaatgctccaaattacctcagacatttgactcggcctctcttttacctcctcctgctgcctttactcaatttgcatttcctatttccagcttgagttgcataaaataaatgaactttagatatattagttttatttatctcaattaaatgagcaccgacttttttatgttcagtccagacgttcagttactctaccaaatatttaagccattcatgtccttttaaaaaaaaaaattaattattttgttatctctatatgatctatacaatatttgttttagtcccaatacataaaaacaactcgttaaatacaatgtaacatcgttaacagtgtgacaatgtagtgttgacatacatgtttgtgttttatggtttagtttctgaactatttttatgtttcatctctacttgcacaatttttatgttttaattcctatatgatctcttcttgctcctcctacttcccttcctctctatttccttttttatttcccttaacatttccttttatatattttgcggtttcgatttcttttaaatacgtttattgttttacatcaactaatttgttgactctaaatcagagtctcaaggacgtagagttcaaatgcacttttgggataagacgaggtaaccaagcgtagcaattggttcaaacattccttacaataatagtgacttgctacattagtttaatcttgttgcgtcaaacacttaaaaacatgtaggttgccagttaatttgttttctagatcacatattagcataaggaaaatggatgctcattgacatgaaatgatgaatgaaatgcttggtttgtaggttggtttctatggacaaaaatgtaaggtgaaagcatagggactaaaacctaaaaataatgtattgtgtaggtgtagggattaaaacataaaaattagtagtgtaagtataaggactaaaacgtatcgtgcaaacaccttaaagtcaatgtcatattaatgttttagacaacatgatgcaacatatcatgttgttaacgacattaaattgtatttaacaataaaaactataaagcaaaatttttgtttacacatgaacttaaatgagtaattttcaagtgtaaaaagtaaaacgtaaaaattgtgtaaatataaagactatgtaattaaatctaaaaaaatgctcaacatgacatcatgtcaactaaatattattttatatattaaatttttaatgattgttttcatgtaagtgatatatttttattgatttttttaatatatatagattcatatgatatattacatttattaaatctaataattacattatatttagtaaatataaaatttaatactattattgatgttagttattaataaaatatttaataaatacaataattattactataaaagaaaaaaaatcagttttaaaaaagttttattaggtaatttttaagtaaaataaaaaatacttaatattttaatatatatatatatatatttaattaacatttattatatcattaaatgtaataaattttttataacaatgcttttaatgtttagtatatataatatttaataatattgtaatcaatacactgtaagagaaaatctatttatttatatgtctatttaaattatacattaataacatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaatcttattaagtcattcttattttatcatttttttaaaaaatcatgacttctaaacttttaaaattatttttatcaaaattaccataaattttcaatatttggatagaaaataagatttaaaaaaattggtaagaggatcatatgtgtttaatttaaagaaacaacgagttttactttaatttttttctaaaaaataaaattacttctacttaaaattaaagagatcaaaaaatgaatggataaatagttgtctgcttgtcttttatcagttgttattattgagagcttttctagtggaaatataatactttttttnnnnnnnnnnacaatgcttttaatgtttagtatatataatatttaataatattgtaatcaatacactgtaagaaaaaatctatttatttatatgtctatttaaattatacattaataacatttaatattatattaatgtttatgttcaagttgatttttttgtatatataaatataaataaaggtagtatgctgtcaataataaaaagggtagtttatagaaaataattctatttgatttgagtatatctattatgagttataagaattatctaagtagttaacaaactatatatttagtatttgaacttgatatcactcattaaattgaaaaattctccactaaccaatcgatgcatttaatagttgacttaaagcatttgcattaattggaaggattttgttgctacatttaaacaaaatctgattttatcccaaagtaggcgctcaaagttagtgaattgccatctacagcctttcttaatgtaaatccttgatcacatcactgcttataaaagcagaagtaaagaaacaaaaaatataaaagtagaagttattgactaatcttggcgaaaactatggctaaaattgtttgtcttcgatatgcctttcttctcatcctccccatggcttctgtgatccaaattgtttcggtgagtttctctgcgctttcctgcgtcatatatgtataattatatatttcttgccccttatgattaacttttctttttccattgcatataattatctattatatatatatatatacacacacgtaggtataaaaatttacttatcaatttcatgctcaaattattttaaatagttatatttagttctcaaattttaaaaatttaaaaatgttcaatttaatctttaaattcttaaaaatgaatggttccaaattttttaaattaatcaatttgagtctcaaatttttgaaaataaatcaatttgattattaaattttaaataacttgaggatcaaattaaattatttaaaataatttgaaaattaaattaattatttttaaaattttgggatcaaattagtttatttttaaaaatttaaaaatcaaattaaattatttaaaataatttaaaaatcaaattgataattaagttacatataaatgttgacacatgagagttataaaattaatttgatagtaaaaagaagaaaaagaaaaaatcatggattttattcacggactaacaattaacaacattataaaaagatgttgacccctggattcatcattttgatgtctatgaatccttttgtcttttgactatttttttaaaatccacaggctggtggggaaggatcactccctctcgaaggtactagttaaaaattacttctttaaatgtaaacatttttatagcttaactagatgaaaaaaaaaaaaagaagaggaaattaaaagattaatatataatctggttgaggtgatcatgactgaaatcttgattacattgtgcagaatgcggaaatgcatgtgaatatcgttgctcagagactcatcacaggaagccatgtctgttcttctgcaacaagtgctgtaagacatgtttgtgtgtcccatcaggaacctatggtcataaggaagaatgtgcatgctatgacaattggaaaaccaaggaaggaaaacccaagtgcccttaatttgagatccttcatatttacatgtttatcatttatcaactcaattgcacgattgatgtatttctctgttttctacttttctatatctaataagattttactgaggccttaatggcctcatgatgagttactatattattgcgactcttcatattgaaaaaaaaatggtattatatctcaaaaaatgtataaattaaggttaatatgcattatcaaccaacgataattaaaagggtcttgtggcgaggaatagagaatatgttgctgtgttctggagggtccgtttatgtttatatatgtatatgtgtgtgtgtacactcaaatgctgtaaatagttatgggctaacaaaccgcaaaactcaattgtatcttcttactaaccattaaagttgtaatgtttataaataggagaatgctaacaaatgttcaaagatactaatggtccatttcaagatggtaaaaagaaaaaggggtaaacattgagaaccttatagtcagggccggtcctgaaaattttttgatccaaagcgaagtagaaaaaatgggctcctaccacacattttttttttgaaatacaaataatattaaaactaagggatggaaaaaagggcccttaacacacaaattttttgaaattcaaataataataaaattaagagatggaaaaaatgggcccttgacacacaaattttttgaaatacaagtaatattaaaactagggatgaaaaaaatgagtctctaacacataaaaaatggatctctaacatacaaattttttgaaatacaaataatattaaaattaacaaatgaaaaaaaatgggcccctgacacataaattttttgaaatacaaataatattaaaactaagggattaaaaaaatgggcctctaatacacaaattttttgaaatacaaataatattaaaattaagagatgaaaaaatggatccctaacacacaaaatgaacccctaacatagattttatttttaatttatttttattttatttttttaataaaattttttacttaaattactggcccaaaaatttttggaccctgggcggaggccccgctggccctgccccaggatcgggccttcttatagcattgtattctagttgctctataacattgtttgtacaagaaaaaggagtaaacccatcgagagactatcaatgatgccattggcaattgatgaagctgaaatagagagactccataatctaagattagcattgcttttacaagaaaaaggagtaaacccattgagaggctcaatcattgatgcaaactagaactcgtgattgcccattcaaaccaaagcaaacatagagcgaaagcaaaactaaataaacaaattaaagagaagcacaaagttttgaagagaatccagaaggcaattttcaaactcagcctaatgtttttctacagaatcaaatctcttgcgtaatcaattgatgcagtagcttcatcaggcaccactatcttaatcctgaaaagagcacgccccaaacaaataactgagtaacattttgatttctattcaacaactgaacaacattttgttgctagttattagtaataaggaaaaaagtgcttgcaactggactacctcttgcaactaacacttaccaagaaccttcacatggaagctataaccagttcacatacaagccacatttttgttggagtaacatacataatatgaatgtataattgttgacccctagatgcatcattaactttaacgtctatttaattcatttttctttgttttttttattttttaaataatccacaggctggtggggcgggatcacttcgtcctgaaggtacttgttcaaaacttatttaaatttaaactttttatagatgaaaagaacgaggaaaaagattaatgtattgattggtcacaactaaaatcttgatgacatcattaattgtgcagaatgtggaaatgcatgtgcctatcgttgctcagtgactcaacacaagtgttgtaatacatgtttatgccatcaggaacctatggtcacaaggaggaatatccatgctataacaattggaaaaccaaggaaggaaatcccaagtgcccttaatttaagatccttcatatttacatgcttatcaattttatttcattcatgtatttctctgttttctacggtcgattctaacatgaatcaccccatttacggactcatcgatgaaccacccatttttacctacaatagcaggtcatttaccggaaggaaaacaaaaaaaaaattggcaacacaaaaaaaaaaggttcatgagcgaaagaaaatataataataaaaaaatcgaaaaatttaatataattcaataaatttatcattttctctctcctccccgttgtgcttcttccccgacaccggcctccatctcttctgggtagatcaggatcttgttgtgctttgttctacatggcttgtttggattttgattgagaaagctcttgattttaattttaatttttttaagttgttccttatcggattttggttgtttgtaaactctatgctctggttttgagagctaccagtgtgtctttttaacctttttttttttgcttcatttcttggtttctgaaatgtttttcaactggcttggtggcctacaacatgaagggataaggcagcaccttaagctttgcagatgttcgttggaaccaaagttgttgggagggcttgatcaaatcataaccaaaaatagtagtagaaaattgggaataatctccactatcgacaaagtacaggttgagcactgatttatttcaaaatcagtgtcttctactcctccaacatccaagttatagttcccaaaaccattaattatatgaacttctagaagattgaatttagataaggtgttttttcatcttaacaatacggttcatcacccctgccctagagagggttccttcctggtcatggtttctgaaaacagccacccaaggaatttttgatgcaattgtaggagcatatgcagcatccaatgatttagctgaatccggggaatcaaagccaaatatattatctgctattcgcaggcgacaccttttcgcagccctcgttgaaggagaaattggagtcgcaggaaccgccgaacaatttaaaaaaattaatggtcatttttaagtaaaaataggttattaaaatttaaaaacaggttattttttatgttcattttttcaaattaattttaattggacttgcaggtttttgttaatggtcattttcgatgaaaacagtgagtcctgcaaggttggtagtgggagttgcaaaagaacgaagacaatcttgatgtaagggtcaaatagaaaagaaagaaaaaaattaacaaaatccgttgtaacatatgaaaaagggggatgcgtcaagtaaccggttacgactttaaagtcgtaaagcaccatccgactttaaagtcgtaagcttgtttttttaactttgttatatattacgtaattttattaatattaaattttaaatatttttaaaaaatatataaatatattttttttgttaataaattttttaattgaatattatttataaaataattatttaataaatttaatataaagaaaagatggtttcaattaattgacaaattatattatatcattaaattatattatattttaagtatttttaaaaaatctataattattttatattgtgttaattatttttttaatttaaaaatatttatagtttgtttttaaataatttatttttatgatttttttatataaattttattttttgatttaatgaatttaatattattattttatatattataataattaaatttaaatgttatttatgaaagtgctaccctaagttaactccaaatgaaacaatttaagattattattaatccatcggcatttacgtttactcgtaatttaattttttatcattaaaaattataaatggtttatcggttcagcaagtaatcagtttgtaatttgaaacctgcaacctattcactcggtaatatttgtctattaaaatattatatattttttttggtgttatcaatttttttttgtttttcttccaataaatgacctgctattatagataaaaatagataattcattgataagtccgtaaatgggataattcatgctagacgccaccgttttctacatctaattagattttacgtactgtggccttcttgattgcctcatgatgagttactattcacaatagattaatgtgactcttcgacccaacctacaacatcacctcctcctgcgtcttcaaaacctcgtggatctcctgaggtttccattttcatctcacatttataatataaaattttcttatcaatctttaaataaaatattcatatatatatatatatatatattttaagaaataactaattttaaatatttcaacacagattataaataaattatttgatgtcacagtatattcctaatcagcggttagaggaagtcgtcatgaacgtagtagaacacgaacattttaaaattaaaaagtcttcgtggagaccaaggaaagactagatttagaattgtgaagattaaaaatcaatgagagattaatgtgtctttttaaaatatattaaataaaaataaaaatatcaaatttacaaaatgatctttagactttcattgtaaaaaacaaaaaattaaattaattaataatatgatatgacaaaataagtaaattaactaccatatcaagaactgaataatttttccttgtctatatacacacaaatggtgtgtatatttatagctaacaaactgtaaaatggaagttaaaagattaaatttgaatagtatagtcatgcataaaggattaaaatttaacataaaaaattatataactttttaagtgatcatataacgttaaattttaattattcatatttaattatattgtttaaatttaattttttcacttttatataaaatatcttcttttcatgatatttttttattgtatatataattcaaacttgaaatcatttatttatcagtttgattgagtttcgacgaatcagttcttatcaagttacttctcatgacaaccatgcaaactttcccatcacaagaactttattttggttgggtcattgaagatgatgttaaggacagatttttttggacattgcttctctcaatactatgccagtataccatcacctccttcaacgccctaattggcaagtccccttctaacatcaaatttaaccaacagcacttttggatagaggattagaggctaaggtgatggtgattcaaatcttgatttgtgcactctatatgctttaataatgatagacgtgagaggcgagttgagaacgttccaaggcaataatgatgcggatagggccattattatagaaacgactacttgcgcacttgatcggtgggtctaaatgagttaactttagtcaaattgacctcttaaaatttaagtttgatttataaaaaaagattaatcaagtttaatttatttatttagataaatctaattaaaaatttggactttatttattaaaaaagaataaagtttgaatttgacttgttaagctcatgtaaaatttaattatttttaatttgtaaaaaataatttttttaaacattatcaagttaatatttaataaattattttaataataattgtgtaaaaaaataacaatatatattaatctacgaatttaataatatacattaaacatgtgatatgatattttgaaatatatataattttaattttctctttatatataaacaaactattaatattgaacttgtaaaatttgaacttgactcatttaaataatcaagtataattttaagtttgaatttatttaattaattaaataagcttgatcaaatattttacaagtgaaactcaaataattcacaaataatttaactcatttacattttattagtcacaaaaaatttccaatcccgacagatcaatcacaagtaacaacaatgtttttctacatggactttgctagttgttgttttgcagttgtttggcatacttcttttatcatcattttcaagtttccaactttcacttggaataattattatcaaaattaataaatttactatacatagttatttgtaattaaataaaaatgtaaaaatattttaagtttcatgtcttattttttttttaaaaaaaaaaactactataaaaagtaagtttaacccatgaacatccatttccaatttatatttattcactagctcttaaaataaaattcttcatcgccagcaattagctcttatcccttggtgtggtgtcaaagggcgagttcctttcttgttttgcccaaaaaattgttagaattctgttaatcctaatttatagactaatatttttttattaaagataagataaatagtggttataatgtttttaggctctaaaggacttttattccataaaaattaatataaaatcctaaattcggcattggtatttgtttttcccccgactcagttatggttatttctttctcattatgaacgatgatagatagatttatatttatatcagtcattgccgtaatcgtctgatttcaattaaacaccccacctaccttcttttcatgatcatctaatctccatgacatccatccccgagctaaagatgtgcacacctaacaccttcttctattcggctggcctttttcatagtagaaaacatttcactgattccgtcgtttgatttctctggaaagttctttatttgtgtttagtactagttactactatggtcagaaaattactccgtagagtaaaatcaatatttctatttgtatttttgtatgcatattgaatggaaactcttgaaaatatttcactttacgaaatgtaattgattttttttcttactgctgactgtctaaacgattaacaatgttaaaattaaataaattggctaatcaaaattaaactattttcacaatttaattatttgtttattacataacagtatttttattttatatatattcatttaaatacatttacggtactttaaccgatttagccagccacccgctcttcaaccaatgaaactagcttaacactcaaccaaatggattatagaacccaattcaataaaactagtttaatgccaccattgcatatcagcatacgattactgtatcctccgggtcagattatattttgatccttacactcttaagcctctacgaatcatatacttgaaattaggagattatatattctttaattagttcatatttcaatccttatactcttaatttctacacaccttttgtttgaggttgaggattatgtattctttggatcgaatcgtattttgatccttgcatgatcttattaatcgagtattaacgagatcactacctataatatcaatcaattaactgataaacataatcatgcacctacattattggaatatgacaaaatattttgatatgtcataatgtttggtcaacaaatattggaggatcgtgcttgacaaacaagattaaatagtcttctttttttttttatcttaaacaataaattaaataatatattttactaaatattttgaattaggtcttctcttttatgagaaaatcttttgtgaaacgattagcaacactatcactagttttgtgattagtgagaccaagtcaccacccacgttactcaaaactactccttaatcagcaatcaccgcctaattacccccatcgacattgttgtcgcgccatagttaattaccaccactctaccaacttgagtatgaagaagatctgagcacatattttgtataaataaatatttttagtgtaattaaatgttaatttagttataccggccagcaaacgatatggtgcaactttaattattattactattactattttttatatcatatttcatcttatcatgtaggagtgtattctatttttatttttttgtacttttttacttaaagttggcattgaacccgatcaaagttgaatttattagaagaaactaatcttcacaaaaataatatataaagagagtttaattttgataaataaaattacactctgaataaattaaaatttaatctagatataatttttaaattaattaaaatcaataatcttgctatatttatttggtaaaaaccacacatttcacaaataacaattttgcttaagttgaatatacaatcacgaactataaaatttttactctaaatatttattgtcgttatatgctcatgattcaaattcaaaactactaataaacttaaactaaatttatatcaattgattgacatgttttgtgatatataatttagaagaaaaaattagaggaaaatgttggatattcatcgtataaactaatttacacataagtgaatagacatttgatataattaagttaaaccgaatagatgatcaaatgataaaactgaaagaatttgatcagatgattttttactttaaaatctatctaatccagatcgcgaatacccaacgtcagtcaacctagtaatacagacaaatcatcttccaaaggaacatatacccactaatactaaatatttcgtatttcaattcggataaattataatgacaaacaatttaaaaaattatagataaaaatgaaaataataaaattataaagagaatatgtgtaatgtattgaatattagcctaatattataatcataattaagttcctttagtcaaaaacatctttcactggtgatgatgacgaggaatgacttcagttagactcgaaagaatactgagaatttgagatgctttagttgcacattaatttggtctcagctagcttctaacgcagacctttactcctttcacgaatttattgagtttaaatttatttattgtgtaatatttattctattttgagtctaatgctgcattgttgctttcttatttaatacgagtatttactaagttttcaatgctccaaaattttaaggtacagtaacattttgtatcttttcttattattcatttaatacttttctttaacataactgattagcttttacgtcgaaatatttaaagaatcaaaatattttcaccaatatctcaattaattaagacctataaaaaaaataagaaatgcgtcaaatttagtaattcctacaaactaaaaaataaacgttgaaagagtcattcaactcagattgaaattgaatttaattttttttataaaaaaaatcacttttaattatagaaaatcttaaaaaaatattgcaagtgtttaatttctaactaggtttgaattcctttattaataatcttagttatatgggtgttagtacagagtgcaaacttacattgaactttgttaaaattgtaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgtcttttatcagttgttattattgagagcttttctagtggaaatataatactttttttagtagataagctttcaaaagtacttctaatcttgtatccaaatagatccaatgactattacttcttcacaaaagctaaaaaaaaaaagtataacaaataagtctttttgcattaattaaatgaattaaaagaggataaatatacaattaaagaaaaaaggtgcaaacaaatgtggttatggacgtgcaataaggttcataagtggcaggcaagcaaagcaaagcaaataagtctttttgcattaattaaatgaattaaaagaggataaatatacaattaaagaaaaaaggtgcaaacaaatgtggttatggacgtgcaataaggttcataagtggcaagcaagcaaagcaaagcactagaaactaggaacagagaagaactcagttgccaaactatttttctctctcctttctttgtgcaactccaaaatgcgttccataggggcaaaaaatctagcactctcctcagccttgttgctccttttggtcgattttgcaacctcagacatcaaccgagacaaagcagaatgtaccgacaaacttcttggtctagctggttgtcttccctatgtcggtggtgaagccaaagtccccaccatggattgttgctctggtatcaaagaggttattgggaagagcaagaggtgcctctgcatcctcatcaaggatcgtgatgacccgagtcttggcctcaagatcaacgtcacccttgctctaaatttaccagatgcttgtaaaacacccaccaatataactcagtgtgtcggtaagtgtgtaactatacggtgtgtgtttggatacggcataaaatcgattttgggggccaaaaacagtggtgtgacggtgaattttgagaaacaactatgtgttattgtggctcgatcctgagattggccacgatttttttcacggtgccgccactccaaacacgcacataatctatttatgacacttattttgttacctttatgttgtgccggtacccaattttgatgttttatatgttgttttcagatcttttgcatttggcacctaactccacggaagctaaggtgtttgaggggtttgaaaaagccttgaccaacaaaactagtccctcctcagtccctagtggtaaatattgttgattaatttttattatacgtaattccactttttattcattcctttaactatcctggaatttgttgtccgcatcagggttttaaatcatgatttgtggctgtggttttggctcatttcatatgcatacaaagaaaaattgatgttattgtcaaaattattcatattttttttcttcaatgagtctaattcaataggttgaatgaatgggtgtgagtaattgtgaactcactgatattggtattttcaattctgttaattgggtctcagaatgaattatagaatctaatttacacgattgaaaatacgaggaaattaattatagaattgtgacggttaagagaccaaaatataattgtagtctctgattttgaactgaaaattgactgcagctaatagcgcgactgcaaagggaacaagcacaagcacgaacaacaacagcggtggtgggtggggaaagaggtggttggtgacagaggtgctttgtgggattttaccgtttgttttcatttctcatttgttcctcttcgtagtttgaaccgagatcaagagtagtaggatgttttggtggttgtgtctatttatttctcggattcatcgcatgttctgcatgtaagtatatgttatgcaatttgtgatttatttttactaggttgtactgtctttttcctttagttatttttgcctcagtgtgtgcccatcctccgttgtctgcgtgattaataatccaactaattgaaaccattgaaggggacccgttacttgacctcaacaatgtgtatgctttaaatatcattgtgctaggaccctctatttacacttgctattacgtaattggttggatcgatgttgacatcttttctaagtgttcatttatttaatagtaccaaaatgagacatttattacgggtttatagcaactgtaatcaactgaactattgattgacataaaaacaacttagaccatcttcaaacgtccgtgtttaaatgagatgtttaaagttaagaaatattacttaatgtaacacccccgtgtatacccggtgtattaacattgtataatcatcagattagcgcttaagcaagataattaaaacctttttaaaacatgtttatattgcggaagcataaaaccaaaccatctctcttgataacattatgtatggagacaaaacccacatcaagtataaccatgccccctgctcaaccagatcatacaaccaaccataggcagataacataaatatctcaaagatataaacatacaggagtaagcataactgaacgaaaaccgtatatatatatatatatacatataaccaagttatatacaacatctgatcccgaggatccttcctcacatgagagggtatacaaaatatacatcaacagtgtataatacaaaacacatgcgcaacgcatgtcttccctcaaaggggtatacatcaaaaataaacaaaatgctgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcgccacctcccgcgccaagggcgccaacctccagagagtcccgcgccaccggcgccagatcccacgcctcaagcgccatcttccagagcatatggcgccaaccgcgccacccacggcgccaaccgcgccaactgggaaattcagggtggttctggcgccaccggcgccgacctggcgcccagagcgccaaccaccagagaccatggcgcttggagcgccgttcccgcgcccacagtgccaacaagcagagaccctggcgccaagggcgccaacctggcgccgtcagcgccacaccttttggccacggcgccatccgcgccacacctggcgctggccgcgccagattatgcagaagcaattctgcagagtgttttctgcataatccaaaccaaaaggcctcagactcgcgccacacgcgtcctaattcgcgccaaacgcgctgggactaagggatattacacttaacaatttatttttattagagttgataatttgatagtgaattgtttatattaacaattgttgtttaattaattattacaaaattaaaaaaaaatttcaattcaaaatttaatgtggttcaaattaaatactcactctaataattatagtataggaataaaaattttaaatctatatgacatttttgcaagatttataaatttaagataaataattcatataaccatcatataatttccaaataacatatatagtttcaaaattaaaactctctaacattacatataaaatttacatgaaatgaatctctaattctccacccaatcattattacatttaataaacttatatattaccagatatgcaatattacgtcttccatatagtttattttatttgatcaaagacattaaattgcatatcaatgtaatgaagtgtgctatgtctagtaccatatataaatccaacatatacatatacttgagtaattaaatgaacacactatttattgtaaataataaatattgaacattatgtcttatttgaatagtttaagtgaaaagataaatttatataaatttttaaatgttgtataattaatcactactttctttttttggttaaaaaatatatatatctcaagtctcaatagatattcagatattaattctttttgaggcataataatcaccaaagtaaattttatctctttaataaatacttctttatgccatgactagctaatcgattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagacatgcaacattacatcttccatatattgctttatttatctttatcaaagatattaaattgcatcaatgtaatgaagtgtgctatgtctatataataaatgtatttattttcattaacgataaacttacatatttctagacatgtaatattgtatcttccatatagttctttattttttttttaacaaaagacattaaattgataagataatattttattagatttgtttaaattaattcaaaattaattagatagtatctgattaaatttaaaattcattacccgacatgacaaaagcagccacatgtcaataaataaatagatgaattatcaacttacataaatgtgtattatttataacctacaccaaagtaatatgcccttactaaaaagaaacaagctttgcaacttggtgcatacaagttgagtccaacttactgacaagaaggcccactgtacaagacacaaaaaggctcaagctaattgatttttttacactcttaaaatatccctcttctctctccttgtcaccctaattatatatattactgattaaatattaaacttttaagaaaacatttggtaacactgatgaggaggttatcgtgatttcaattatattcaaatcaggaaaagtaatcaccctagtacacagaaaaaaagatcatcacgtggaaaacaattgaggatagtaaggtaacagggtaaataaaggccaacatcccaatcgttgttatagccaagaccggactttggcattcattattaaataagcacgtttaaatcttaccagcaactgaaagttcagcaacacacatgaagttgaagtctcagcttaaatatgtacataatatcatgttcataaaggtctcccgaggatataatataacgcaaccacactcggttttgcgagtcttggacactttgacaaatataagctaaggcaatagagggccagtgacaggttaaaacgtcattccattatgaaatacaacagctagtatgaaactggatctactcagtgagaagcatgggaatttcatcgaccggagcaggtagctgcaaatttccagaagttttatgcgagttagtatttctctgactgcattagaaaaaataccaaacaagggaaaaaaggttgcagatgatatttatttataagataatatggacaaacttaactagtgtatgcctctaattagtggaaaacttgcagttttgaggatttgtttgttcatttacaagagcaacagatgattgaaaagctcatattaaccatcctacccttcccatgctcagaccatattgcatacacaaaaaactcatattaggtgatatgatcaagagcgtttgtcagcatgccaaaaactcaagctattagcataggtgcaattcttggcatataatatcctgcatcagacacagacaattccctatttaagccactagatatcaaccactacgttgaacccgatccacagacccaatcagtacactacactacacaccctcgtgacccttttgggcatatcataagagacgttgaggagtccaaatatttcatgagttattacatactcacaattggccataagtagagtgaactctataacattacttcccccttggcgcaaggaaagatcaatgactgccttcaactttaaagtgcatttaatacaagcagaaacggcttaaaaccaaggaactggtgcgaaactagccctgatcccaacaactttctatctttttttattcataaggaattgaactcaagtattactgaatttacaataattcacgtacattgtttaaccgactgaattagagcccttagtaatcccaacaatattattcaatgttgtactactataaattaggtccactgcatagtttgagttccttgtattgcccatagggcaatatatagactgtattgagtcaattccttcaacttttcaaaaactctgttttagtcgagaactagaaaaattaatctctcgaaattcctagactaattcaagtggatgatccctttaaattcctgagcatgtggatacgcatgtcgtaaaacacatacacactaagaaaccctgaatctgatgacataaatcacacctctcatgaaactaattacagagcatcaaaggtttaaccatttcagtcaaaattcaaaaaatagagacctaaaaaaaattcgttgactattccccatacttagcttcgatgtttacttaagtataagtcttttcgaaccagtttctggattagagcaattaaacctaatctagtgttccaaaaataacaaaaatcgagcgtctaaacaagaaattaggaaaagagtaaaagaatggcgaacctgaattgaacgtggaaggcgaggggggcacgagagggatttgcggcaggaacgaacggttttgaactggtcaacgtcgagtttcttgttgatgatgccgacctggaagtagatgctgtcggagggtggcaaatcgaccctgatctcgtcgacgttgaaccagagaaagaggcgctggacctgaatgcccttgagattggtgatggagccgtagctgagcttgccggagatcttgctctcgtagtaaactaagtaatcgaactgtatgtagcagggcttcggcaaaacgacgacgaattggccatcctcgtcgagcgtgtagtcggtgacggtgtccggtaacagaccactcgggagcccgtacttggggagtatatcgtacacgctctccttcgccgccgccgtgctaacacacgcgcaccacaacagagtcgtgaagattgccatggcaacaaacgcgtgtgatgatgatcggcttgggggtgttgttgccatggctgaaaacgttagagagagagagggctgtagagacaacttccagtgaccgcttcagttacgattctctctcgctctgtgtctggtctttgtctcctttcgggaagagactcggtttcaattttaaacacaccaacaactacttacatccattatttcgaacgattgtttttattttatcaaaaattaaaaattaaaaactatttttttactccctctgttgcggtatataatgattacaaaattaattaatctcaaaaaattttaactttttctaaaactatcttttttttattaattaggaatattgaacttgacttgaacaaattcatactatataattaaatttattatatgtaaattaattattaaatgcaaaaaatattattttttaattcgtgtagtttattaaattattaagttaaacaatccatgattttttaagttgtcatttttatttttgtcttgattttatttatattttttatgttaatataacattttatttctatctaaagtaaaatatcatattagtcttgaaataattaattctattagtcaaatattattataatttgatttctttttaatatatttagtcattatatacatataaagctttgcgcaaaaataaattattgttttaaaattgtattttttacaaataaaaaaatatatattttaaaatatttagatccaattaactttactcgagtcaaccaatttatcatcagggctaggttgggtttaattttttgtttacaaacctaaccaaacccaatacgtaaatatttgatgggattgagtgataggttttgttaaatatgattcaatttaacatgtgaacactttatcattaatattcatgtctctcctaattatttattaatacattatcttttcttttaatgagagatatttttagtctaataataattactacaaaaaatattataaattgaattttataaaaagaaaaaaatatcattttaaatttaaacttgaattttataaataaaaatgaaagaaataaccaaaaagtctttgatagagttggacatttgggtttggacccacatgtcgctcgcgatatacatgtcttgaaattttgagtccgtttgaatccaggtttcggaagtggacttgcttatatgcttaacctgaatcttcaacatgtaatatatgactgtgttgtttcggtgatttataaaaagaatttgtggaattggttatgcgttggtaaagttgtgtttcggtaatatgactgtgttgtttcggtgatttataaaaaaaattcttctggagcttgccaggtatttgctcgtttaataaatcatatttcattaatatataataaactgtatcttcaagaactttttataacatccaagttcgtgggacgcgtggccgtaccaacaatgctaaactcagcagtcagcagtcagcagctttcaagtttcaaatgtgactttttgtttttgaattttgagcataataaagatatttttttctgaatgaatataataaagttatatttccgcaaacaataaatatttttaaaaaagtttgctaaaagcgagtttaatttatttatttaagataaaataagcctaaaaaattattatgtactaagaagcacaaaacttagaagatacatcttcgaagatatatttagtattatttacctaattgattatgttaatatttaatataaatctttattacatgaaatacgagaatgaaaatttaattttaattgaaaaacaacacaaagcatataagaaattatttctaagttttatcatattgttaaatctcataaattcataatttataataatgaaactatccgacaactgtacgtgaatctgaataagattattttaatttaaccactagtttcaaatttgagtcacatatatgtaattgcgctagatacttaatatgcgtccacattaattatatccgaattaaacatgattatctccattaaaaaatgtctatggtctgaaaaaaaaaaaaaaaactatccaatacaaaaaaatcacatgcctccattataaaaagttcaaaacactatctccaagtgtgtgaacgagctggtttgagattgctccagtttcatcagaattttttagtttaaatcttgtgtatgcaggtgcattaaatacgaagagttttgtcggtcgtaatcgaataatattgcttgtcctattataaaaaagaagttaaaaacactattgcataatattattaaagttggctacatagatcatggtcctaggctttttttaatgtttattttcatgaaggcttgttgtttaacttacaactagcggaaacccaactttgtgatgcctattggcccatttaaatgcttgcttattcaggttaacctatttaacccatgacttggactgaaccaacccatgtaatattttcttttttgttattttagacttttagctcttttttaaaaatatttttatttaggtttgcaaaccaatgtgaaaatgatttgaaccctgacttgcctgttcacctcgcaagcaaatcctgcttgccctatttgcaaactaacgcaggccatacctatgcaaattgcggctttttgactgataaggggcattcttgttttaatataggagtaaaaattttaaaaaaattattatttagagataagtcgtgctaactttttagtgagacatcgtgtcatgtatcatgatttttattttttattttctgttcaagtagtagtaaatttaccactttaccgtgcttactattcaaaagtcctacaagcacctgcacgttttgcttttttattcatttgtagcagcacctacaccttttgctttttattcttttttttattgagtttggcttccagattttttgttttggttagtagcgtggccttttattctttttattttggttagtagccttatttttttttttatatgtatgtatataggttacgactttcgtacccatatatatatatattaaaattgttttatatttttattagttagtaattttaatattgtaatttgaaaataaatattttttgatgaatttttttaataataagcattttttatatataaaataagatatattaattttgataaactaaacataaaaggggtttattttttaattttcatacttattaagtaattttttatatttgttattggtgtataaatatgtaacaattttatgatatgtgttacagtttcttatggacatcttatgacaccctcaaaataaggtcattaattcataatgtagacatatttatgattgtgtcatgagataatttgaaatgagacaaaatatttcacataacccatcaaacctggacaactccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgcacctgtggcgctaaccgcgctggaaaccagagagaacaggttttccagagcacttctggagctatccgcaccagaatccagaggaaacaggttttctaggacacttgtggtgctgaccgcgccacccatggcgctgattgcgccgcacacccagaggaatgaccctctagatctcattggcgttgatcacgcccctatggcgctactagcgtcatcccctcaaatgcctggcgccatccgcgccagactccagattatcacattttcgacgatgcgtatatagaagaactcataatcataaatataattcattcaaattatatgttcggttaattttactactattcttacaaaattaaattacgattattgtgccaaatactttattaacataattatatttgtaaaaattacttaacaaaaacaaattaaatataacttatttcatatattaaaagaaaatattattatcaaaatattttaagtattttaaattttaaattttaaaattagaaacatattatacaaaaacaattaaataaatattcataatacaaagtatttataacattaatttcagatatattaaataaaaagatataaaaattacatacaaaatattaaactaatttacattaattcaaaatgacttgcttttttaaataattaaacaaacaaatttttaattctttaaataaccaaaaactaaaatacaatataacaaattcaaataacacaaattataaaaaacaaaataaataaaacaaataaaaccaatgggttacgtaacccacgtatataacaataattttaaaaaatgataaacaaaaattaacgaaagaaaactaaataaaaaaccaaaattgaataaaataaaaaaaacctaaaacccttaaatcaatgggttaggtaactaacaataccaaatggggcttctgaacatacgagagatcatcataatcgtggcccccacttctgattctgatctcaaggctgaagcttttgcagaagatgatggaggcgtggatgtgggacacgtgggttggtgccactatgaaggatggttttggagtggtgggggaagtgaatctgaatctgaggtttctgatgtaggagtccaaggtgggagggtatgaggtgctgttggggaaatatgtgacggcagagattggaattggaagagatgggtcagaatggagagagaggcaatggagaatgttgtcttgaaaaggttctaattctgaagctgctgccattagaacgtagagtagaaagattcagacaaagggtaagatcgcaatcgcagacatcgataggcaatggatggattcagatttcagaggttccttatggaagaaggaagccagagaaagggatgatcagatattcgaatactatagtttcttcttccgggttacgcgtgaaggataacgtcgagggtaaacaagagacataagaaattcttaagctacactttgttccaacgaaaaataaaatgaaatgagatgaaaattttaaattgagatgaaacttttgaattgaagtagagtacaaaagtgtgatatttatatagtgatggactgtgatactagtgattatatttcaatatccacaaattttaaacactttatcaacgattttaatttcattctttctctcttttatcaaattatattatatatcaaatcaattacttatttttctttatctctctcaaggtatgtgtacaacaaatattttccttttctttttctacactgttaggcgttagctactaaactcttctttctattatcttgttcaaatacttttaatatttttcttttttagatatattccatgtattatagttgtagacgagtaaaaatatctcaaactagttttagtaactatgtaatacacggatatgcaaattatctattgatcagtaattgcaaagactaacgacaacaaaaatacgagttttagagaccttttaaactttgttttaaaaagaattaaaataaaaaagagtaaattatagggattagaagtatattaaagtcattctatttttctaagaagaatgaattacatgatcaacatgtctgtatataaatatattattttagtttatagttatgaaagtgatcnnnnnnnnnntttatcaacgattttaatttcattctttctctcttttatcaaattatattatatatcaaatcaattacttatttttctttatctctctcaaggtatgtgtacaacaaatattttccttttctttttctacactgttaggcgttagctactaaactcttctttctattatcttgttcaaatacttttaatatttttcttttttagatatattccatgtattatagttgtagacgagtaaaaatatctcaaactagttttagtaactatgtaatacacggatatgcaaattatctattgatcagtaattgcaaagactaacgacaacaaaaatacgagttttagagaccttttaaactttgttttaaaaagaattaaaataaaaaagagtaaattatagggattagaagtatattaaagtcattctatttttctaagaagaatgaattacatgatcaacatgtctgtatataaatatattattttagtttatagttatgaaagtgatccatcatccatgattggtcaaaaagctccgaacatattttcagtgcaaacttccctcttctactttaacataaaaccttttctaactaccatcatgtaatctacttatattgttattcggaaaagaaacttacatatctataaaacggctatccacaagtgtcttttaaatattcaaaatacttaatattgtatgcttattataattaaaaagaaagtaaaatttgttactcgaaagactaagagtctaatggcatgcctggctatattcttaatactatatgatatactaatccgaaaacatacataaaaagtataaataagaaggatatagagaaaggaaaaggaaacggaaaaagggcttccttccataaatgaacctcttttctgtgttgcttcactgttagaacttcgaagtttctaacttgcatggcagttgaaggaaggtttgtccttggtccttggtccatgtcatttaggctttagcccctagaaaacatttcttgaacatcaaattggacacagaaaagttgtattctttgattttaaggagtattttttatatgcataaataaaataagtaaaaaacataaagataattgaatgatacgtaacatatgcgttaaagctatgtttcaacaatggaactgcttaaagtttaagaagtaggcaaatatatgtattatctaatacatatcttgaccaagggtcaattcgggccacctgtttaaacacgtcaaaagtcttactaaacaacaaattacacgtttagttttaagaaagctaccaattactatgataattaaacaatgttcccattgaagtattttttgaagtcaagtttacctgaattaacaatagttcaaaaagtatgatgcctcggcaagtagagtaatattaaatacgtaccactcacaaagctaagttctcttttcgcctgacgacaatcataaagacattctcttcaagtctatccactttctgtgttttttctctggcctatggccatgctatacacatgctgagattgtaatataaatagtgaactttcactctttcaggaatcaagaagccattctacagcaaaatctctctctctctctctctctctgagcttagagtttgttttaccttatcttctataatggatcatggaaatgacttcagtggcagtggcaccaacaagaggagcagcaatgaaagtaacgataggaagaagctattaatgagcagacaaatagtttttgagaatgagaaagaagacatcaacaaaatggctgatgcattcgtcaacaactgccgcaaacaactgaagattgagagagaaaattcattcaaacgttttcaggatatgataaacagaggcgcatgagtgatttgagctgaatggaattgctgcagtggctaaataatagtagtgtgattgttacttcacatacgcaaaaaaaaaaaaaagtgcgattatttcttaaaatggagaataatacaatagtgaaggatataattttggatttatgaaaagttcttcagtagttcataaagttcagagtttctctaaatatttttgtattcctctcagccaccaaacattcagggaaaagactagttgtgcatctacctttttttcttaatttacttttaataaatttgtatcataagtaaagaagtaattttgctcaagttatagtttaacactaattgcatacgtctctcccaacaagaatctcgaactaatcccttctcctagacttgattagcgttggtatttgaaatctgtatttgacactagcttttagaaaaatattatccaagcagatactatactattactcttaaaaaacatgcaactgattttcaaaccatccattggaatgacttttgccacaacatggggatatgatattctgttccccctgcttactgaataaattaacttgaccaaagatacaaaagttttttgatgttttctaataaatcatatacagcggaaacgcatgtcttacaaacctaatatactgtaaagaaaggaaaaggcacagccttgagtgaaacaacatttacaatatctgccccctattcataattgtaaaggaatgacctcattctatagccaaaatcaacaattaacctcatctttacaatgaaagcacaatctctttcccacacaggaaagtggataaacctgtttcaatttgattttcccaaaataccaacaatttcctaactgtatagccaagattatcatcagaggagtttggatctcaggcttgaagaacctgacaatgaacaatatgactcttcaaactaccacgtccggctatagtcgaccataaatttctaactaaagacctgacatgacctttcccagcaatattttcccaaagttgaggattgctttccacacgtctgtttggactcaaaacatcaactagactgatgctcatattgttgcgtataatgcaaagccttccattaaggggaacaagagcagcagcgtcaagagcacgggaactacctaaatggagcttgctatcaatgaacttcttccatgaatctgttgctctgtcatatactttgagcttgcacccatcctggcaatcaagtgcatagagttgcccattcagtgagatactaggattacgccaaccattgaccattccattactcactgggatccaggtatcagtttcctgggaataggattcgcatatgacactgcgattagatccaagtcctttcaaaaaccatgttccgttatgaactacaccaataaagggaaccattgctgtggtcatctctgagataaagctccacctgttccggttagggtcataaacttcagcagatcgaagagttctttgaattccttcacactccccaccagcaacatagagacaattatttattacacaagaaccaaacagatgacgtttccgcagcatgtctggtgctctatgccacttattagtacgggcattatagaaaataacacgtctcatagatcccttcagtggatctcttccaccaaataaatacaggtggcaaccactaagaacggcacagccaaatcccaatgcttcagaatattccccaggaacaggtggaagggattgccacagttggtagatgggatcaaaagcatgcaatgaaattcttccatcacgatctcttttgatgacataaacccattcttctgccattccaagacttctcctgagtgaatagaagaaatttccagacaggaggcgataccatctcttgcaaaccaaacgcagtttactgtgctcaaccctaggcacacgaatcaaacatgcaatagcaagatcatccggaagaccaggcaggagaggaggctgaactctggtcctctctctacgtgagtttttgctcctatgtgcattcgggtttatgtcaggttggatacataacttcgatcctggaacaaatttccttgccccaacaactgttttcaggcctgaatctaccttacagtagcaagaaacagagtcaacctgtaaaattctcaatgcagtaagttgaaagtaccattaaaatatcaaaaagatttcaccaaaaatatgtatatgcataatgtccgagagcatattcacatgcacacagtaagctttagatacttctccttccaacttcaggttccaaagaattgaacagttcctactttctatactgctttttttcagcaagaaaacaataaaaggaagttcaagaccaataacttcacaatctattgacttgtcaaacaataaactattattaattttattaagctgaaatctttattttcttggaaaggtcatattaagttttaaaattataatatatgaatatagtcttggaattttcaatggctatattgtttgacttgttgatcatgagttcgaatccagaaacagcctctttacatatgtaagggtacagctgagtacaatattcctcctccttaccttcgcatatcgaggaacctttgggtaatggggtacgtaatttttgtatagccatggaattttcaatgctgcaggtggggcagtaagatcttaagaccaagtaaggttatattagataggttcattacatactatgattaaaatagcgccgctttagcgcgctatctcgcatcaaccgcgagttgcggcacccagccgctacttccgcgccgcaacgtgacggtttccggtagcggtcggtggcggcggtgcggttggaagctcttgtggcgctatcgcaccgctccatggaagagaagcgagttgcagagctcctccgccttcagccgcctctccaactcctccctgccgtccttcctcagcgcgttcagctccaccaagcctccgaacagcctctcgccgaagaagatcttcggcaccgtcgcgcttcccgttctctctctcagctccttctcccgctccgcgaaatcgcacggctcctgatgctttgaactgtgttttctaaatttgaataagcggctgagatgcaatttgggactggagacacggatcgtgaaatctaattgcttgctttctattggttgattccactgactagttgtggtacgttggaacttggaagccatgtgaggattatgcgttatggagcaattttttttccagcactttttattgggccctcggcccatgaaatgtaaaacagacttaggcttttacttccaacatcccctattttgcttcttgaaccccgaaaaaagcctcaaagggataatttattataagtatggacttcacagtagtggctttaccgctatagcgtttttggggtcggccgctaccgaccgctacccgctacccactatttaaaactatgacttcatgatgaaaatgttgaacaaatgccataacacttcagctatcctcagcttctgctaaaatgtttctattcaaacccttaggtctaatatcctcaaattttaaaaagtaaaaaataagggatatctgcaatatattggaattaaaatacatgcaaatgatgctcggtcagagtaacataaaaacagaaaacaagatcaaataaatcactttattactgcttgtgaggcttaaataaaggtgttaggcgtaccattattatccacataaaatacaaatacaaataagagaattttcaagagaaaacaaggagcatctgggtatcaccagagagacatcttataagagtttgaaagtgaatttataaaaatagttactcttaaaataatctcaagttaaaaaaatgaaatcaatgaaaaactcccctttggccacataagaaaggccttttcagtaactacatcctgcatttgtaatacatatcatgtaagttacacttccagaatgagggaaggtagtgacaagcagtaaatttgaaggatcataaaaggatgtgataaggtgagatgattcattaaacaggcttgatggagatactaccatcagatgaattttttaattgagacaaaagaaaatgaaatatcaggtagccaaaaaagtagtgaactacaataaaggagaaatacagaaaatcttgggaaacatatgaggacggagagtagataagaataactctatacaagagttatgataactgatcattttcaacacccattattataagacaaatagcttaaggtagagctagtgatattgatgagcagaagaatttgcaggaataatatgctcagggaaaaaaaggttgacatataaaccaagatgaatttaatttatcttatatatgtacaaatataacctgatagctttcgatggaaaatcatggggaacaatgtaaaaggaaaaatgaaaaaaataaatctctatgctatatgaaggtgacaataaaaaactaagctcactctttgatcaaatagctaaatgaaaacaaagaacaaaggctagatataaatgagcattgcagctatgtactaagattatacttgtaaatactatgtttacagcagctggaaaattcttataaaaatattccatgaaaaaattatatggcaagaaatggaagtagatagaagaaggatgaaaatctagctagccaaaaaaataaaacaagaggggaacattagcccaaaacagatttccactttctcagcacatccattagagaagttaaagaaaagtattccacccccctcccccctaaacaaaaatgtcctaaactcccttgttggtacctacacatgcttaagcctcaaacccaatacatacccgagaaggcaaacatataaaatcctcctggttggtaacattctctgtcaagggtgtggagtatggaggttaacattccccatatgtaaaacactagctaagtacaactcgtaattagcaagaccgaattgcatcaacaaaaaggtcttgggttcattcctgctgatgaactagtgatatgcaaccttggaatggagcaacccctcaaacccctaagaatttagccttttaggtgccaaaaaacaaagagaatggtagcattctcagtcaaaggtgagaagtaaggacgatggaggttggcactccataaatgttagctgcgtgaaactctatagtctagaacatcatgtttaggtaggattagaatttaggaaagtcaacacacaatgcatgttgaggcagcaagagacttctaagatctaattttgactgaagagccctagaaataaacgagagcttcttcccatttaagaactctaaggttcatagactacccaattgactgaagttacaacttagttctccgcctctcttccaaacacaagcagagaatgataggaactcaagttaaccaaaacctcaagcacagcgctggccaatcgaaccttttatccacacaaaaaagaaaaaagaaaaaagaagaagctgcaactgaaaaatggagaaaaagtcatactattcaaaagaagaaaactaatatgcagataaaaaattggagtgaattggactttttaccagtggagcttgaactctagataccctttgagtattcgttgagctttcaactaactggttcatttccgaagccgagtcttgcaaatgaatggatttttcaacgcaaattaagcatcttggtgcagatcaacacaactcctattgaacctacccttcaattcctggaacccgatccagtgagcagaagagaaaagcttgtatctttacctcaggaactgcaagagaacgaaaaacaaagaaaagggtcattcgagttttgaaggaaggaagaagaactaagactttaagagcggtgagatgaggagcaccttctctcactctcttctttcacctttggttgagaatgagaaagaaaccacaagctttagcttcacaaaaattgtgtgatttttttttctctcttggggatttgcgaaaaattaattaaagtggtttttttaattttattttaatgttaaactgagttgtgtgaatttgcggaattttaatataaattgtataactgtcataagaggacacatcgcttcattcgcttgtgacgatggtcctctttaataaatgagttgcagttcatgggtcaaaccaacccaactttgaaggcaaaggagggagagggagagggagagagagagggttttctttttttgatttattgatcgcagaaaatatcatccttttgtgggattgtgaagattggccatcacatggctacttcgaagtccgaacagcttttttgtctttttctttaacacattttggcttttaacatttttcttttcttttaactcacggccagtttggtgtttgcattgtttgcgagttccgatgatcgagttttggaggaaaaagatttgaattactagttgaaattaacagtttaattttcaaattaagagaatctaactttcatgcactatgagtaattttattatgttaataggttagaaataattattctaaaattaataaattcatcatatttgttaatttataattggatgataatgtaaaatatattatattaccaaagtcattttgattaaattcttaaaattaatcagtagaaaaaaaatgataaactcaaacagaactaacctaagaaagaataaattagatatattcagattatgaagttaataacatatatttttcaaaatattaaataaaaatgaaaaattatagatctaataaatacacaaattattataaaaatgataaaagtgtccaaattttttctgaatttagatttttaattgtagtttactataagtgcatggactaaatgacattgaactaatttagcttgataaatagtcttaggttttagttctgaatataaatttgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatttgtgaaggtttttttttttatatagaaagaagttaatgacgagaatttcacattttaaattttatcccacttcaaattactattcatgtctaaatgcaagagaacaacttccatattacatactgttactgcaactcttgttgcttaactgctatgcctttcatacttcatcaaaatactagttttttgtgtctaattaaattaattacctgttacatgtctcgatttattatcatatattgtaacttgattattgttcttgagttttaaaatcatcatacaatggagtgaaaagaaaatgattgataaagattaaaaatttcatccaccaaagcattagatatattatcacatccaacaataactaaaattgttaagatgtattagtttatttgtatacacaannnnnnnnnnctaaatgacattgaactaatttagtttgataaatagttttaggttttagttctgaatataaatttgcactaaatacttagaaagtttttatcttttataattatcttaaaagatatttgtaatctcaaacccccattttcacccaaaaaaataacagtctatttaagttagattaatttaaacttgaaaaatataaatttaagaattgaatcaatagagatcaaatttaattgatttagttcaaattagatccgattgcttaaaaaaatgaaccaagataattaattacacacataataaaaaggttgatttaattcgggttaatccagttttaaaaaatataaatctaagaattgaactaatttaattcattcaaataaagtcgaacttaagaaaaaaaaatcaattacatatatatattcagattgaattgttaggtcaactcaatttaatgaacacccctaattgagggagtgggttgaatttaaatatcactttaaaaagttatataaatagtaaatatcatggtagcatctatgtttcccccaaagttattcttgttatccctattcagtttttataaaaagtaaaataatgatttaataacatcaaaactataatgttaccataaaattactaggaataagggatgtatattaaaaatgggatagaattctctatgtactctttttttttctttctttcccacgtctaaggtttaataaggaagacaagtcctacattagtcgacttagattagaatagaactttctacttatgaagacaattatgggtcttaaatagtaaatcccatccacacgtccataaataagggtcccgtgctatacgtaatttttctccactcgagtatctttctattttaatcggaattattgacttgatcatcaacttgagagtccatggtcggtccacttctttaacgacctcaagctatctttgaatagacaagacaaaactaatctaactttatcataaatgtagcctttgaaatacaaataaaatggttggccgaacacctaaaatcaatataataatccactatgtcaaactggagggagaagaacctctattatttgtttcatttgttatgtatatagaaaaattacgagcatcacctatgatgaatgataaaactgggaaaccattgggagcgaagtttacttagaaatataaaaagcaaaatctggctgtgcacacatacaaattaccacaaattcacgtagagaacatactaaaataaaggcaggcattctctcttctaaactcgtttaattaagaaaagggaaaatatgagtaaacagtgtttgataatgtggcacacgctctgttgtgcaatgtaataagataacctttgccattggtctatgttcatctctccctaaatatagtattcaaagataatgaacatgttaccatactagtgtatgttcaattgaaatcgtcggcgggaacctgttgttcatttcaaccaccgctataatattacaaaaacctttgccaaagtgggaaaatattaaattccaacataaattggttgacactggaaagagcatgctttgagagagataagtcagataaccacgatcggcaataacaaaaagctcgatttctctccccttgcacaatctcccaccagtctcccaccaaaattaccacccaaaatgaagggtataaaaagttgtcgacaagaaactcctaatatgctagtaatcaccaatacccaccatcattacacaacctttattgatgtggctactagaccacatacacaaacccactccccacaatgattagcactgtaaaatagtacaaaatgatgatggcttgaaacacgagtaaattgaagatcataaaaacacggggggagtaaaaccatcccgtaggcgtatccacgcctatacctaagatggtatgtaatgctatgaaaagaagaaagtcaatcccaagcactagtgaccccaggaccataccctccaccagcatacccacccgagcctccatatccaccaccactgccgtttcccgcactgtagtaatctgaggaacctctactgaaagagccctctcttcggaagtcacgaccaccaaatcgaccacctgatcggcggttcctgcctccactgaaagaagatcgagcagcaaaccgtgagagccaagcaggtacttcttgatttgcttcttgcatcagttctgataaagctctagctagcgatgaattgttatcactgaagaatgcagttgcaagacctttctttccagctcgtccagttcttccaattcggtgtacataatcatcaatgtcattgggcaggtcaaagttgaccacatgagcaacatggggaatatcaagaccacgtgcagcaacatcggtggcaaccaatatgggggtgttgccacttttaaatgacctcaaggctgattctctttcctgcaggtatttcagaattgatgagcacagcaagactaacaagtatatacttaaccaataatattgttgcaattcaaaaccaacagaaaagttagtaaatgctatgaagtaaaagggtttaatatgagggtagcaagttgaatagcaatttcctaacactaactacaaagcaaaatgatgcaagaatccaggaccatgaccctattaatgaaaaaacctgggaaaaataaaaaatacataagaatatttgaaagctccaggtttgaacaaacaaataatagggtaataatatcagagaatgactgcaaaagatgtgccccaaaaaaggatgtagaatataacagaatcattttaaacctaataatattgcctgtaaccaaaaacaattcttttataggaataaccacttgatagctgttctagacttctagtcttgaaatgtttgacttgcgaatcttgcaaggctcaagattctgtgttttgtattagagtcacgggaatgcagtagacagaaaattggaattcaataaaattgcagaagaaacataacaaaatagtttcttccattaatgcaatggtgcaacccgtctatttggtgtatcaagtcatctctaaataaaacccaaataaaatgttcaacccactttattagctatggagatttcttgtcctctgttcaggtaaaagtaacttcacacattctaatcttttctcttctctgttctgatttctcattttctcttgcttctctgttaatatgagacagtcaggttggatattcttcctagatgtttttagaatttagatatatagttttccttctccactattatgctaagggcgtctttttttctgttgcttaaaaatttattgattggttgctaaaatgaataactactttaaagacactttttatccctcaaattttagcaactggtggttaaatgagggaggagccacttaagaacataccatggagagcacaaatacaaatgctctaagaggcctaagacatgctcttttcttggcatactataactactgtccgtgggttacatttttaatgagaatttcgtttttgtcagatatattagctctttttctaagtgagattacaaatcttaatttgtgcagaattggttaaaccaaaggcatcggtttgagagattgcagttgtgagagtgaaaggaattattaaagaaagagttcatactcattcagggaacatgcgtttcatttcaaatggcaaacaattgtgactataaacaaaagtcaatagcaatatgggaaagtgaaatgtggcaaaaaaggggaattggggattcagttaaacgtttcatatttttaatttaatttttcatacttttaatttcatttttaacaataacacgcacaatttttcacagcactaaagcaatcttatgttatacaccaatcatcatagacgtgtgacaacccattacaagagctgtttatttttaacattcatgcaatagactaacctgctgtgacctgtcaccatgaatagtagttgcaggaaaaccattaagacacaaccagtgttccagcgaatcagctcccttctttgtctccacaaaaactaaagtcaaaactagctgcaaaaaaaaaaaaaaatcatgaatgaaataatcttaccacaatttagcgaggttttactcttaatgaagcacaacatgagtaaaatagattatccacactataaatcccccatacaaactgaaattcaaatgcaactttgcaaaggcattacctgacagagttcaaaataattaaaacaccataatccaaacatgtgcatgcatgttgctcagaatcagtttagactgtccggtagatatttctttacaaaaaaaagtttggatttttatactgctagttttgttggttttggtagaggtaaagaagctaaattttttggcaataagccatctatgctacactttggggtatacagtcagaatgtaattcttgtatctataaggagaattctatgaatgatcaaattctttggggacaagataaggtgttttggcttctacttgctgataacataaagctcgtggccattttagaggaatgttaaagagactgggtcagtaactttgtatgtttttatgtgctctcttgttttttttttctcttgtaattttgttttctcaaggaggatctcttatcttcatatctgttatagcatacatcttctactcatcttaattcttttaacaatatgcatgcacgagtagaagagtataggcatcactgagaactacccatcccaagtgggtcagaatagttaatgagacaatagtcattgtaaaaatctcgggtatttcttttggaaatgtgacactggacaacaaagaaaagctccaaattcatttgtgacataggtatatgatcattttagttgttctggcatttttttccaaccaaatcatctatgcattaacacaacttgaatcaattcatgacattcatttagtctcaaaaaatcacttgtaataagttctatgtaaataaagtacctttccttgtacaccatttgccctctgtgcatgaagaaggtccattaggtgacttctcttgtcagactcttgaacatactcaactctttggacaattaaatcagtacttgaacccacccttccaacagcaaggaaaatataatttgaaaggaaatcagaagccaatctctgcatatcaaccagaaatcataagaggtcttaaaagttataattataatatacacaacaattaggcattcatgcattgtttgtttatacctctgaagccacttatcatctcaaatcaaattaaaagcaaccaaattacattattctaaaggcactctttctgaaatagaagaggagggagattaacagcaagaccccttagatacaagtatgtgattcacaaataacaaggaaaatgcatatcagagcaatgacaacctacactataaagtaaaacacatcttcctgagatagacttccaaccagcactaaaaggagtccataatatatgcaggccctagagataatggggcaacaaaggaggagggggaagcaagccaaactgccccatgaagtaggaaaggtagcaaaattaagaaacacattcttattaaaaacaacatgccagataaaagcatgcttaacatgaaagcatattttacagactatatcagacctgtatctcttttggaaatgttgcactgaacaacatagtctgtctggcacctggtggaggcatgtccatttgctctacaatcttccttatttgcggctcaaaacccatatccagcatccgatctgcctcatctaaagccagatatcgaatcatctgcagtgaaactctagctctctccagcaaatctaccagtcttccaggagttgcaacaagaatgtccacccctctttcaagatcccgcatctagagaaaatataacttgttagggtaagggtatataccaaaacctaaaatttcttactatcatttaacggtaaaatttgatgggtcaatttagattccatattggacctgttaagtaaaatttgcaacaggatagaatctacaggagaatacatctacagtgataagtttgagactcattaattacaaggtgcagcacctccagcaaatgtactacaatatataaccacaaaattcttgaccaaccaatatccacacagacatatgcaaaaacttctcaagtacagaattgcaacattattggaagattgaaatcatgaaaatccaaacagtactgaagctcaaaatggatgtaacaaaatttcacaccatggctcactatgaaaccatgagactatatatgcttccaaacatgtacatacacattattttttttttttctccactctctgactacccacacaactcatgcttcacatatgatgtgttccctagtgttttcatgctgcttgcattgatcattcaaggtcataattgctgctgttatatctatattttgttgttgttccttgcatgtggactaacatggacattgtgatgtgtcctctggctatttgtgctgaaagggtgaaaactgaaaaatgagtacaacaaataatgaggttgttatgtaaagccactgtgtaagtgtcccttgcatacccttgctttcttttgactgttatgcgttgaactatggtttatagtgagtttttcttttttactttagatgcctatatatgtgtgtgtgtgtgtgtgtgtgtgtgtttataattttctctgcgtcaaaatgctaataaatctgtttttcagttttatgactttgttaactatataaaacatttctaattatttatcatgaatcttacaattaattatacaggtcggaaaacgagtcttctgattcatgattcaaatccctatttgacaaccataattaccaaacttggatctcaaatagaacaactttgctaggtaatttgaaacaaggtgtctacacaccagagagagaaagagctataataattgaaacatctatcaagaatataatgtcatagactcagaactagttgtgggagaaacaaagtatgaaataaagagaaacaaagataaaagggacaaaaacctgctggtttattggtgctccaccatatgcaacaaccaccctaaccccagtttggtatgaaaacttcctagcctcttcatgtatctgaaaccaaattagaacaatacaaatatattttcattgcagaacagtgtccaattaaaatcatagcataatacaaggtaaatctaactaactcacttgcattgataactccctcgttggagaaagaacaagtgcaagcggataccctgtacgcaccccacgaggtggcctctgcacaggttggcccctcatgattccactgataatcgggaaacagaatgcagcagtctttccagaaccagtctgggcacaagccatcaaatcccgtccagctagggatattggtatagcatgccgctgaacaggtgttggcttcacatatttgcaccttcttatgttctgattaagtgcttcacccaaatcaatctctgcaaacgtattcacaggtgggggcacattatcaccactggtctccactggaatgtcttcatatgcatcaaaatttattcctgtattctcctgctcactgaatgcctcttcagcattatcctcttcttcaaagggattgacttcccgttccctgccacgatcccaaccaccacttttgtttccccatccacctgtgcgtccaccaccaccaccatacccaggacgataatcatttctgggcgcattataacggtatccagaattaccagcaccagaactagagccagcaccagaggaagggacactatatgctggagcaggggcaggggattctcctgctggctgacggttcctcagatggggaggtacataaacaggtcgcgtaggagctaaagtgctaccagttccaacattgttagcagaagaaccaggacctgcgttttcagctgcagaatttgcagccaaatcagcccatgaagttcgcatagtcaataacaattctcgtagtcaacagttgtccgcaaaattcaaagggaaaacccctcctttccaggatcgggataacacctttacaagtcgcccccaattaaaaaaataaaacaaaaaaaactgctgaaacagataaatactctttaaaacgaacaaaattgctcagaaccagccctgcaaagcaacgaattccgatcaataaccgttgcaaacatatttacatcacgatatcacataaagcagaagccgatcagcagaacacatcaactacaatcgacaaagtctcaaaaatgcaaaagcacaaactaaacaaatgagaagaacaaaaaaatggatgcataaaacgaagttcattctcctcgaaatctcaaatagactatagcataagcaaaatggcgaaccaaacacaatgtctttgaaagacaagcacgaaaacaaccaaaacgtgaaaagaaaaacaccatagccgaagcaacgaggaaagaatgatagcaataataatagaggcatgcagattgcagagagagagaagagccatggatgcacctgggtcgtgttgggaaggtaaaaccctgaaacggtgagagcagtgacaaatgaagaagatcgagaaaacctaatttttggtttggttgcagaaagagaaagagaggagaagcgccttcaaaggttagaaacaacaaaaatatcttttctctcttttgtagtgtttttctctctcttctcaaaacttcaaattcaaaataatatataaactaacagtgtagaaaaaataaaatttaacattattactatcattcaattgtctataactataaaggaaatcagatagtttggtatccacatttattttcctattttttatgtcagtgtaataggatatataatggtagctttataatttttattatttgaagtcaataaatttgttgtcactaatttgaggtgtgtttatttattattttataataacaattacttaatatttatttggtgtctgtatttacataaagtataacattttagtatttttatttattaacagtaattcaaggatttgattgatgtgggattactctccaagatccttcacaactgtttttatgttgtatacatttgtgaaggtttttttttttatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcttaaaaattgtgattgttatttttttatttttgttggttaatagtgttttttttaagattaatacatagtgtgtttaacttttgcatttttctattatggactagctttttttatatatttcattcctactaaactttttattttctcctattcttttttgttttacaaattttaaaaaattgttttcaaattttcttaaatcagtttattttttcaacgaatcaatttaaattttaatatcaaaattaaaatggttagttttaatttttttttaacgaaacaagttttgattttaaaatcaaaatttcagtttttatttattttaatgaatcagttttaaaaacaaaattaaaatgggtagttttaaaatcaattgcaacttttttaagaaatcaatttcagttttgaaatctataacaagtaataaaaaaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnntctaattgagtataatataaccagtggaaacacataacactaacagcctgtgtcttcatttctatttttataaagtatttttattacattaaatttgatacattataacatttttttcttattaatatgaggatgtgtgtattcattttgttctaaatatatatttacatgttacttaattttttgatatcacatgtaattaatttatcacttgaaaatgtgcaaattatatgtatatttcgtttcaagatttttgtggaatctatcactatagaaaatttatttatttattaaattgcacgtgacctatttaaagttaaatcataaataatcaattttctttctgaacaaataattaaaataaataataaatatataataagactagataatattgaaatttaataggatattgtgatgattaaatttgacatgtgcatattatgttggaaagacaaacaaacaaaaagaggataaaataaattaatgagaatttctggatcacgccgtcccctgagtcaaggcccaaagctgcatcaatctcattctcattattggcaaccaaaatcaacagtcccaacccaaacattaaaacatcatattctagttttttagtaagattaaaatatatatttgttttataaatatgaaaatgtttaaaatttatttttataaaatgattaatatatttttcgtcataataaaattaaaacgtgttctggaaaagcaagcacacgatccagaactcatataataaaaaataaagttaaaacttaaaagctctatacggggtattttttggaaaggggtaaattttaaaaatctacggaggtgcaggaagcaacagtcaagtttgagagttgggctttccggatcgggttgggcgacccaatttgacccaaaagtgacttaatccaaattttttgccctaacgcgattacgcgagtcgttttctgattctacgacatcctcacgaagacgcgaacagagcactcttcctctcgtctctcagttgctcctttattgtgatttgtgagtgctctgtatctgtatctgtaccattctttgttgataagaatataatatgatagaacttggtatctgctaagtttttagtactttgttctttagtcaacttagactttttggtaatgaatttgttgtgctagtgtagtcctagaagctttctgtggcatcattctgtgaaatagaaaatttattttgctacatcttagggggataaatttagagagatagacttgtagagaaatttttggaacaactctgatctcctggtttaataatcacaaacatcaatttgcattcagtgtgaacattgcttttcttttatttgttaaatttaaacccctttctgactttcatctgttcagaataatcttttgtccaaaattgttgtttcagttgatatcctcccctccaatgtcttacattttcactgattttattttatttccaatttgtctttcctcagattatgttaagtcccaaataatgtattcaaagagagcctcatcagttacagttagttctcttttgaagttgtgcaaaggatgttgctcacccaaaggccttagtacattgagtgctgttagcactgctgctgaaaggacagatttacagttttctggtggttatcaaaatgatgattcttcaggttaccagcaaaatcgtgttgggttttatcaggaaagccgaaataaggttgagtctaatgagctgttgaataagcaaagacctgattatgtttcccgagcaaatgcagagcaaaattcttatggagctggtcagattgcagacggaggtcctataaatgtgacccgaaacgttcacaatagtttggtgggtcataatggaagtgtcaatgggtactttagtcaaggcaacatgaaaatgcaacaaaaagttagggcaggtgttgataatgcatggggctctgggatgcatgcaaatcccttggttgagaaacatggttggacacacgaacctggacaaaggatgcaatctcccaacacatatagttcacctaggcatttagagtcacagggaaatcttagaggggacataaatcaaaacattgatcattttcagcagccacaaaatgctcattacaaagggagtcatgaaatgcatcaacagtacccaggttctggacagtttcagcagagtctaaaagatggtcggtatttgccaaacttgaatattgcacaaagatcagtggttggctctcatctatcaaataacgcaaatcatgatggcgaatcagacaatgcatctaatgatagtccatatagaggtacacttgaggaattagataatttctgcattgagggtaacgtgaaggaagcagttgaagttttggaattgttggaaaaactaaatattcctgtggatttgccccgatatttgcaattaatgcaccaatgtgcagagaataaatctcttgaagaggcaaaaatcgtacacaggcatgcttcacaacatctgtcacctctccaagtcagcacatataataggatattggagatgtatttagaatgtggttctgtagatgatgctctcaacattttcaacaatatgccagagcgcaacttgactacttgggataccatgataacacagcttgccaagaatgggtttgccgaagattcaattgatctatttactcaatttaaaaacttgggactgaaacctgatgggcagatgttcattggagttctatttgcatgtaatatgctgggagatattgacgagggaatgctgcacttcgagtccatgagcaaggattacagcattgtaccatctatgactcattttgtcagtgtagtagacatgattggcagcattgggcatctggatgaagcctttgagttcattgaaaagatgccaatggagccaagtgctgatatatgggagattttgatgaatctctgtagagttcatgggaatactgggctgggggatcgttgtgctgaactagttgagcagctagattcttctcgtttaaatgagcaatcaaaggctggccttgtacctgtaaaagcctcagacttgacaaaagagaaagaaaaaaagaatttggcaagcaaaaatcttcttgaagtaaggagtcgagtccgtgaatatcgagcaggagatacttctcatcctgaaaatgataagatatatgccctgcttagaggtttaaagtcacaaatgaaagaagctggctatgttccggagacaaaatttgtgttgcatgacatagatcaggaaggcaaagaagaagctcttcttgcccacagtgagagacttgctgttgcttatggtctccttaacagccctgctcgtgctccgatgagggtaattaagaacctccgtgtttgtggcgattgccatacagcactgaagattatttctaagcttgtaggcagagaactcattattcgagatgcgaaaaggttccaccattttaaggatggactatgctcctgcggggattattggtgaacataaacttaggtactgcctgcctctttctttttgatatttcccttgttatttgattggtagctaataaatttatcggaactgaaatgtctgatttgtgtgagcaaaattttatacttcagaagtagttaagctcaacttacatgaaacaaataatccactttctgctccctacaccccatgtttgttgttcaatacagtatgcttagtttttagagtatgtactatgtacaattatgatatgagttttgccagtaaaactccagcatagaggtactttattgcgactatactttttccaagctgactaaattgttagtcataaggaaggctaggacttattaatacagaagagtggatggtatattctcaaagacttaaaaactgtcagtttgttagcattacaaactcttaatgctttggtaaaagcaaagagtgcatgacagatacatctccaattgatgcttaatatatccttattctaatgttgctttctaaaatagatcaaaatgggatttccattttcacttctaggagttgctgtttcatatttgggcttatgatagaaaatggagtagaggccaatgtgaatttgtttgaacaaatgtgaaatcatgggtcctgattttggatcctttccttttcttattaagaatggggcagtgttctgatttaagagacaaatatactactagtgtctatgtatgactggtggactgttgcatgggtaatggtggtaatgtggatttctatgatgctgtttttaaccttttatcttacttggccttttggtatttttgttaatcgtgttatgaagcaaaattaaggtaagcctcacaacaatcttgttatgcagatgtatcctgattcctggctaccagatggattgaatagaatggctgttggtaggtaacccctcaaggctgcagatagggaaattgttcatatatctcacggtcattaaattaaaatcgatctttatatccgcaaggagattggaattttgtttaaccaggctcttccacactattaatcaagcagtggatgtgcattcaagttgcagaggcattattcattgagtagttttatataattggttgttttagcttccatataagatataaattattattgccactccaggcaagggaaaaacttgtgtagttgatagacaagatttacattcaatggtataatttcagacaacttttttggctgtcaaaacctcatcatttacctcaatctcaaaatccaaatcatctcatttatagtctaaacttgtttgtcttgcattcttgcttgcctcttctgtgtcaaacttctcgctggtgtgcataattggacgtttcctgcttgcatatatgtgtgttggcagtttgagttttgatatggcttgctaagtgggagatagctgtcttattgtttttggtgcttagagaactagggatttgtaggtcaaaactagtacatgggtactagtctacttgctgattaaaaaaagggtacttatctactctctttttttggtgttgagcaagctgcttgcagaagccttgttggagcatttaggatgcttcgatggtggggtgcctctttcgtaatagttaatcatgaaggaatgatgaggtctctccgtgtgacaacaagttaatgtttgtgataacgagttgaataggaaatgggtaagatgtactttaatgaggacattgacacaaccacgtgtgattgttgtcttagcaacatacaaactcgctttaggcatgggagcagggccagaaaattattttaggtccaatgaaagacttatgttaggcttttcaagggagagggagaaaggataataagaaaatggaaaaacactgaagcgcgtatcaagtgattgaattattgtataagcaattcatgtctcacaactcatactaatggagctttccaaaagtactcatataggagaagaacaaaataaaattaatttcttcaaaagttaaaattaacttatatataagttaatttgtaaaaactttgtcgtattaattctttcaaaaactaactttttgcttgtgcataagctgatggtgatggcggaacacctgatggtggatttcgatttggacatctaagttggaagagatgacaattttagtgttttttaaaataaaataaagatgataacgtttattagttattattttaaattaattatttcaaaatttaaaattctgacaatcttaacagaacactaacattgacagaaaacaaatgatataattaaaatgatattttttaaaaatatagatgatgaaaataagagttttgaaatttaatggacaaaaaaaatactgacatttagctttctaaaaacaaggtaaatattacgagttcacttttctatatcttcgtcttatgtaaataacttaataatagtaaaaactcttttttatttttactaaaatcttgtgtgacttaagctttcgatataaatttacaaattcattttaaattttaaaatataaattttagttacatttttttaagtgttctcggtgatattttcccattaaaataaaaaattatttaataatatactttgatattataatttagaatataaactcaaagataaattttcttattagtttcactctcacatagatttttaatatttttttgtgtatttcatatgttaacaataattctatctcaattttcaactattttaagttatcctcgtctcatccttctatgtatatttgatcttttgtttgtctgtttcaatttatctttcataattttttttaaatgttaatagtaaaagaataacttacatcataatttaaattatttattatacatataaaatataaaagaactgcccctaaagttacattttaaaagaacttaacaatttttaaaatccaaacctcaatacacccaccgagtcccaatattgttgttgagcatgagcgtttcaattatttgtaatttcaattttgcccccgaaaaaggagtggttatcgaacaaaacgaagcctccaaaacgctttggtttcttcaccaccaccatccttctcctctctctctctctctctctctctctctctctctctaaaaaccagaaacaataaacacaaaccgaaaaggcgaaaggggttttccgagtgagatctagggtttccatcgatttggagagaggatattgatagaacgacctcaacgaacaaggtcaggaggtggagtactagaacatggattcggtgcctccgaattcgcatggaaacctcgatgagcagatttctcagctcatgcagtgcaaacccttgtccgagcaagaggtaacgttattcccgaaaccgcttcatctcgctccgttttatttctttcgttattatgaaatgcgatgcgcggatcgggaaaatctcttgttatttgtcatcagttttgtgctttttgctccaattgcttctcgtgcatcgatccgtggcttgttgtagcgaaaattgaatcggttcctctttgtgttaaatctggtttctctcggaattggaatggcgactggaatgcgcgtttgttcgaatattccgttagatttgcagaattcgtggtagcgattctagtttttttttttataattattttacattgattttgattatatcatgttattgtggtttttcagttttagacctaaatcaattggtcgcaattaatggtgtttttcttcatttaaggtgtggatattttagattgttaacattgactgagaattatttgaggaggaagaatatatttctttctctatgcttgagtgtacgttaattttttatacgataactttttacctgtcttattagggagggctgtaaatactctggattttggatacttcctgttaacttaagcgtactcttgcaactttacttaaggcagagtttagttttttgggtgtaatagtggaaatgttgatgcaagttaggagctatgatttgctacttgagctcctaagaagtagaaaatacacaatttgtttgtattattttcgtcacaaaaagttaggatagttggatttgctctaagtttgttgatccacggattgttgtttatgagttatgagtctatgcttattgcttaaggaagggttagttttcatttttgtccctagttgattgcattggtttttgaagaaatttaggcatagttttcggtctagagtcagggatacagctctgacattacatacgttgcatgacgtttgtcttattttggtacttacgaaacagcagttatttaatgacacatttattttgtctcctttgaacacggaaggagtcagcaaagctgaagggaagtattaaaaactgctggatccttgaatggacttgttaataattaataattaaatgagtaagaattccttgctactttctcctactgagtatcttgtaaagcatttgtattaatcaagttaaacatttccaattagttttgcttttttttgttatttgcacgtgccatcatatttgatcggtgggattcagggagttagaggaaagttctacctaggtttttgcgggttcagatcaattttcttttttagcagagtaagttacttgtggcaacctgtgctgcttttgtggtgatgtggggcagaggatcctatgaccactttaatgctctgttgttttgtgttttttgtttctcacagatcacggctgaggtagcggcctttcacagaaaaaatcacacctattagaagtcacaactctgaacaggatgaatccttgtttttctcttcccttcttattatggccattgatttttagggatttttttttttacagtttaaactctttgctaaatcagagggatttagggttgaaaacattgaatctctacatccattaaagtaaaaaataaaaacccagcattcccaccctcgattcacaattcagtgttcttttgatgtattttcctggtttctaattaacacttaaaagcccaaaccatagttgtcaatagtgtgtgattattgtgacattgtgtcatggcacttggccgcaacagaaaagaatgtcttctttctggaaatagccttgccattgagatagtgttgtgatttttttgatttagcgatccaactctgatttcactttgcacttgtgtgtacaggtaagggtcttgtgtgataaggcaaaagagattttgatggaagagagcaatgtccaggtgagtctgtctattttttatcatttatgttagcatgtttatatttgtgctaggtgtagggatttttttaaaaattggttcatatgtcaccaacattgtttgcatcaagcccctttttcctctcaatttgtgaccattatctgttaaggaggtcttattatccaccatttatattggtttttactttgtttaatatgtttatttgtagggcttttagctttaactcatgatgattttgaatgactgaaaaaactaaagagattatttcatttgccaataattgcagcctgtgaaaagtcctgttacaatttgtggtgatattcatgggcaattccatgatcttgcagagctttttcgcattggagggaaggtattctttatgatagttggttttacattcaacatgcatttattaattttgtgacacattgactacatagattttataattatgaaatatgtagtacttggaaaatcaggaaattccatgctccttagtgttgtattgcgaaattaggtttggcctatttcttatttcatagcagaaagtctaattttttattgagaaacaagctgcagtgttattgccaatgagttgcatactcagtctctcattctcttatttcaaatttgagatcaaatgtgctatgtgcttattttattctcggttgaaccattattttttagcatctcacccttgcatatttaaatacttttttttgcttttagttgaaatatggaacctctttgttaaatactgattcttgttaccatttttgttggtagtgtccagatacaaattacttgtttatgggagattatgttgatcgtggctattattctgttgaaactgttacggtaaatatttattgtttttttagaattcaacttcgttctgacatatttttattgttatttattttttataagatgttatgggattatttggttaggatgttctactgaaatcttataggtcttagactaattgaccaagcttgaattgtatttttttttaatcagtaatttgatatctgcttagaggattagaaaattacttggtttatcagcagtagttttttacctaaaaatttctgttttctggaccataattctaatattcctttctttgtgtcatactcctacaatgagaatgattcattactattcatgctatatgccatgtgtatgggggtttattggaattattgggtgccactattaaacttttcgtggttgtgcattgtgctatccaaaataaaaaaaagtaccatgattatgttgtatgtgtaaataatgcattatgtctgtagtataagtgggataccaatgtaacacactgacatataagtaaacattgctgagcaaaataaataaatattaacatgcagagatgtgtatgacattcaaactgattttgaggtacatgttgatattgctattttttaattgcgtagtttagatggtgtatattttgcttccatatggtatttgtttgataacattttgggtgctaattaagtcataatgcagcttttggttgcccttaaagtgcgttatcgtcagcgtatcactattctgaggggaaatcatgaaagtcgccaggtttgttcttttttaaatcatgtgatcttcctgttagtagtgaattatagattagatttaaaatcctattttggtgattggaggcatggtcacttgtcagtatcagttgtttttgacagattttttcttatcaatatactacccataagttcatattgctgcaatgctgccaatcaaatgctttcacacatccagatgaaagaaattatgtagtattttgggaaccaaatatgcttgtattaaaaaatgataccatggatttgataaagtagttggagttagaacttcttacttttaaagcaacttaatatagcactgattacagcattgacttaattgtttgttcagttgttttgtatgctttagctttgaatgataatggctgttcttacctgtctgttgcagattactcaagtttatgggttttatgatgagtgcctgcggaagtaagtacctgctaagtccatggctgaggataagcaattataaaattgcaaaatgattccaaattaaattttgtaccgaaagttgatctggaattcatattattttgctaatcttttttttctcattttaatccttctttttataactttcattcttgaagttgtgcaatcctatattggtgaatatttttatttcatttgcaggtatggtagtgctaatgtttggaagatctttactgatttgtttgactactttccgttgacagcattggttagtatactattacataattttggaaaggactgggatattttgttagatggtcattgttcttagttccaaggtagtttgttcgattcaatgatcctgggcaaccttagtatgttggcttgcatttaagattagaccatggtggaattgggtggtatcactgtgctggattgtggaatctgttggagcagatgaccccactgtctttcaaaaaccctatttccccctgattgggaaccatttcagatgacctggtgaatgaaaaattgaatgttgccaactgagattcttggtctggttgtgaccaattttggaaagaaaaaaaaccttgaagcttcatctcatgtgacatcaattcaatccaattcttctaacttttcaatcttgttcaaacccatctagtcctatctgttatttgatctgttttggagctttcttttgaagttctttggtctgttcgtgttctagagcatccttgtgatctatttgtgctctgcctgctatgtggaacccatggctgtctgaagaagctagcattgtttttgtttctgaaacctaagaaatgggtttttttatatttaaaataaacacttgaggatcttcagactgaaattttatgttccatctccttcagcatcttatatttttataattactatcaatataaaagtaaattgaaacattaataatttttaataacaaaaatatgaatttatatgctctcacacatatattatgaattttgtatgatcttatgatccttgctaatgtgccatgatttatgatctttagcccttcccaatcctgagtaggatctcaatttaatgaccttgtctagttccatgtgcattttgttcttggtactctgaattcagtatgcttcttttgagctttgtctagtttaattgtgtctcttctttttgattaagcttcatgatattcttctccatcaattgcagtgctcatatttcactggatttctagttttcaataactgagtgttgctaaagtgtgatatgtttactttcataggttgaatctgaaatattttgtcttcatggtgggttgtcaccatctattgaaaccctggataacatacgtaattttgatcgtgtacaagaagttcctcacgagggacccatgtgtgatcttctatggtctgatccagatgatcgctgtggttggggcatctctcctagaggtgctggatatacctttggccaggtagtcctgtttgttatgtatcaagcttgattgttttcatctgtcaccattgcttttttttattgcttatgcatattgtttttgtaggacatatctgagcaatttaaccataccaataacttgaagctgattgctagagctcaccagctggttatggaaggatataactggggacatgtaaatatttgatatcattttgtttgttcttatattcattcgttgtggtaagtagttgatttatagtcccttgttgcaggatcaaaaggtggttactatatttagtgcacctaactattgttatcgttgtgggaacatggcatcaattcttgaggttgatgactgcaaaggacacacattcattcaggttgagcttccttctttttgttatctactcaagtaatatgttgtggatctgtaactcttttttagtcttttgtacatatgttaatattttttttaatctcagtttgagccagctccaaggaggggagagcctgatgtaaccaggagaacgcctgattacttcctatgatactattttggtcgagttgctgttaccagcatagcaactaatgccctgcagtaatgtgcaagctcatcttcttgtccaaatcagccatgaatcacattgatacttatatttttgaagttaggcttcgctggatgtgttatttagttgaattataactgaatctttccaagtggaagctgagcagcaggcgatgctattgtgggcatgtgtatcattccagcttgcagtgtatcagttttaatgtttttcccccattttttcccttttctatttatttgcaagtctcttgacctttcttttctcaatttagtattattgttaagggggtgggtttctgtagattgataatgcttttaacatatcttttaatggtgttttatgattttttactcgtcttgtaagaattatattctaataggtagtcttgtttttacatgaaatgactttcaatttttctaattatattcgtactctgcgaagcttggcgaaaatcaatcgagtttttgtaaactatcgtatgacttttttgaagagaactattgtatgacttgataaactttattgttatcttgacatgatcttctgtttgattattcaaagaataataatttgctgtcctctatgcaacttatggctttttgatacattgggaaaaactttttgttgcatttaatttcagaatggatttctcattagttgcaaactattttttagcacgtgttggaaaatgaggtcgagatgggtggacgcactagtgcagttgatcgaatttaatttcccttgatagaataaaaatgtgggaaaggttctattgtctaaatgataatcttggtacatcctcaagtggtaacatttccgagtgtttctgtggttttgggcaagatctcccacatgactacagtcgtatgtcttgattcagtttcatcgttcaatagaattttccataaataattaaatttagaacttatatttcttacattacaatatcgttcatatgggttctgtaaactcgaagtgtacttacctgccaaggctatccttgtcaaccaaaacatatcattagccgcaagttcaacagaaacttaccctggtaatctgcacttcgtaaactccccatatttcaattaacttcttgagaaaacatccttgagttcaaccaaactggaaaagttcatcacaaagaaaggtagactcttaatgcactgaaccaattactagtatttgtggttgagtttgttaatcgggcagaattagttggacaaataataattatcttaaccattgaaaaataattttaatcagttgatgtacaaatttgtacttgtcagtgcatgccttataaaccttaaaactaccactattggtattttgatacgtatcacctctgatactaatatgggatagatattatagtaattggacaaataataacatgtttttattgtgttcacaataatcagaaacaacttataaaacattattgtctttattctaacttctaattcatgcttttatattaatattacaataatttcgttatattaatttttagaaacttgtaatggtgatcccatatctcatatttgtacttgtgtttccttaaatattatcggtatttaaaactgaaacttgactaattttttaaagaaaagaaatggaagaaataaaactctccctctattagagaaaaaacaaaaacaattggaaagagatttcaagaccttcatttctcttctccatcccttcaaactccttaaccgaaaatgaacaaattttatcaaaatctcattcccctgttccattcctttccagccgaagagtatgtaagaaacacttagaatgagcactatacagcaacaatagtcacggtattgataattgtaagttacacctggtttaaaaattaaaccacttcacaagcgacaaaaagtacaatgttacatatcacttggtaactttgaatccagtgttataggcttgaatgcagccaacaccacagaaactttacatgcaagaaatcccaccattccaactatgagatcttttggtgttagcatcacctgaagatctcctgagctataccttgatgcaattacagccaagcctagagccaatgctacacttgctattggacccttcactcctctgaacaaagcatcagttctttctttgtcattggtgattaattctgaagctggcaattcatccactgatctctgcaacagtaaaagatacaagaagcctccaattccaccaatcaagaaagcaatcccggtattttccccagccaagagggaagcaactgatgtaccaaaaagcatcagcatggcatcataaaataacaatgagaacttcaaatctgcgtattctttcatgctctcttcatttgagatctttagaacttgagagtaagttagggtcattaagtcctttgttgaagatgcttatgggatcaatcccttccagctcagtcacaaggctaggtcttaattccaacatggacagatcagctccctcaccaagcaacacatcatcaatctgaaagtcatacaggaagccagtatacgttggtaccccatcttccggtccagatggttgcccttcacaattaataaccattaaggatacacttcctaggcgccactgacctgaccttagagacagaagaagggtattgttagaaagcctaggtttaaacagataaatatgggatgaactaatgattgtaccaacaattatttcttcatgtttcacaaagagcatattataagcttggtggagggttagacctgttgtttagtctttttactcttcatctttcccctccttcttttccccttctttgcttttgtctttttcttttcaacctcctcgtatctatcattggattcatctaccactgaccccaattagctaggattaaaggtgttgttgatgttgttgtttcacagagagcatatattggttgcataggattaaaggtgttgttgatgttgttgtttcacagagagcatatattggttgcataatgatttaaaaactggaattcgaatctaagatgccagaagaaatataatagtatactggcttcctagcacagaatgcagaagggatattttccttggtacttaaaaacaagtttctcggcaggagtactagcaactcattctctcatacactttgtcctaatgatttaaatttattagaaacttttcaaaatcacgagtgagactcattaaataagaagtaaaacctacaacattgtgatttctaatatatttcaactaataatagtgtattaaaaaaagtgtgttagagagtatattgttagcatttgtcttgtgggtagacaagcctgttaatcaagggcactttaaaattgtaggtcaggaatgatgtctatgaatattttaatcatttgaaaacaaatagacaataataacataactgattcaacactgacccaaagagccttaagttgtgcaattttaggaccctcaaaaatgaattcatctaacctctttggaaatgaagcatgtcaatattagtcatatcccctgattctgtagaatgatccatcatcaaactcacagcgatcctttgcaatatggaatttccattttcatctatcaagcatagtagaattccagcatttaagtcactaatactagagccatatgcgttgcttgtaactaacttgaccctaaataaagatgtggatccatcctccttcaaagatgatgaaatgttctctactgatgtatttgtgtacactttcacttcagaggctggcaagagatgtgaaggcctcgcatagctctgaaaatctgtggaaggaaacatcagagattgatgaataaactaaaatattatgcaacatcacaagtacttctttagaacattaatgatcaaaatgtctactttaatggtcttcattgaaatggtcttcattactgaaagatgtgttattacgtcataaccctttcccttaccatctttcatcacaaattaggagtaaaaaaatagagaaccattgcatgtgaagggaaaagaaatcactcgggtctgcatttcaaattaaattagttggcaacctagataatcaatggaactacctctgaggctctgatcaatcccataaattagaaaagggaagtacattttggtaaaaaaaaatgtggaaagcaatccatgttagttaataccaggccttggacccaacaaatactaaactgattagttttgccaatttaatagaagttggttaaaccaagcttcacgtgtgtatgactcaagttaaagctaaaaaaagaaggcaagattccaggatactaaagtgatcattgactacaaatttttgaacttttacataaattaccctgtaaatgcataaatcagatgaagccaacaaacacttggacaaccaaaaccaaccaattagcttcattgcaataatcttttacactataatacctggcaagttgcaatcataattgcagcattaaaaatgtgaaggatttgattaatacttcaccccactaaagcaaatgacgtgactatataataattgactgtgaagtctatgatcaaaaatcataattgattatgatcattgacttttagggacaactgaccagatagatgcaaatccgtataaagagtaaaccgtatcttaacaaccagcatgtattttataactggattaaatcctctcatgagatttttgtacgaaaaaattatatgaaaatttatatttgattcccctaactttagaggaaaaagtcaatatttacaatcattaattgaaaaattaaaagattatatgatgataaaatacattcaaatatataataaacaaggaaattattttaatcttaatgtttgattttctatgagtaaatcattgcttttgtatatgcatgaagtgaatccaccgttttaaaggacacaaaatcttaaaaattgtatttacataagtactattaaaaagacaggatgctattaaaattcgttaaaaaaaatattaacagagaggtacagagaatatcatccattcccataatctatcaataacgaagcaaactaaaattgaaattaatttggataaagctaaaagttaaacgtttagatttttaataaaattctgcagaaattgttacgtgggtaccttgaaaatcagaaggagatagtctggcccgaacagcaaagcgtaaatatctgttgtgggtaggaacccttcttgttgatgaagaagatgatacttgtatgattgttttcctttgaaaatcatgagagtgacacgttgaagctgaaggtatcacagtcctcacatgaattccctccgtgcctctatactccaattcaggaattgcagtgcagtttagagacgcaactgaactacagacatttgaatccatgaaataatcaaagagattattataaagataattttaaagaaaattgagcaacttcaacaagcgtttgtagtccaacggttaggataattgccttccaagcaatagacccgggttcgactcccggcaaacgcaaatttttttctcgtttactttcgttcttcgaaacaaatgttcttactaattgcatttttagttttatttcattagttttaatgttatatgttgataaattcaacaaagccacaagacccctaacacaatatgaattcttgaacagtatttcaccggttttattctatatgaattatcaattatcatgatgttacacttaaaaaatagtgtatttgataagatatttaagttaatttttaattttttattggatagaaaattttttaaaacttttttatgaataagtttttttatattttttagaatattatttgaaaaataatattttttaaatattagcttttagatttttattttttttgtctttaaatatttattatattttttaattttttaatttatgttaatattttattatttttatcttttgtataattttgcatttttagttatttcaacaaataatttataaaacacttgtgattaaataagataattttttaattttcaactaaaacagtttactttttaacttttagctaatttttcatataagtttgttaaacataatcttaagacaagatattttaattaatttataatttatttattaattgaaaattttgtttgattgttcactaaannnnnnnnnnnnnnnnnnnnnnnnnnnnnnnnnnnnnnnnnnnnnnnnnnnnnnnnnnaatattaccttttaatttaaaattttttattatttttctttttatccttgatatatttatcaaaaaaatttattattctttttatataaatcatgattttattatttttattattattttatctatttcaactattttaataattaattttatcaaacacttatatttaaaaaagataattttttaactttgaactattaattttaaagtaattttttattttttagttaattttttaattttcaggtaattttatgaaagataaccttattcattagttttaatgtcctaaacggaagggaaagtgctaatgtgatgaacttgcggttggaattgggaagcatgttacggtctgcacaaggtattaggcaccgactaggggcaattatagctcaactcaaacaacccaaataaagggacaggggatggatggagttgtacctatcaattcatttgagaaatgaacattaattgcttcaaagaaactatattgtattaactattcctttttaattgttcatgtccaaattgtttcaactatactatattttttttattagtattaaatttaatgtataatacctaaaaaaatgtataaacttatagtacacgtcttgaactttcctttttaataaaaattataatcaacatatttttgttgaattgttgaacaatgtcaaatgtgaaattaatccattcaaacatatttttcaattttattaagtatgttggaaatgattgatttttacatttagttgatatatatcatcctttttattgatattattatgaacttaatttttatgtattgacaattagtataaatacgttttatattgtgaactaatctaaaaacatactgaataagacttttaaaataattattataaaaattaataaatttattataaatgagaatttgcaattaaatgttaatatattttttaattctattaatgtggactatttagtgtattattatttcttttattaattatagtcaaacatatttgattaagaatctaatattatattagaaaaaagtaatacttttttgtttttctaaaaattataaaaaataaattctaaccttattatcatatcatcgaatatattgattaactagtatggannnnnnnnnnttagaacaatagttatgaaattgtttaaaattttgagtatacaatatgttttttcaaaattcagtacacacaatcttaagttgaaatttgagcatacaaaaaggtaattttggtacactgttagatataatctaatacacacgcgtaaattagctaagaaaatattaaaagtaacaataattttatcatcttaaatttcaatattcggttatgtttggtaaacaaaacaagcaagaaattttataaacaaaaaaagtgtaagatataaattaattttttagtataagtgatgttaaaaaattttaaaaaatgaaaaattcatgactcatcaagtcaactaagttattaattcaaagtcaaatcacattgaatcaaattaagtcattccgggtcaagtgcatatctaatccaacatgtgatttgaattggatatttgattctcagtccaatggattgatctccacttattattggactgatctccacttatctgaaccaaatttaataattatgttttgaagtataaaaaattaagagatatgatactttaaaacttaaaaaaaaaatactttaaaacttttaaaattctgtgataacaccataaatttattatacatttaatatatttttaataataacttattaccaataattataaaatgtgtcctttactagttaagtttttttnnnnnnnnnnattaattaaatacacatgtggtcataaaaaaaactagtgtcatcattatatcatataaaacaagttgtgtaaaaaaaaagtacaaaccaagttgttatcgattgagattacctacaattaccagagatctcatccattaagattgtttattagatgataaaaaaaatagtgtataactatatttcaataaatttgatgcattatataacacattaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatctatcaatactttatatttttagagatcatatttttagatatcaaaataagtatttattcacaaagatttggtttgtttttcaaagtcaaagatatgtacgcaataacctaaagcgaatattctacatattgaattaatatatttagaggaaacatattgaattaatatatttagaggaaacatattaactccattatatgttcaataatcaaacctaaatatgaatgtggtttattctgaactcgaattcgtgggttcaactaaaaaacttaaatattggatattgatatgatttataatgccgtacaagaaaaattatagattaactcctatatatttaattcaatgtccaaacctaaatattaaagtggtttattcaaaactcatgggttaaaataaaaataaataattattggatattgatatgattataattccgtaagagtaacaattatatattaactcctttatatttgattctatgttcaaacctaaatattaaagtggtttattcggaactcgtgggttaaactataaaaaatattggatattgatatgatttatatttataatgccttaccagaattatatttaactcctttacatttgattcaatgtacaaacctaaatattaaagtgatttatagaaagaaagaaaaaagtctttattaactggagtccagtccaaaacctttttgcagtgacacaataccgtaatgtttttcagggagagatactcttaaaatttaagggattataaggaccgataacaactccctgagcacaaacaaagtacttgacggagaacaaaattaacaataacatgagaagctttctcaatgggcacacttgcttttcctcctcccccacttaaccattgtaaagcacacatcaaacaaactagccaaaaattccatatatttcaaccatgtgaattcccaaattgagtgggttcacaataaatgattgaaataattacaatgatgtgaatcaaccaaatcatttgacataaaccataaccatatgtttcatgtttcatgattaggtgagttttaggtggtattaaaaattaaaaaagaaaaggtatagaatataaaaaaaaaaaaacatttaaacacaaaataaaattaaaatcatttttccttaaacaattagaacaacttgacagagaaaatcatttcttcaattttatttttgatgaatatttcttcggttgttgcataaaatgatcaaagttttgctccataaacacgttccaagtttgacgaagttctttagtaaaaaaaaaagtgttcaactaaatcgaagcccggaattaagaatttccccacaaaaccgggaccagtaattagagtacacgtcaagatatcatgtattcgctttgttggctacgtttgtagttggattattgcaagcataattaattaaaacgtctttgtgagattacgcaaaggaatatatatatatatatatatttttatttttttatttttttcaattccaaccctttgattggtatcttcatcttataactagaattttgttgttgaagtcaatcattcaataacccaacatggaggattcttccctctacacttcaactccaggttcccagcagcaacatcttctaaaccatcatagagaagggtcagagacagaacaagatggttccaagaccaaatcacacaagaagctagcacttctccctttggtttttcttatctattttgaggttgctggaggcccctatggtgaagagccttcagtgggtgctgcaggccctctgatagccatccttggctttgtggttttccctttcatttggagcattccagaggcacttctcactgctgaattggccacaactttccctggcaatggtgggtttgtgatatgggccaatgaagcctttggacccttctggggctccctcatgggcttctggaagttcttcagtggggtcatcaacttagcctcatacccggttctctgcatagactatctcaaattggtgatccccgctttatcttctggcttccctcgctctgtgtctatttttctctccacttgtgtgttgtcttttttgaactattctggtttggctatagtgggttatactgcagttgttcttggtgttgtttcacttttgccttttgtgttattgtctttgttttctttgcctaaaattgaccccaacaagtggctaagttttggtcaagagggtgtggagaaggattggacactttacttcaacaccatcttttggaacttgaacttttgggacaatgctagcactctagctggtgaagttgaggagcctcataaaactttcccaaaggccttgttatctgcagggctgcttacttgtttgggttacataattcccttgtttgctgccactggggctatgccacttgatcaacaaagttgggttggagggtattttgcacatgttgccggggtcattgctgggaattggttgaaaatttggatggaaattggtgctgttttgtcaataattgggctgtttgaagcccaactaagtagtgctgcataccagcttcttggtatggctgatttgggattcataccaagaatttttggagaaagatctaagtggtttaacactccttggatggccattttgatctcaacagttatagcacttggcatgagtttcttgaccttcacagagatcatatctactgtgaatttcttgtacagtttggggatgcttttggagtttgcagctttcctaaggttgaggaggaaattccctgctttgaaaaggccatttcaggttccattggggttctttggattggtcataatgtgttttgtaccatctgtgcttttggtgtatgtgatgagtgttgcttccaaaattgtgtatgtgactagtgccttcttgacctgtcttgggattgctttatattatttcatgaatctttctaagtctagggagtggcttgaattcagtcgtgtgggagataaattgggtgaaaatgattatgttttgtagaagtttggtatggttgctttttttttatggaatctttgccaaaagtatttgtttggggtagaagaatctttgtttatactgtgtgtatatttctgcgggagaaatttgattctcctcagccattatgttttaaagtataaatattgtcatgcaaatgtcttgatgacgatttaaaaatatgttaatattaaaataaaaataattaatgaagtatcaaataattgtacaattatgtaaaatattgtaaacagaatttactatttataaaaaatatcaagtgtgataaattaaacaattgattttgagtatacaccaaaagaaatagacatgtacccaaaaaaaaaataaaaatgagtcagtcccttttgtccttttttgcttttctctcgtgtacgtacgaaatgcctatttgtaacgcttaactgcttcctcaagtggccttggtaactgatggtgttaaagctgaaaagaaaaggaaaaatgtggacaatattaatgttgtggagtaattgacttatatacattgataattgggaaataactaatgtgtatatatatcttcgaaaaaaaaaattgagacatatatttaaaattactaatataaattttatataaatattcaatgtattatttattgtattgttaaatataatatatttattaaatttaataagtatgatccatacggattggcccatacagattggtcaattatccgtcattagtcgtcgcagctatgctcagaccacctccctcaacgccgtctccgccctcctctccttcccctccgccctcttctgtgatgcctgctcccgcagctgctcttactccccctgcctccctctgtgattcttgctctcctgttccccatctctatctctctcatccgcacaccacaatgccgtcgcacgccttatctccgcgccatcacccttaagatactcgccgtcgacaacgccatggagtccgtgaagagtggcatggtcctcggcttcagcattggctccacttcccacttcgtccttgacctcggcatccccttctccgtcctcgaccacaatccttgccatgatctctccatcgacaatgccgatgaggtcgttgaggcgatccataatctataaggttcttacatattcataattagtaagattcttacgaatttgtcaatctgtatgaggttacggattcatcagtaagcccaaacagattggcaaatccgtaagctcatacgaattgatcaatccgtaagaatcttaaggaagggcatttttaattttttgctgtcttttctgagtgtatgaagaaatttgtgttgtgcatgaagaaaaatccaaaaatcacacattgaaggagcaagaagtccgaaagcccaatatattcatgtgcacagaggagaaaatcttctaatttgaacaactagcccaattctctctctttgtcaaaaaaaaaaattacttccagcaataaccaaatagtttcattttgggtgttaaccattaaatttctgttattcaatcataaataattgtttaaattattttaatataattattttaaagatcaacaaatttatcatacataatggattataattaaataattgtataatttttttatattgtacataacttttttttctcattttaaaatatatgcaaaggtaattcaaatagttatataataagttagtttcattttttaaatgaaattttattttcatcctaataaataaaatatgagtactgttttttaatgcaagagttccaaatagttatatttgtacatgtaaataattttaaaattgacttttgttttcaaaagaagcttataagaatgtatacaaataatattaaaccaacattacattgacctgactaaaattaggtttgaactatttaaacaaaattacatatctaaatattgtgaatagaaaaaatattattaataaaataaaattctaaaaaaaattgaggattttcatatcataagttgttttctattttaaataattaaatcaaccaggataaatctattttaaaagataaatataatattcaatatttatgtttcattcacaaaattagaacataacactttatttaataaaaattaattgtccttctacataactaacaaatattaattagaattatgagaataatagtaatttgattttcaaaaaattacttctgatagtgattaatattaaagaagtgagttacttttttcatgagtgaatgtgaaatcgtatggaagtgggcaagtaaatcaagggaaagggataactcgtgactaacagcgttatccctagctggctttcggtggaaagtaacgatctttcttcttcgggaaatgattgttagagaaaaacaaaacaaaaacagttacctgactacactttcagaatcaagtcgaagctccacagcatgaaaacccatcatggacatgcaagttgcgccaataccacataaaataacaagcagttgcccagagctcactccatcaacatgcatatattcaaacttatccaatcctttacatatatggaaccccaaaaaatccactatcaacaagatgaaactagtgtcccctccattgcactcacattaaatttatatgagtaaattttatattattttaatttattaatatattattagttattcattattcagtttaaatttaaataaaagtatggtagtaaatatattaataaatttttaaatatattttatatacccacatgtttcagaaaaatgtttttataaggagtattgtcctatgtaaggttctttttcattttagtgatatctcgtatgctcatttttttttattttaaaaagttaatttaattcatttgttttgtgtgatttgcacacttgatttgaaataataaaaattgggtgaaaatgtttagttacaatgtaattcctttttttatttaatttacccttttaatctttaaacttcatctaaaaatgttttaaccatacaaaaaatgttattaataaaacgtcatctaatttcggttggaattaaaggaaaaaaataaattagattacataaataaatatattaagtcatttacctacgtaaattttgttttaatcttattatggttaattaaatctattttaaattaaattagttccaaaaacaacttttttattaaatatttttttgtcaataaatgttataagaaatgaaactttattaaaataaataaataaacatttttttgtcattaaatttcaatcaaatattcacggatggatatactaccaaaaaaaaaaacattcagagtttctctttttccttaacctgctattaatcaagtggttgatgctcatagttatagaggtcttttaatttgtctttactatacaatgtgctcttcctgttacctcatgatcgatcattttccagtgtttcctggtcccatctgcagatctgcttgtccaaaatggcgaactttttcaagactcatatatatcttcggttttgaaatattataggaacgtttaaaagacaattataattagcgtgtcgatttgctaacaaaatctttatacattcataatgtcgttaattacctacatgataatggtaaggttgattttaaggcaattgtcaagaaattaagaactgaaaagttacttacttaaatttgaataaattgaaatacagcaatgacatgaaaaaaaatacaatatactcaaattataatatgataaacattattaatatttataataattactttgagaatttactttataccactgttgttttaaagaccaataaaagaatttccgcacaccaaaaagttatcttgtaattaggataatagggcaagtttggaatgagaaaaatgaaaaagaaatattcaccaattttatttataactaattttattaaggaatttgattttttaatcatatttttttatttataagacttgagtactaaactttatttaaaaggaccaaactcataatcacttaaatcaatgacttgctgattatatattttcttcattaaatatatttacgttgttatatatatatattattttctttcttgtcaaacaatctacaaacctatttttctgtctgagtttaagagacatgtattatatgtgtaaaataattatacaatcaattaattaaaaatcatttttaattacttttaaagaagttattatcaaagtctaaaaaatatttatacagtaatttatggttaataacagtgtgaaaaataatacacatactattttttctttttcttttttttcctttttaaaactaaattaacgtacccttaatattcttaaacacagcgtttgactcatgtgtatacagtccaatattggtattatgaagtttaattggatttgtcctggtcaactaacgacggtgcagatggaggctcttggcacatgaaatgtcatttccttttttggttcggacaaaagaatcagctagcataggcaaaccaacttgaaaaagaaaaatttcaaggacaactaaaggaggtaattaaagatatgaagtaccaaataatatatatgtatggggaaatgatgtaccctttttgcaatattaattaactaccccacattcttccaacccaacccaagtcaatgaatgttttcaattgattttgactgaaaagagagctctccctttatcttttctgaaaggataaggagaacgtccctgtcatatttattttgatatatatatgtaaactaaaagtaatacatgcgtggcgtataaacctccaaatccatagtgaaaaagtaaaatgcttcaagaattttaatggataaatatttgcttgtttgtactgtcgaaaatttcaaacgtcctcccattaagattatgcgagtcctgtacaccagtgagggtgtggtgacatggtgtgaccggttgaaacctgatttttaaaaacctgttaattttacgaaagtgcccccaaactgtattttacatgtttagataccaatttcttataggataaaatacgttttgtttgtatttgtagtctcttatgacttgttttttttaatctttgatattaatttcaagaaaaacaagaaccgattgtaacatgttaattttataagtgtcccaaactacattttacagttgtagataccaattttttatagggtaaaatatgctttgatctttcgttttacctttattttttttagtttttcataattttttcactatttttagttactcataaattgtataaaaaattatcattttacttatgcaaatttaatctatatgttatttgaattaaaattcaaaaatcaaataagtatgaagtttgggagcagaaattgaataatttgcatttcactaggcgaaattgactcaatcttgtacaagcaaaaccatacatcatattgactctttttttttaatgtatttattatatcttgacccctccaagcatgaggtaaacaaaaaaattgagtgtatttatttgaattttattagtttatttaactataaaggtataaacctttgtcaaagaataataactttcacttatttttactttgtatgactgatgtcataattttattttatcgtaaatgtatttatttttatttaatagaactaaacaattaaaaaatatttaaaatatgcaaaaccacaatagataattaaattacatatatagtatttaagttgtacatnnnnnnnnnncttaagatagaaagtgtgtttgaatacaaaatcttaataaaattataaatttatttttgtttcgattgtattttagtggattattttcctctcacaatctcaatttttgggtaattttggaatatccatcaactaagagttaaaaggctaatccttcaccatattgagatccatataaacaatatcttttccaatacaagctctttcattctcatattgaattggaaatcaaatacttgatcacatatttaagagacataattatctattaattgtaacgctccgtatgcatccggttcattaacattgatttatggtcgttaagcgcagcaattatcacatacaatcaaaatggaagcaataaataaaatgacatcatcaaacgtcattaacaacatcaactatacatcatatatggtgaattcttataatatacagtatatataaatcataactgtacatattcatcaatgggtacaaaatcatgggcataaaacaaaagtagaaccaatatgctctccaacactatgcctaaggttctcatataaactattcctgctcaggcttcttgccctgggacctatctttgaatatcacctgcaaaacataatccccaacaggggtgagataataatctcaataaactcagggtccttggaaatttttcctccccctgattcactttcatgcatataatattaaaattgacattataaactagccatcacagctctcaagccatattaccacacacacacacacacatatatatatatatatatatgtctcaagggttcatcattatctttttataaaatatatcatcatcatttaatcatcacactcttaacacattacatgtacatggtatatatatatatatatatatatatatatatatatatatatatatatatatatatatnnnnnnnnnncagtgggaccataacatttgttcatagaattaggaagtttactcatgtgttttaattactatgttttacatgaataacaaattatgatattataattttaatttagtattataccagtcaatcaacttatcatttataactttggattaaaagtatttatgaaagtacttatgtttattttattccgaagacaggaaaaaacacataagagcttgaccctggaagatatcatatgtaaaataatgtcttatttcactcaactaatcccttataattacatcaccactttaatctttcttgcaaatgaatatagctaatgactaatttgatgataaacttttttacttaagattttatcnnnnnnnnnnnnnnnnnnnnnnnnnnataataatgttattatgtataacatttacaatttaatcacaacatttacactatcaataaatttgtatttaatttaacaataaataaagtttgcatttaagttaatattttgtgaaaaaatcttaaacatagtttcatataaattaatttctctaaaatatatgaccttttaaggttttttttttataaatattaagaaatataattaatttactgaattttaaaaagatacattaaataatgtttttaatatttttttatctttttaattaatgatttcatttattttttatgcattacttccataaagtatttattaataataatttaaaaaatatttaatatatcattgattctacaaatgacatatattttgaaataattttgttttttaaaatgtcatgtattttttaaacagagggagtatcttgcaatcactttagagttaatataagaagtatacggctgaactattattctataaccactcaccctatgattcacactactccaatcacgctcatccgttgccaaatcaccgatgattccaagtttccaaatcactttcactctctcctccctctttctgcttctattactactttcaagtcaaatcttctatttcgatctttctcacataatacatttccgtttacaaaaatcttaaattatatttatatttatatttgttacaaatcactagatgtccatattgatgcatccttcttttttttacatgcatcctttgttaagagttaataattatggcattttttaagcaagtgcgttaaacattagttacgcgtcctaatgatgtcatgaaagtgtatttataattaaaaagattactttaaaaaaatgaacgatggtaattttacatgaaatgcaatcattgcatgtaaacaattttacaaatgaattttaaagtaaaatcaaaccatgaaataggatatctctattaaaataatttaatggatttctagtgattaaaagaatttatcctgtcttccctctgatatagtatttttttcctttctgttttttgtttctgggccattcacttttgcatttatctgtttagaaaatacaactattgcattgaggtttatgtacaaatttcgtcataccaatatattagcaaatggagagtgaatggataaggtaattgagattatcttgttttgcacgtcacatccttccacgttagatttcaaagtaattgtatttagccaccacgcaattttttaatcattaattaaaaaactatgactctctcttaactctttttaaactattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagagaatgcttgtgaaatgcatggatatttgataatctaattttatactaaatatatatacaattataataatatatgggtaattaattttaaaatcatcatgacgttttacaggaaatattaattatacaccaaaaaaaggaaatattaattaaaattgaactgtttttttaatcagaagtttgaactattctaaaacaaatatttttaatacatagaaataaattacacgagcacaacacacaaatacatgtatttttaggaggaaaagagggtttgagactcttgggtaatgaaaggctcatttatcaaaatacagtcaaacatcaaatgcatgtatttttaatttttctctctgaatttgactcctgcagagctggttaaatgaaatatatgtatatgtatatatacatattacggagtaatattatttattaattaaaatagtaattaagattaagattgtgatattatattattgttttttttaggaaactattatgttattattaaagtattctcttaatttcaatcgacacatgtaatttttttttaaaaaaaattctcacttgagaaaaaaaaaagtaattatgagattaaaaccaagacacgacaccctggatgtagggttgggcacagggatgtattatttttgggttatttaattattttttgttatgagaaggacaattcgacaaagttacagagaaagatagaaattgttattgactattgtattattcctcgctgtctgattaattttggtttccctacacacgtatgcataattcatcctntaattatgagattaaaaccaagacacgacaccctggatgtagggttgggcacagggatgtattatttttgggttatttaattattttttgttatgagaaggacaattcgacaaagttacagagaaagatagaaattgttattgactattgtattactcctcgctgtctgattaattttggtttccctacacacgtatgcataatgcatccttatccacttctacgcttttggcagttacagtaatttacaggaaaacaaaaaaaaaaacaatacataatggaatcttttgtcattaacactaactttaatatatattaataaattataaattgtaatttaattataaattattatgtagatgaatttgttaatttttataataaattatcttaaaaattatattaataatattttttaatgaattaatagggtaacaaatttacgcggacaatacatgaatttgtctttcaacgactaaaataggatttttaaaagaaaatactcctataagcttcatttatttgtataataagtttagtgtttcaaaatttatacttcctaggaagagaatctgtcccaaccactctgttggttgtaaaaaatgtgaattcgtttgttctacaaattttttaagtattagagtttatttttgaaataaaataactcgaactatgggtcttaatctccttataattgcacttgataattaaaaccttgtttcagcttaaattgaacctcttcatattttttaactcaagcaatgcacacgataattgctaacaacatatgggatgaatatcaatccgaatcaatagatgaagatcgaatgatagacctgttactgatatctgaaattgtatcgttctcaagtgcattaatgcaataaatccaacttagtccgtttcagctcatacatttgcatatataatacactcaaacgaaaaacgacgaccacacaacaacgcttgtactctaatacataggacagggacacaccactttttgacggactcccaagtggtgtaaaagccacattttcagtacttaattaaccgcaagcctgcaatgaaaacaacactaataattttaatattctaatcctctagacacgcctgtggagtgtcagtagtttgggtaagcttgtagggttttattactgcaaaatacttattgattttatcccgaagttgaatgacctatctttggtataatattttttcatcaataaaatccaaacttgacatcttacttaagatatctggattcattttcattcaaactaatgtcaacttttatatatttgaaaacaaaatacatataaaaaaagtgtttgagaaagaaacttgtctaatgagtcataagtataagtttactattttttacttttaaagaaggaactagattgttgttgagtcttcatatataattttgaagtcatgaattaaaaatttataatataagagtcaaaaatatttgacaagactaattaggttgttaaataatcatgtgtgcagttatgcatgcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattacagaataaccatactcatgaatgcctttcttttagactatagataaatataaaattaacaagaaataaataaatgacaaaaaaacaagaggaaaacaaagattaatgattctatattgagtttaaaactacttacacatgacaccatctatgtagtcttcttcacttgttatgagtgtttattactcataacttgttacatacttgtaattttattatcaaagacgtgtatatatgaaaaactatgttataaataaatatatttacaaataaatacttatccatctatcaaagcttttgattttttttatgtgctgttgatgtcaaatggagcaaaacaatgtgataacattttataattggttatcataaatataaaataaaataatgaatgtaataaaaaatatattatataaatagtagtataattcatgatattacatttatatcataaatatatatatatatatatatatatatatatattagaaggtgacgtttaatgttagtaataataaataagatgaaaaactgaaaatatctgaatgcacacagcacagatggcattatccgtgtgctccaaccagttggaggtgattgagtactactggagtatgatgacctatctaacggcttctttctatctctataaatgcttcttcaagcgccacttcatctttcacacacactctcattactcatagtgatggataataatacgatctccaactttatcgagttcaacgagttgatacccaggttaccgagcgaactcggactcgagtgcctcactcgtttgccccactcagcgcaccgagtcgccctccgagtctgcagccagtggcactgcctcctccagagcgatgcgttttactcccacaggaagaaaaccggccacacccgaaaagtcacgtgcctcgttcaggcgcgtgaggagcaactgcttcaggaaaaaaacaagtcggtttacgggataagcgtgttcgacccggagagcatgtcgtgggaccgggtcgacccggttccggattacccgtccgggctgccgctgttctgccagctggcgagctgcgacgggaagcttgtgctgatgggagggtgggacccagcaagttacgagcctctgacggcagtgtttgtttacgattttcgcacgagcgagtggcggcgggggaaggacatgccggagaagcggtctttttatgccatcggggcggggttgggtcaggtttatgtcgcgggtgggcatgatgagaataagaacgcgctgagtacggcgtgggcttatgacccgaggagtgatgaatgggccgggctgaacccgatgggccgagagagggacgagtgcgagggggtggtgattggggatgagttttgggttgtgagtggttattccacggagaggcaagggatgttcgatgggtcggcggaggtgttggatatcgggtcgggtcagtggagggaggtaaacggtgtttgggaagagggtcggtgtcctaggtcatgtgttggggttgggaaagatgggagattggtgaattggagaggttcggatccggggctcagggttggggtatgtggggttgcggttgggtccagggttatgttgagtggatccgattacgaaggtgcaccgcatgggttctatttggtggacatggaggaagggcagaaccgtaaattgagaaagataaatgtgcctgagggtttctctgggtttgtccaatcggggtgttgcgttgaaatatagtgagtgatgtacaagacaagactcgccacttgtgaagatgctactacccttccagaattggaaaagccaaatttgttactagttttgttttcttttgctaaaatggagggggcaaaggcaaagtttgatttgtgcatttgaatttaccatacaaatgtaaatgttactgtatagtatattgttttgctgatccaaggaaggagtgttgaaaattagaacattgagattatccataataataatatttggggccactaagattggaccactatatatagtcttataaatggaccacataataatgaccggttgatgggaatccaatgcgatggtgagtgtaaaagattgcttccctagcgagtatagtattttagagatttgacgaaaatgtgacagttagggatattttttaggttttttaatgatgtgtatgtgtagtggcggttaaaaaatataaaacaaatcaagagtagtcctcgtccttccctcatcctcaccgcctcaatctacccaaaccaaccgcgtcgagatccagcagtagctccaccacgtcgggcctgacgtgcctcgccgccagggcgcggttgatgtctaaggcttgtttaggttcttctccgcgctgaaagacgaggttgtttgcggcctgttcactgacacagtcacgcgaggagcgcatcgcccatgtcctcgttgctccgtcgccgcaggaagcaccccgcgccgctgccggagctcttcattgcaagatggggaagcctcaggcttgagtattaaatacttaatataaagtatcagattaaattaaattgagtattaagccttttgaggacctcaaacttgagctcgttcgtcactttcctgcacaacccttcccgaagtcaatcagtcttctgatgccaatggcatggctaaatttggattgtattccctttgtcctctttgtgcttttttatttttcaccttgtttatttttttttttttgccttttgtttggctcggtttctttctctagaagttcttgagttgagtttaagccatttaactcataatatataggactagataatttcagttacagttgggttgaagacatgactccttgtaattacaaatttactttgttctacgatgaccttgatttacataactaggtggtctaataacgaaatgccttgattctgggcccaagaatcacccttgatttgcctataaaataaaataaaaaaaaaagaatcacccttggcgagctattcacaggatgaaagcagatgaaagtgttactgttcttatccttgtttggaataataaaactcttgttgtagacctgaagaaagacgggttgatggcaagccatacttaggaaactgcttattgttttggaaatacagtgacgaatgtcagatcctctgtaaaaccatcactcacataggccaacacatcgtaatattgaaatacctcaattttatcccttttaaatagaggtaatattgtcctatgccttctaaattcatataatatttatgtaaaataatcaccttaagatagaaagtgtgtttgaatacaaaatcttaataaaattataaatttatttttgtttcgattgtattttagtggattattttcctctcacaatctcaatttttgggtaattttggaatatccatcaactaagagttaaaaggctaatccttcaccatattgagatccatataaacaatatcttttccaatacaagctctttcattctcatattgaattggaaatcaaatacttgatcacatatttaagagacataattatctattaattgtaacgctccgtatgcatccggttcattaacattgatttatggtcgttaagcgcagcaattatcacatacaatcaaaatggaagcaataaataaaatgacatcatcaaacgtcattaacaacatcaactatacatcatatatggtgaattcttataatatacagtatatataaatcataactgtacatattcatcaatgggtacaaaatcatgggcataaaacaaaagtagaaccaatatgctctccaacactatgcctaaggttctcatataaactattcctgctcaggcttcttgccctgggacctatctttgaatatcacctgcaaaacataatccccaacaggggtgagataataatctcaataaactcagggtccttggaaatttttcctccccctgattcactttcatgcatataatattaaaattgacattataaactagccatcacagctctcaagccatattaccacacacacacacacacatatatatatatatatatatgtctcaagggttcatcattatctttttataaaatatatcatcatcatttaatcatcacactcttaacacattacatgtacatggtatatatatatatatatatatatatatatatatatatatatatatatatatatatannnnnnnnnntttagagaatgcttgtgaaatgcatggatatttgataatctaattttatactaaatatatatacaattataataatatatgggtaattaattttaaaatcatcatgacgttttacaggaaatattaattatacaccaaaaaaaggaaatattaattaaaattgaactgtttttttaatcagaagtttgaactattctaaaacaaatatttttaatacatagaaataaattacacgagcacaacacacaaatacatgtatttttaggaggaannnnnnnnnncttgcaaatgaatatagctaatgactaatttgatgataaacttttttacttaagattttatccattaaatatattgaaatgcttctgaaataattatacatttttttatagttttaaatattcagattctacgtgaaataattatacacaaatcatttataattgtaggtattttctttcaatttatcttttaaaattcatttaaatttagagaatgcttgtgaaatgcatggatatttgataatctaattttatactaaatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatatatatatatatatcatctatatgggcacatttatcatcaggacttattcaaacatatatttattcgattcaattatattctactggccagaataaatctcattaatcaacacacatagtctcaatccatgtatatcaagtacatgatttcaatcaaaatagtaacacacaatttcaatatacatgcatcaattcatacaataatcatcactccctttggagtatggtggaacacaaacaagggaaacactcccaagaacaaaaagcttacctgctctcagcgctacaccggctctcccgaattcatggtcacaaccaccagtaatatcaatatcacaccctacacaaagcatacaaacaatcaatcaataacggttctcaaccgttagaatgaaaagaaacactattcatttccattacaacctctatgttctctatcttaggattatcagagctaaccaccttataagcgattcacagaccctcaacaggatctatctggacctaaccaagatcttagagtctccctagactctacataaactagttcaaagcattcagttgcttaaccactctatacctcaagaataaccaagtcattcaaaacaatcaatcgaacgcttaattaccttctatagggtctcctgaacacttttagtaaaagcacatatgctcattcatatcatgatacccgccatttaactaacattcttcctactcatacatatctcagagtcaaaaccaaacttcatcaatagtcatgattcaaagctcaatattcctcagaacaacctcctgagcatatttttctaaagaatccacgactaattccagccctaacacaattgggttactattcatcccaagaaccatttcacaaatcaatcggtaaaacttgagtttcttacctctaaacagtcgaggaaggctggagaatcacttctccaagctttagcgtccttgaatcgctttctttcccttccaaaactcagttttacaaagtcccctagagaacgggatctctccgattgatggttctctcgaagaattgaagctggaacctagctcatgaaggaattctaatcaactttctagttggataggaagtgtttagatgaggtatggaggagatatgaagcttttctaagttgtcaatggtagaaaagcaaaggaagaagaagaggaacatttttcctctcccaaaatgagaaaatagccttttataggccccagtccgcgttcccacgctaatggcgccacaccccatgctaatagcgccaagaattcgaaagaaagagcttcctaaagcattttggtgctaatcgcatcatctctggcgctaatcgtaccagatattcgaatcagggggtctccagggccattctggcactaacagcgccataactggatctaatcgcgccacatgatcgagtcatgatgctaacaatgccgctcctgacgctaatcgcgccaaataaaatattaatatatttttcttcgtcatggttattatattaatcatgccataatttcattttgatataatttttttttactttttttatctctctatttattcaaataatataagaaaaatatatataatttctattttcttttttcttaattttagaaagtagataaattaatgcatcaatcctaaaaatcaaacaaggtagtataaaaaggaagtttttatgaatatatttgtacaacatcatttaagggatgtatttaagtaagattttaaaagtaccctaaaaaaagttttaaaagactttttttgtaaaaaataataatataatattcaattaacattatttaatttttttaagaagtgtgatgaaatccaatgatattcaattaaattgaagtctaagaaatggactattataaataataaactagatttaggccttaaattattattttattaaaataatttatgtttattcaagcaatacgtcttatttaacttaacctatttttgcatctattaatatgtcaaatttaaaatttaaaaattaattttaagtgatactatttaaaagaaataaaaaataaattaatgtaaaaaaaactacctaatttaacttaaaaacacttatattcaagagtagccatgaaccattcaaattcatattataaaatggatataaaaattcatattataaacacgaacaggcatgaattgatttaaataatttttcattttaaaaaataataactcaaatttaaatcaataattcttcatatttacatatcaaactaaatattaaatattttttccatggaaaaataaaaaataaaataaaagttgtgtgtatggaacaaaatttgagcaccaattaaaggaaggtgaatttgatgttaaaggatcatttggtggtctcagtgagagaatagatgttttacaaccaactacaagtttcatgttggatacaatactcatatcggcgattatggtcaagaattattttatcaagtgccatttacattagagatatcgcttgacacttttttttaaagtacaataagaaatagcaattctattttgaaaattttcatcataatgtaaatataaaagactaataccaaattggtaaaaaaaattaggagaagcgaaaaaatgcaagatcatttgtctttttggctagtcaaacatcgactaattcatatatcattgggtttcgattaccaaggaatcaagactttacaaataaagtccaaggattgacattccattgctatcattttatatatacagttacaattatctacgttcccagtgtgcctatgatgtagcaccatgaggactattagctagtgtatattgccttatgagactagagtatggtacatataaacttgaagaggtctgcgcctcaacgcatttcggggagaaccaactagatctaggtttgagtggcatttcacccctaaccacaactcattcactgattcttcaacatcagtcaattcgagcctccacttagtttcacccaagcttcatcctggtcatggatagattacccaggtttgggtccataagcagtaataattgcccctggaagactcattttcgctacaactccgatggtttcccttaaccaagccattgcctatgagtcgtcgattcattcttcaacaagcaagcagttagagtcccgagcctctgccaaaattctgctaaggtccaattctaatacgataggataagatatacaagtaggataagaacaatatataataagaacgtgataaactttaattgtattgaatgtttggtgcatactagataacgaagaagggtgttcacgggtatgagtcactcgagaacccgaatcgatccgaactaatctgaataatttgggttgggtcatttatgtatttgggtcaaaatcgaactgaaccgatcaaaattgtttatgtatgagttgagtcacgggtttagatttatacattcgttggcctattgacccgatccgttaattcgtaataaaaaaataaattttattatatatatattaaaattttaaaactaaaaaaatattttgacaataaaaaaaggtgtgttgggccgaatgaagggtcagtccataatcatctcaactcatctttgctgtgaaggtgtgatacaataaatgtcacaggtttaggtttctttttcttttgcacttctgtgttctctcgcatgtcatctcattctttgcggttatgcaccaactccttctcagttctctcatcttatctcattagatcgatcaagcatcacgttttcctttgcgctttcttttttctttttcgaagctctttaacttctcgtgattattttggtttgtattcattgagatttagatggaaacaaggatgggaagaaaagaaataaccttcattgtcgagtgttgactcgaatttttgttgttgtatttgatttaccattttctttttcttgtttgctttagaattaagctaatctttgataaaatcttataagaggaaaatgtgcctgtttggattaaagattgagagaattagtttcagaatgagtaatagtcaggacctgatttttttttctttcgttggttgatttattctttgagagtttgatttaaatgatgtctttttatttttcttttgttcttttaacattctttgaaagtttgattcgaatgctgtctttttttttcttcttcttttgttcttttaacattaaggttacttaaaaatcagtgttcaacgatgccaaaataatgatattacgttttttgttaatgattgaaatgatgtcatttcatcataaaagcaaaaatattatatttgtataaaatatcaattaagttttgggctaacggggttgtatttaaatttttagagtcgtttgtttaactttcaatactattaatattagatctccaagtgttgaaattgcaagtgttgaaatttcttaatgtattactttcaggtatattgttatttgtttcaccctttttttcatattaatttgtgagaaatagttgtgattcagactattatagtaaatattgttcaagaatcttttgttttaatttatattataagtctattttagaacattatgttcatagtattaaataaatcaattttactactttcatacatttgataatattatgttaattatattgaatattcgaaagaatcatgatataaaatagtagttctaagaaaaatatattaaatgggtaatctgttggccctaaccgaaccgttcatgaacgggttgagttgggttttaattttttttaaaaactgaactaaaccgatcaaatttgattgagttgaatcataattttggtcaaaatcgattcaaaccaatccgccaacaccaacaaaaggacatggttaaattttaaaaatattgtttcattaaaattacctataatttataaattttttttataaactatgattaaaaaaaactgaactataaaaatttaaattttatttatgtagttatttttttacaattatataacggttttaaagtagtcaaatattttactttgaaaatatttgaataataattatttaattttattattttaattgataatttaatttaaatttatgttttaaaattataatatatatatatagagaggaaagagagaacataactcctattctatcttgtcgatcataattttaatcaaaataagaaatatattaaaataaaaataatagaatatgataagcaataagataatactatcatattatatttatgtaacaaaatcgtattataataagatatggtaactatcatatcgtattccctcttattttggccaccaaatagactcgaagggaacgcctaataggagataggtttttgtttatgaggaatcatatgttgggaaacttatccatgtttgatatgcatttttaaataacattcctagaaaagtatgttttccataatgtttttttagtaaatttgtcatgaaaacttttttattggaatgtgaaaatcttatttatttttttagtttaatatttttattacagtcaaaacatgacataattctttgccaaattatataatgtggtgaatcattaaaataaaaaaatatgcataagtatttaatgtcataagtatttaatgtcaaaaatttcaatgatgaatcaaataaattttatttatttccagaaatcatgattcatatatatgaaaaaaatttctcccctacacatgctccctaagagtatttgacaacatataaaattaaagatttaaatatatttttgattcataataaatatttattttttgtgttcacttgttattaattttattttttatatggaattccttataaaataaaaattttattttttattcttgacattattttttagttcatgataaattaatgaattttgtattcatttttaataaattttttaatttataattagtcaaactaaaacaaaattagttaaaatttaaaaactaactatacattaaggtttaagcaaattctaaaggaaggtgaggcttgtttggttttgggtttgggtttgcgaatgaacgagtgagtgcgtgctgtatagaatccgagatttgattagtcagggaaattaaaacagaacagaaaccctccgaaaacgcaaaaccctgttggcgtcgtggccatggatttccaagtcgtcgttctcggcggtggcgtctccaagaagctcatccctctcgtttcgcaggttccgaacgcgaatgcttcaaaccaaacaaatttcgatgctattctattattctaaagcgcttatttctgttcgcaggagcttccgaacgcgttgcttccggtggcgaatcgccccgttctctcctacgttctcgagtacttggagcttagcaacctcaaagatctcattttggtattttcatttcttgcaatattttagatgttattgaagagggtaaatagtgaattagtaatgatttttttaactgtaggtggttgaaggcgaagaagcggctcttcatgttggggcttggatttcgggggcttatgctgatcgcctccacgttgaggtaatcactttttggatattagaaaatttaccaaacatgattcattgcctctatatatgtctcagtagtgaccacaaacataaggatattatgtaggttttataagttatagtaggaaaaaaaaaatagaatgaattcgcctgtgtggataaacttttcaacaagcacttttagagaagaaaataagaaggtaaagtgaattatgtttctcccgtaagttaaaattagcttatgcataaattaaaataaacttttaaagaagcaagatgggagagcttctataaattagcttatgcataagcagattttaactcatgcaaacagggtcttatttttaaatttttttatcggcaaatgttaatattgttagtttgttagtttttttttagcaggagggaccgaacccaccacctttctctccttcccttctttcttaatcatccaaccaaccttatatcttccttaagggtcttatatagtttgtacttaaaagtattgatactatgtccaaaggtgatgatttgtgcttaaattttttccaggtagctgcagttcctgaggatgtggggacagtgggtgctattcgggccatttcacatcacctaactgctaaagacattttggtggaatatcctcccctcccctgcccctgaactctgattaaaataatgttgttctttatggttgtattgattttctgcaggttgtcagtggtgatcttgttaccgatgtgccacttggtgctgttgcagctactcatagacggcatgatgcagttgtcactgctatgctttgctctgctcctgtaagtggacctttggagtcagtatcctctggtgggaaagacaaaaccaagaaacctggccgctatgatttgatagggctggatcccacaaaacagtttttagttcacatagcaactggttagttatctagctttcccttgtatatgtcattttgttgttgtatgtatgctcatgtggaatcttgcaactcttttcaggtgcagaagttgaaaaagatcttcgaatccagaagatcatgctccctgcagttggccaggtactttttctttcttgtctctgaaccttcctagtttgttcctcctgcttataatttctctaatgttatgagtttatcactcttctagtgtgagatataagtgtctattctataccaactttagtattggaggtattttctgtttgttacttgtgtagagatggaaattggttattgtgcttttagagtaagaaaattgttcaatctgtcaatcttaaagaaatagcattttctgtgaaaatatgaattcttcatctgagtaatagaaaattaaatgcaagacttctgcaatttcttatttctctttgtttctctttattgttatttgtccttcatgtagatagaaataagagctgatctaatggacgcccacttgtatgcattcaaaaggtacattcacttactttttaactttctcctttatttgcagtcttggattactcatgttgtatcctgaaacaaacttttcttgcagatcagttctacaagaagttctagatcagaagagtgcatttcatagcttaaagcatgatgtattgccatatctagtccggagccaactggttagttgttaaaggtttttgcagagataggctaggtaatgttgtacttttaaggattctaaccttattcatattttctaaatgagagttagaaatcagaagtattattaaatggtatgccacaaacagaagaaaacggaactgaaaaggttatttctcaaagcaatcaacaaatgctatctcaaatactcgctaatgcatctgaaccaacctttcatctgcgacatgcactgggtccttatgggtctacttttgatcgaagaacccacaaatgttgtgtatatattgctggaagcagcaaatactgtgctcgcttaaattctatacaagcatacagtgacattaaccgtgatgtgagttagttattgttatgatctttatcaggcacttgctattgccttacattttttctttgggtatagttccggttgcttgggcgttattcattttttactgtgacaggtgataggagaggctagtcacttatcagggtattccttctctactcaaaacaacattatccatccttctgcagagcttggggcaaaaacaactgtgagttagttacctaagttgtgtgctctggtacagtttctggagcaatatttttggtcctcccattttaagatttatataaatagttgcaatttgtttttaggttggaccacattgtatactgggggaaggttcacagatgggtgacaaatgcagtgtgaaacggtctgtcattggccgtcattgtcggattggtgccaatgttaaggtggggtgatattattcttacaagttaacaagttactttctggtcttatgatttgtctgtgacacttatgatctccaaccctcgatgattggtcagcaacactgattggcatcttactaatgagttgtattcaataatgttaatgccaagctttttcttgacttgcttttatggatgcaggttgttaattcagtagttatgaatcatgttactatcggagaatcttgttcaatccaaggttctgttatctgcagcaatgtacagctccaagaacgtgctgtactaaaagattgccaagtaatttgtttcacctctctctggcaatttttcatgatcgcaatttgaattggaatgtgatattgcctgtcttggcaggttggagcaggttttgtggtcactgctggtagtgagtgcaagggggaggtcttggcaaagaaatgaaactagaatgtgaaaatcgaggctggggaaatacatagcaaaatgacttctattctgcttgatcattgcttggagcaaattttgtgctttttgctgttagcatttacaatttggtgatcttagcaggaggagcaaagaaattttaatacttccaatttgtatgcatgtcctttgcagtttcttgcaatttgtttgaaaatggctgcaatcggtgttgaatattcatttgtgtaaatgactactaattgcttcctctgcatcactattttctgccatccaaatgcatgttgcaagggactttaggttggtatcttgctgctgtactaaagctgtataatccagcgccatcagttttgtattcgagcaaatgtagtactattgatgcgttttggctttttcagttttgtacttttgtttttgtttgagatatagtgataataatgcttacttgaatttgatgcttgctttgtaagtaattcgtttaagctcacttttttcctccctttttttgcgagagagaggggtggttctcaaagcttggtagcgtcaaccagcagatcatctgatgggattgggatgaggtgtgaatgttacagaattactaaatggtctctagagaattgcgagtgtctttgatgccatttacacatttttgttggtaaaagttgccatatgcattttggttttgcctatgtatatcttttgttcaagagtaccttataatacctgttttagattgctttcactacaaactggcgtttagcaaaagggacaaaatgtgttgatagattatgaaaaataaattataatcaattccatgaaatagtttttatgtttgaaaatatttggtaaaaagggatatttaaataaaagacatttcctatagtaaaattatattaaaaagatatttttttaaaaacatccaattgtctagataaaaaaaaaaacttaataacttataataataagttttaattatgagtaattctttttataaaaaaaattgaagattacaatctgaatatcttctaaaatgttaatcacataaatagtagttacgtacttgaaccgttttttccgtgcaaaaggcatttattcccttgaaaagaaatcagcattgccaaatacacttatttttttactttaattgtgcacggagtctttattttataggtttcgtgaacgtaagggttaattaacaattcttttaaaaatatattacactagtttagaatgtgagaatttcttacacaagacacgttcatctttacttggttacatcataaatagacattagtagccaatgtttattcaggaaaaacagttaaattaatttatgaaatctatatcattgatcattattctttgaatgataaaagaaatgcttaaagtccttgaatatttttttttttggtcaaaattaatccctacgtctataatttgtagattggggtataaaaatttagaaaagaaaagtcttttctatgattgggattgacaattaaaatcactaccaattcaaattgagggaccgtgcgccgatacgaaacccgcatatgaaaaaggaagagtacgaaaatccaacatctttccgtagctgtgtttgactccctaccttgggctgtgttttttctatgctggactatcagatttgctctcttactttgtactctttgttggcattcttggttgtggttatctttggcattgttttggcaattctatgattcttttcaatgctggcatatcattggggaaagacaataggtcctaccatgtgatgcagcattgtgcatttaatctcgaaactaagggtgtgccttaatttccatttaaaaaaaaaaaaaactgtttttagctttcaaaatgcaactaaacaaagttgctcacataattgatggaggatagtgcaagcacactgcaaactgctaagtgtggatttgacagaagttgctttcaaaattggagggtagtgcaagcacacagcaaagtgtggaatcgagagagaagttaaagaaaatgaaaattgacgaagacaggaaaacatttctcagctatttctatttttttgggttttaaaacaattgttttgaaaacaaatttcaaaacttaataattttaaataagaaaacggttattgagtaatgagcagtgcaaagttgttttagaagagaatcaaatattgtgtataaaaaaaaagaagagaatcaaatatgtccatgcccttaagtttctagttttcctgaatgcatttaatataaatttaattactattttatttctctaatttattttttagatttaatttgttcatcttattatttaaagatttaattaagtctttaatttttaaaaatgatttgatttagttcctttacttttaaaatattcaattagatcctttattttttaaaattaattcagtttggtcttattttctcttttatttgctaagaaagttttgaaaaacacaattgaatttggtttatattgggaccaaattgaaccaatcttaaaaaataagagacctgaaatttttaaaaataaaaagatctaattaaattatttttaaaattataggacctaattgaatcttttaataacaagagaactaaattaaacttaaaaattaaattaaaggatcaaaattataatgaaacgtttaatatactaaaaaaaaaaattcaacacatttacctaaatactggccaaatcgtccctcgatattgttagtagatagtcaaaatatccaaatcaatcctctctctagttttaaaaattatactattgttaattactttagttttttttaatttttaaaatctttttaattcttaacttcaaaaaatatatattcattttagaatgaataatatatgtattgatagtgtaaaggattttactttatcattcaattacaaataatcataatataaatttgttaatttttataaaaatcataccaatctgattaattaataattaataatgcaaacttctttacacagattgtacataaaaattaaactctgcattttattcctttttactttatattccattattttacattaaaagaagaccaaaatcaatgacaataaacaatgttacgactttataaagtgaaggatttcccactaataatatcaaatgttcaccatttgattgcaaagacctcacccggtataaattgtattctagacatagggaatggactgaattaataatgttactaaagtctgctctgaattgatagctcacgcttcatttgatctctcaaaactctccttagtaatttgttggaagctgttcggggaaagtcgggcacaattttaacaaggctcacctgtaaagtaacaaaatgagttgtgaacatcaaatcagtaacttcatcataagtcaggttaaaatttgcataaaatttcaatttcctttcaaactaagactttcatgaatctttaaataattaagttattgcttttcgtgatgtattcaattcaaaaccgtagttgcttaatttctacaggagaaacactgattgcagctgtctccaaaatgccttcgtcggccccatcacagacacgctcaatttctacagaacttgtctgcataacagaacagaaaattccaagtaagaataacggtcagaccacggatatcaagataggaatttatgaatttctgatgaatccatgatcagttacaagtacggaagtaccttccattcttattaatttattcaggacattgacatggaaatatttaggattcttacaccatgttttatctagcagaatagctttcagaagcttcatctccaatcagagtagaactgggagaaggagctataataaacataaatatagcggatgatacctttattccgccaagattcattgtgtcctcagcccgcccttgtacaatgaaatggcctccagcagttcttttgattatatctccatgtctcctaagaacctgcttatatcatgttagacaggataaattatggataaataaaccagttgaaaaagtagatgacaataacaatagaacgagagtagttaatatttcagcaacaaccaaaaaaaagagtagttaacattacaaatttacaaggcaatctaataataagttatgtaatttacaagggactatctgaaaatccttgatggaagatctgactaatccacacttctaagaaacatttagatattgatcactgacataggcaatagcattatttgacaaacatccaaagttgagagttaaacagtaatcctatcctctctaatttctttctttatttaactgaatgtgaaaatcatacctttcctttgtaaatgggcattcccttaaagaaaacctcctcattatccgcattaagcaatctatcagtcgctcccatatatattggaaacaagcccacttcaccaacacaagcaacatcctctggctgtcgcattggtcaaagagatcaaacaaattagatagcttaaaaaataagttgtctataccacaaaaattgctattatatatcacaatgaacatttattgaagatagtttggtcatctactagaggaaatgcaacccacttgggaagagtaaaaaatcataagagaattgaagagtgtaagttataggagaaaattggtggccaaagggttagtataagaattacaccattcagaaacaaatagtgaaggagaatccatatggacattctaactgatgaccattagaagtcagtcttgactcttgagattttgagactagcatttccaattagccattattggttctgagtccggattatgtaatacacttgacatccattatccattgcagcaacaaaattatatgtgggtattggcatgatggaaagcagtgtcaattcggtggcaacatatatagtatcacatgatcaaataatagaaactatcaagaaaacattcttacataaggaactccattttcgtcaaggatgaccaaaccagttgccattgatgccgtgctaaatgctccaaaagcttgaggctgcagtggacttcccatgatgtaagaagatgcaagctcagtgcctccacaacattcaatgattggtttgtaataagattttgaagaaagacagaggtcatcatcaacatttgaagtttctcctgttgaacaaaatgttctgtgcatataaccacagtttagtgcagtttttcacattagttacctgattattcaaacttaaaagaaattactttatttttgtccaatccaagcctccatgcattgtgtacccttccaagtttttactaagctcggaactgttcccaaaatagtaacaccagcatcctgaacaattgtagttgaatgatgttgctttgtgcaatgtatcaaattctattgatgcagaatacaatataatctacaacaaataatgacgctttttttaatttttatcttgtttcatttatgttggacttttgcccccttccagaccttatttaacctctttgtagctaagtcaagttctagcaatgagtgtctagctttctaaaagttttttacccctttcctttacatttttaagaataaaactcattcagattgcatgtataattcatccaggcctatagtgcaagggttaaaattcaactagaagcaccttgtccttgagggtctgcatagggacacctcattttcttttttaccataaaataattgcaaaagttgatgtaaatgcttctatgaacatagctcaatgagacaatatattttttctgtcatcacaaacttcatcttattaatgctattttatgtgacaaagcattttcgaaagaatgagaaaagttttttgaccttgttatgacatcagtgtggcacacagttgcaaattattttcgcaaaagatatgaaagttcttgggttatctcactatagataacactaccttacaaccattaccttctacatcccactgtatcatattacttcattgcttccatgattttgcagaaaaaacaactagtctagttcccactcagttctgctactagtcagcacttactttgtttgatttccaaattcttaggttattaaaataataatgaccattttgtagaataagacatgttatgttaattataaatactataaggactgaaatataagagttggacaaatacctgaacgaactttccaaaaccatggcctagaggagatccatgatacaaagcaagagttgcacccgatagagagcatgaatatataagagttgggcccatcacccatcctaaatttttaggccagcaatagacatctccaggttgaatatcaatgaaagcccatgcatctgcagcacttcgtatcggtgaaagttgagtccaaggaattgcttttggctcccctgaaaagtaaaaacgtaaccagaaaatcattacaatgttagtttctgcttgatgtgtttaagggagaatgtttacctgtcgttccagatgagaaaagtatgttagtgacagaatcaattgattgatagattggagagtagtgatgtgacctgtcacgattaaaatgttatggtgagacaatactcaagagaaacaaagcaacttctctgtctcttttttctgtttttggggtcttttgcaaagactattttagttcacataattacaatttattaggatgaatatatatggcttaatagacacattttgaagtacattacctgggatgctgtctgctagaagaaagataaaccttccatgatatatcgcattctcttaattgcacacctagatcatcacctatcacaggcagagcgataactttacatgcagctgcttcaatgactcgactacaaggagaaataagcagaatgaggtcagtggtcaagaaattttgcatggtaaaatattctgaaagtggcattcaagtaagcattagttaggaaattaggatctagatacaaagtttggccaatgagaggcagtaatgcattcgttctaagataagttctttgtaacatcagttgagagttgaccaaacaggtctggatactcattcccggtcagattgccagttcaatctggtcttgacaactaagcttgttagaatcctgagttagaatgtaaataggaaatacacaaaaaataccaagagtggctgagagtaggatatcatttttataagtgaaaaatataatttgtcactaaaataattcctttgtgatcccattaaatatctattaactaaagtcacgcctcgtgcctataacaaacgccataaaacaaagtgaggcagaaatgagaaaaagaaaacagggttctatagaaagcaggttccaaaaatacaatgtgtttgatgattttctgttccataatagattatgagttttcccaaaatagcccaaccacgtatatctatgctcaaacgcaaagacttctcaccagcatgtggaacatagcatcgaatttgaacccaagcagcaataagacaaacataatattgaaacatttatcaaaggatactttaacagatgatcattaaataacaatagcaaatattaagttggcaattgtgccaaaagttaaggataatgacaaataaacttataaagcttaagatgccaattatgatcttttgaacagataaactagacagtatgattttcatattgcaacaaatataaatataatgttaaatttttttacctgtacaaagggaatttcctgccacctcttgatatgaaatcccaaaacaaatttaagctgagtaaaatacaacaattctaatttgatactttggaagttcatcatgtaagtgcttatatcaaagacctaaatgtgagggcagcaaagatcaaactctttaccactggatcaggagacttttataccatgccaaggaccaactctcctaaaagcttaggctctatgtttttatatctaaagaaaattcaaagggaacatctacatcttattttgcaagaaacgttttttctctctccctccttaaagaggagtactatatgtatgatacttactagaatttggacttgagcctaactcaacccccaaaagctaactcatattttaatcatattactagtcaatgtggaatattcaacacactccctttatgctgaaggctaaacatctcgaatgtgatgtttgcaagattggataggagaatttggagttggagcttaacatcattaagatttcagtcacttgatttcctaatttatttttgcttaactctacctaaaaggctaaaactcttggcaccatgaaatctattttcaccagtactgttttgagcactaaaactgctatcacacatgacatacaataagctttcaatgcagctacttttctacctaattagtacttattaaaaacctgatctttctcaagcttatgaagtcttaattgcattattgcaatgcacatcattcacaaagactaatcagccagaacaagatccaacttttgttaatactgaggatcaaagctatatgatgttgtcagtaccctcatcaaacaggtataagcctaagttaactaaaataaggtccaaggaatcagtattttaacaaattctccaaagtcagatatctttgcacggactattggttgaatctcatcaaacgggaaacacaagttagacatttagactcgaatgaagattaaaaaattttaagccactaacaatttggtaattttgttattccttcacacacactgagtagcattacgcacaaattggtaacggagaaagaacaaagtcaaagacaacatcaaagattgaatagactcactttgatcaacaacagctttacttttaaagtcatacgcataataccaaatttaaaagataacctgagtgaaaataccctttgctttagaaacatgcagacgagttgcaatttcttttggtgcaaagctatcagctattgatacgacaacacatcctgctagaacaatggctaaatatataatcacagcattgactgtcaattgcatgtaaatagcgattgcatctcctttcgagaatgtggcatctattgcatttgctaccaacctgaaacgatataatttcacacaggaagcaaataaagagattatagatagaaattacttctagagtaaaacataacgcagaaagatcaaaaaccaaaaagtgagatacaagcacgaaaagaattgaaacaaaagtaaaatagcagaatgatacacaaattaatcccgattaatttgaaaaaacacacatcaaattattgaattaaccgacttagcacaagttactagtatgatgatgagtaacataacttaggtggaaaagttgaatggcttacatcaattagtgccggagttgtttaagcgtgatatgattaacctcggaatcatcaaaaccttcatctctccaaacaatggctaaagtgtcatctgttttgtgggggtgtgaactgggttgcaaacagcaattggcaatgttgaggacagaaccggggagccaagtcccaccatgtttagaagggtcgaaagtatccaaaatgcacttgggaggttcaacaaaggaaactgaaagttccttgagaataagggaccagtaaagctgcacaaacaaatgatacccgttgaaaacacaatactagaataaaaaaagggaattataggtgggagggtagtaggcttgcctgagggtgttgaacagaaaacttgtgaaatagaggataactagtaatagggtctttgtaggaaggtcctaaaaggtcaggggtatgagtttccatgagacggcccaggttggtgtgtttggattgctctctgaaatcaaaaagcaaaaaatgaaagatgaattagagtttgtgttgaggtagtggtaagtcataaggcatagtaagagagatatacagagaagggaagcaatagagtgggagggaagaatgttgagagtggtaaacagactagtagagaagctgatgcaaggagtgagggtaagatggtttgagcagtctccgagtgacaatttggcgccatatgtgtgaaggagactgaaactcagagaggatatccctcaaactcaaagcatgatataattcattgccttctgacactgttaagcctcctgcattcaccaaatcctccactcccaaatcccgcacgctcttccccatctctcgcgatctctgatctttccaacttgcagaagggttgttgagtacttgagtttgaggtcacccaagttgaacatgcagtgccttcacatcacctaacacttccaggtaggtaggtgactatgtgctgccaacgaaagaaggagaaattattactatatgatttagattttagatatgttctttagtagtactaatattaaaaataaatggggtggtccacagtccacactatctataacaatcttcaagcttcaaccaccttcacagggctctgtcaaggaaaagtttcttcgcggtgaacgggtgaagtgatgtgcctgagaccctgagttgaaaattgaagttgagcacctagtccttttattacacctaccacagttcttacttctcgatatagttatattaggcttttaaataaattgataattattggttatgttattctgttattagaattaaaatccattaatttaaaatctaactttgataattataattattttagcctcccaattatataattgacgttgaatgaagtgagatccagatttaagtattagagttggaataattgtccttgttgtgaggaagcgaggaagaggaagaagaagaagattggggcatggttgtgcgaagggttttggagtgggaagtggtgagaatcctggagagatgcagcagcctgaatcaggcgaaagaagtccacgcccaaatctacataaagaacctccagcaatcttcctacgtactcaccaagctcctccgcctcgtcaccgcgctcccccacgttcccctccactcctaccctcgccttctcttctcacagctccactccccaaaccccttcgcctggaccgctctcattcgcgcctacgctctccgtggacccctctctcaagccctgaccttctactcctccatgcggaaacgacgcgtcagtcccatctcttttaccttctccgctctcttttccgcttgcgccgccgttcgccaccccgcgttgggggcgcagcttcacgctcagacactcttgcttggtggcttcgcctctgatttgtacgtcaacaatgccgttatcgacatgtacgtcaaatgcgggtctttgcattgtgcgcgcaaggtgttcgatgaaatgcctgaacgggatgtcgtttcttggaccgggctgattgttgcttacgcgaggagcggtgatatgagggccgcacgggacttatttgacgggttgccggttaaggatatggtggcttggactgccatggttaccggttatgcgcagaacgccatgccgatggatgcattggaggttttccggcggttgcgagatgagggtgtggagattgatgaggttaccttggttggtgtcatatctgcttgtgctcaattgggtgcgtctaagtatgctaactggataagggacattgctgagagttctggatttagggtaagaaataatgtccttgtggggtcggctttgatagacatgtactcaaaatgtggtaatgtggaggaggcatatgatgtctttaaaggaatgagggaaaaaaatgtgttttcttacagttccatgattgtggggtttgctatacatggccgagctcgtgcggctattaagttgttttatgacatgttggagaccggggtaaaaccaaaccatgttacttttgtaggggtgcttacggcatgtagtcatgcaggcttggttgaccaagggcagcacctctttgcctccatggaaaagtgttacggtgttgttccaactgcacagctttatgcttgcatgacggatcttcttagccgcgctggatacttggaaaaggcacttcagcttgttgagacaatgcctatggagtccgatggagctgtgtggggagcacttctcggagcatcacacgtccatgggaacactgacgttgctgaaattgcttctaagcgtttatttgagcttgaacctgataacatagggaattatttgttgctttctaacacttatgcatcagctggaagatgggatgatgtgtctaaggtcaggaaattgctgagagagaaaaatttgaaaaaaaatccagggtggagctgggttgaagcaaaaaatggtatgattcacaagttcgttgctggtgatgtgactcatccaaaaattaatgagataaagaaggagttaaatgatcttttggaacggctgaaaggtattggataccagccaaacctaagttcggtgccatacggtattaatgatagagagaagaggcttttactaatggctcatagtgaaaaactagctttggcatttggattgctgagtaccgatgttggttccactataaagattatgaagaaccttaggatatgtgaggattgtcatattgtaatgtgtggagcgtcaaaagttacaggaagaaaaattgttgtgagggataacacgagattccaccactttcttaatggtgcttgttcttgcagtaatttttggtgaccgaggctatatagccatatgcgggtgaaaagttgacatattgatgttgaaagaaaaaaattgaagtgagagggacctttttccatttgtgataaattagaggcttgtaaagaactgttttgttgaaattttagatcaactgcatacttgttcatcttacagggttgttcaatttattattgaagagtgttaaaaatggatagggaagacaagtgatgccagctagtagacaaatttgtgtcctcggcaaagcaaatgtttgtatagatacatgatcaatgttgttgtgtagtaacattaagagttgttacatagagtgagaaacaaggattgtaattggggaatgagagaaaccgtactgcattgattatggtgccatcctgaaacttttagattggtaatgacaaataaagcaatgcttagtaatagaaagcaaggagtaaagagatactgaagaaacaagctaaaataagttaaatttgatcttattattaaaagattcaattagaatttttaatttttaaaaatatttaattatgtcattttatttttaaaagtttcaattaggttttatttaaaatcaaatttgatttgatttttaattttttctgaagcagatgaaaaaaaggatcaaattgaatttattttaaaaaataaaggacaaacaaaacttttaaaaataaaagaagctaattgaattatttttaaaaattagaggaaattgaactttaaaaaaaaatataaaaaaaaggagaatgttccaaccagagataagtcaaccaccagtaatgagacaactaatatatgtcatatttatgtgatgaccaattattgttcaagaccgaaacatggcttcatggaggctccacttcaaatgctcgttacagttcattagtgattcggattttatcacgaaatatattgtgcttgaagaaaatacataattaaggataatgcttttttagaattgtaaacacgaatacagattttgagacaaaacaaaatttaaaacctcgtggcaggctctgagatagtgtcatatgtcacattctacgactatgaaatataagtggtgtgatttcaaggtggaaaaaacgtacagttatcttctttttatttttctataaaataagcccacatgcactgcgcgggtgccttgtacaaaaatctataggattattaaatgatcaactgcgagagcacattaaaatttatatgcctgaaaacaacattttatgtaagtggtcatcacgaattaaactttgtttcaatttggttgaccaatccaaagaactaaggcatgaggtgaggacaaccactacagctacaagccaaatacaaaccccacattagtttaggcattagccaagacttccaagattttagataaaaaggatacaagaaacaaaatacgagctctccactactctaagccacaaaattaaatttaacctatgatattttcctaagcctctcacatgaacctatatatatatatatgtatatatatatatatgtttatgttatctctaacttgattgctctcatacagtatggagtatcaaaaccaaagggccaaggagggtagattctgtgagaaactcgagatcaagaataagccgaagtttgtaggagtgagacaaagggcttcagggaaatgggcagcagagatcaaagacacatcaaagaagattaggctttggcttggaacttatcaaactgctgaggaagctgctcgagcttatgatgaagctgcatgcctccttcgaggttcaaacactcgcaccaatttttctactcaagggtgtggcattgctacaaattctccgatatctctcaaactcagaaacctgcttgatcgtaaagccatgtcaaatcaaagtcaaagtcaaattcaaagccaatcctctatgataagttccactttccaaggtgctgctacttcagctagtccaaatgttagtgccatcaataagatcatggttatggaaaactactctgcttgtagtagtgaaggtaagtctttgtttttggttcagaaccaccaagtctgtgataacccgtatggactagatatgaatatgatcaactgttcaatgggtatcacaccaaatacatcgcagtttgattattcttggccattagcccaacaaaggattaacgaattgccaatatcaaaagatgattttggtttaaatgtagaaaggcaattgtcaggatatgccaccaatgagtgccatgaggaggatgcgtatgaatatgatgtcaattatcctctctcccactttttctgcttcacttgatatctatcttaatcttcctatctcttcttaaaacatagtttctataatattgccttgtttccatgtcattttccctgagaggataaatcaagagtcaagaccattgaatttctaaacccacctctgcttcaacaagtgcttataggaatcagtaacaagatttttggtaccatggtactttgcccagagtgaaacaatcctttttaactcctcaaagttaacccattggatattttgcaagctcgtgatcacttacagtcacaccccatctcagtataataaggaagactaatgtgccaagtcaaatgtgtacgcactatatatcagtcttcattcttctacaaatgtactcagtgcttacgatatattcaatcccactccttatggttggataattagatgaaaacggatattaagatgtattttacttttttgtgttacatatcacctttaaaataatttctgcacacacatgtaagtgcatctcctagctaggttcacttatgggtccatattattttgtgatcaagtcatgtataatacaagtatttttgtttaagacttttgtaaaagctacctcaaccctgtcctataatattagactggtcctagtgggttatgtataatacaagtattaaaatactgtaaaagaaaataatgtttaaatatgaatgtccttaaaataaacaaatgactacgataaaataaataaatgctttgtttaacccgagggattgactagggtttgtggagttaacctcctgtctctactaagtcaaatccaaccacttatgttgtgatcaacacccacgtcgttgatgaggtgtctggaatagatcgtaagaagtttgaaaatgagtctttggtggagttaaacacgtccccacttccctcggggataggacccacgacttgctaactgctaagcatgattgagaatggtcccaccgcttaaaatttttggaataattgatcatgccacaataattatgttgaagaatcaaataaccgttccaaatagttattgacttaaagaatagagagacattggtcaaagtgtcacaaataaaaaaaaaatgtcaaaatgtcatactccagaaacaaattgtcaaactgtcatgccacgtaattcgttagccacatcagcgaattacgtgggctgacgtggcgtcgcgtgagtgaaggacataattcgctggaaggggtgccaaattaggtatgccacgtggcaaatttttcgtaattgtgtagaagcttcggaaggtcataacttttgactgggacgtccgattcacgcgaaattggtggtcacgcgctcgaaattgagaggagaaggcttaagcaagtcccctcaagggacttgcccaaaattttttcccaaaagaggcctctaagtgtctcaaaattgcgatttagtatttggacaccaaaaaaattcatttttgtctgattttttaattatttaattatttaatttaatgttattttttatttttttcaattacttctctgaatttcgagctttttgacatatcatacgctttcatcggacatttctatcaaaaaatatcactgttcaaaggttatatgaagtttatatgcactatcaattaaacagtgatatttttggctaggaatgtccgatgaaggtgtatgatatgtcaaaatgctcaaaattcagagaagtaattgaaaaaataaaaaataacattaaattaaataattaaaaaaagcagacaaaaatgaattttttggatgtccaaatacaaaatcgcaattttgagacacttagaggcctcttttgggaaaactttttggataagtccccaaaggggacttacttaggccttctcctctcaatttcgagcgcgtggccaccaatttcgcgtgaatcggacgtcccagtcaaaagttatgaccttccaaaacttctacgcaattacgaaaaatttgctacgtggcatacctaatttggcaccccttccagcgaattatgccctccactcacacgacgtcatgtcagcccacgtaattcgctgatgtggccaacgaattacgtgacgtggcaacttgacaaattgtttctgaaatgtggcattttgacaatttttttttgatttgtgacactttggccaatgtctcaagaatagatatgcagtaattctctcttgaatttttaagctgtagaatggggctttgtgtgcgcctgagcttgaccggttatattacattaacactaatgataccaactgaaccgttttttttttttttctaacaccaactggaacttttttaagtctgctaccgacaacttcatcctattagccccattcgcatattattttgaaaggcgtgtgtttgagtgactttacaaatttgattttggatgatcttgatttgttttaattaaattaatcttaattaaaattgaattttgaaaaaaggaatttatatttagaattatctcaaccaaacttgtaatataggtacaaattttcaatcgaagtaacgcctgccaaagtcacatggttttgtgaatttacagtattgaaaaacaactgagggatgcttaaacaaaccacactaaccgaattattattgagcagagcttcccaacagtgtttactacaagttttactaagctcagatatcttattaccatttattttccaactcatgtagagtttattttccaattcatttttccatatttaggccaaaccaaacgcagcttcgtacttcccaattcaggcgtttcaagtttcattctgaaggttctgattccctcaattccatactcggaaattgttatctggaacatccgtattcatacttcctaatttttagtaatgtcttttttccagatagccttgcttgcaacagtttttacgcgccttgacttcacccaacactgataataataaacttaaacaagcgtacaaaaatcacaaattaatcacatcgattcccagaatgaagcgaattgcaaaaaacatacaaggggtacgtttttcacggttcaaaaagagatcatcaaaacggaaatctggtaaaatttgcgacataaacataagaaatcaacttttgacatggacaattctgaatacatgactgaggatcgcaaacaacaggtcctaaaccaccaaatagaagcataatgttgatcacttcacagtttgaataatggagaactatatcacacaggagtaaaaacaaaaaagaacgaacaataatggttcagggtaatgtaacgaagcatataccctttttactcggaaactgataacaaaaaaaagccttcaattatcaatagtcctctccttcctcatcatcttccgctccttcagctccaacctcctcatagtccttctcaagagcagcaagatcctcacgagcctcagagaactccccttcttccataccctcaccgacataccagtgaacaaaagccctcttggcatacatcagatcaaacttgtggtcaatgcgagagaacacctcagcaaccgcggtgttgttgctgatcatgcatacagcacgctgaaccttagcaaggtcaccaccaggaacaacagaaggtggctggtagttgataccacacttgaatccagttggacacctatcacaatcaacaacaacaaattcacaatgttagatcaaaaattgaaaaattgattttataattagaattgatccttaagtgaaatgaatcatgttgaagtgttcttattctaaaatgtaagttaatggcaaatctcattataaactttctgatccaatgcaaacactacctaaggtttgcttcaacctaaaagttaaaatcaattctacacccagaatcaattcatcaatgagagaccaaacaagtgaacatttccctaaaatcatgttaactcgcatttcaatatgatattagatctctcaatgtgagaaaccaaacatgaacttgtatgtttggctccaggttccaggttccagatcacagatggggtttgttcatgttcactgataatccgacagttatagcctccacaactcaaaccagtttacaaacacaaatctagtgatgaatattagtaaatgtgagtaaacatgacaatggacaagagaatgagagaaaattataccaatcaacaaactgaacagtcctcttagtcttgatggtggcaacagcagcattgacatccttagggacaacatcaccacggtacatcaagcagcaagccatgtacttgccgtgccttggatcacacttggccatcatgctagcgggctcgaacacggcattggtgatctccggcaccgacaactgctcgtggtaggccttggcggcagagataaccggagcataggacgaaagcatgaagtggatcctcgggtagggcacaaggttggtctggaactcagtgatgtccacattgatggcaccatcgaacctcaaggaagtggtgagggacgaaatgatctgggaaatgagcctgttgaggttggtgtaggttggtctctcgatgtcgagggatctcctgcagatgtcgtagatggcttcgttgtccaagaggaccgccacgtcggtgtgttccaggagggagtgggtggagaggacgctgttgtagggttcaacgactgcggttgaaacctgtggggaagggtaaatggtgaaccctaatttggattttttgccataatcgacggagagacgctcgagtaagagagatccgagaccggaaccggtgccaccgccgacggcgttgaagacgaggaagccttgtaggccggtgcagttgtcggcgagcttgcggacgcgatccaagcacagatctacgatctctttgccaactgaaaatggggaaaataaaaaataggtcagacaaagtgaaaattaggtcagataaattgaaatagagtgagggagggaaggaggaacgaaccggtgtagtggccgcgggcgaagttgttggcggcgtcttccttgccggagatgagttgttcggggtggaagagttggcggtaggtgccgcagcggacttcgtcgatgacggtgggttcgaggtcaacgaagacggcacgggggacgtgcttgccggatccggtttcgctgaagaaggtgttgaaggcgtcgtgggctacaccgaaggaggagtcagaaggcatcatgccatcgggctggatgccatgttcgaggcagtagagttcccagcaggagtttccgacctggatcccggcctgacctatgtgaatgctgatgatttctctcatctttcttcaaaggctgagattcgattgagatttgcaaagcgtctctctctatctttacagctacttactacactcactcttaagtcttattgtcttaacatcctcctcagggttcaaaggggaatttcataaatctttacaatccgccccgtttggccccagcctatccgaccccactccatccattccgcatctcacaaatacatccacaattacttttttttttttctatccttttaaaatagttttactaaagtaaaaacttaatattaatttactcctcacattattttaaatgatttaatttgattttcaaaattttaaagaatttaatttcattctcaagtttttaaaaataaattaatttgatttcaaaaatttttaaaatttcaatttattcctcaagttttaaatttttttaagaatgtgagaaaaaattgaattattttaaaataattttggaccaagttaatttattttaaaatttttaagattaaattaaatcttttaaaaattcagaaatcaaaattattcatttttaaaattttgaaaatcaaattaaaccgtttaaaattatttaaaaaccaaaattattttctagtattctcttcttttttctttttttttacaaagagaaaagttttactcactttctctcaaatccgtaactatctttttagtcattttcacccaataaatccaaactaatctaattttattttcttttaaaattttatatacaattgttaatctcttactaatctaaaatttaataaaatctcccacgtttaccaaattcacaaaatatcttagtatgaacaatttccaaatttctaaactctaattattcgtgctgtaaaaaaaaaaactctattttttagaacaatttattatgtttcaatcaccacgaactaagctcaacatgaatcatgggacttcaatagtactaatggttggcggtctagtaaaaagagacatgaaatagcatatgagaatctcaagctccaccgtttttctactaattcaagttggataatattaagcttgatgaagaacaaccaactaaaaaaacaaagagcaaggttcaccccaagggatcataaaattctcatccaaacatggttacatgttttcaatgatgcagttgtaggggtgaagagaattaaagggatgttcttttgcggtaagaattaaagagaaatacaataagtatcaggcctatttgcaagtgatggcagcagttacacgactaaaatatcaatgataaaggttgaatagcatagttaatttttttgcaaagtgataccaacaagcttgcgaaagaaagaaaaatggtagctctaagatgacatcaggagatatgcatataagatttattctcatgatgtagatcaacgattcaagtagaagttatgattgattattattgaaaaaagagacctaaacgatcagatacattatttatagagctagttagagaagaaagtttttatcttctaaagtatactcgtctcttctaatattggacatcccatcaagtaatgaatgacgaaattaacaaatgtcaaagatgaacaaatcaagttgaagcaattagagttaaaaacgaggggagattttgggttagagatcatcttcaaggatccatcctagatgatagaaagaaaataatgagattgtaaaatattgtgttacttaattatagaaaaacatagaattacgtaatgtagtgatgttagtcaaactattttttataacaattttattataatataattaaaataattacaacataataaaaaaaatgttgctgatgtaggaatgtaaagtcacttgtggaactcagtaaaaaatataaaattgtcgagttggagagaagagttggatagattatataaaataaaaataaatgatacatgtgataataagatcatttagatgtgtttaaaaaatggtattgaataaaataattagataaattgattaagtagaatgtataagttattaccgataaaaaaaaaaatgggattcttaagatttaagataggatgtagacacttctatctactaggattacataagttgcaaaaaaaaagtagttatgtaattttaaaaaattaaactatcaaatatttagattttttatatataaaaattaattctaaaggaaaaatagaatttaaatgttatatttcaaaactagaataacaatgaattattttaaaaacattatttaatttgatgaataaaataaatattttaaatatattcttatatatattactgtcatcctcaccaagtcattttattaacacgagtgttctgtataagaaaaatctaataactttatggaatagtggtagaaagattattacattccgtcttagactttaagctattcattttaactatgataatagttcaaaatattgattaatagagaatcaaaatagattatctggcaaaatgctatgatctttacatcttgaagactttcaaatatgaaaatacttgacattccgtatgagaaaaaatgtattttaataaacgaaatattacgaaattgtccttatgtcgcgaagttggattggtggagcagggcggccatgtgctgccagccactgcccattactgatgcttacaattattagcagacaacgaaacaaaataacagcacagcacagtggttctacttgcttcgttttcagtttcctccatcaccaatttaccattcactcctccttcctgcatctaaaaaatatctttatttcttcaattccaacaccaaccttactaataaaacaaaacgcatcaaccatttcaagcctaatggtcaaagagtatatttttaggccatttatgttgcagtttttgttttaaaataatactattttttaaaaatatttgcttttaaaagttttttaatactatttgtttcacaagcgtgattaaaatttatttatcaacatagtgtgacataataattctattctttaagtatgtagttatgagttatatcccaagttcgtaatatgaaaaaaattatttgttcaaagatatcaattttgtacatatataagaatatatttaaaatatataagaatatatttagttaacattttatcaactatgaaagtacttattggttattgatgtaggatatcttggattcataaaaaaaatatagttaacattttataagaggattaaataaaaaaagtnnnnnnnnnntgatccaaccaagagaattactgtcttggaagctctccaacacccgtatatggctggcctatatgatccaaggtgcaaccatcctgctcaggttcccatcagtcttgacatagatgaacattggggagaaccgatgattagggaaatgatgtggaatgagatgctacattatcaccctgaagctgcttctaccaatgcatagattattaattcttccaaggctttctagtcccgttgcttgtctcaagggatagttctgatttgccctagataaactgtaatcttaaaaggatttaactaccgaattttgtactttgcatgagattactttagaacctttttaatttgacgtctccacnnnnnnnnnnttcaaataaaaagtaaaattataaaaacatctacaacgtataaataagaataacgtaaagcgatttatcatagatttgtgaatctatatgattaaaataatattctaaaatcccttgatccatatagctttagtttttttgctacacctattgctttagtttgttaaaaaaattaaattaatgttagaaaattataataagtaattaaaatatattcagtctatcataaataggtagaatagcatataatattaatggaaaacttgctagattaaccgtttttaaagattttagataacttctacttatttctataatttgtatttacgtcctttaaataaacataggttaaagaagcgtttggctattatcaaagaacatgatttgttagtatggatgttaagattttgggaatccccaccttaaggacttaaattctttgacggtgctgtaaatttattcctatacacctattttatttttttttttggactctgtttcttatgttgcagtggcaaggactaaataatgtatacttcttgctgggttggtaatgttgttgatgggaaattccctacatgatgttttgaggcatgcatgaatgggtagttgaatcttgcttcaaaagaggtgaatttgtgtttgtgatgttttgggtcatatgcttctatataggataggggtggatccagaaaaaaaaaaaataaataagggaggtaatagtggcggggtttggaggcggcgtctccgatttttttttttttttgtgaagaaaattnnnnnnnnnnattaagttgaaaataagaaaaagatggagaaaagaaaagatagaaagagaaaatgataaaagtaacaggtgatatgatgaaatagaataggatatagaagtaagatggaagaagaaatgaacatatataataagtattttcataaaataaagaaaataatagtaatgatatataatcaacttgtaaaaaaatagtaatgaaaatcatcaaattaaatttaaaattaataaatatatttgaaagagataaaataaaaaatttagttaaatgttgaattttgaatgttgaatacattgaatagcatgggcggatccagaaaaaaaaataaggggggcaatagtggcggggttcggaggcggcgcctccgaaatttttttttttgaagaaaattaaaggaataaattattataacaaaagtgtgaaaaatgtacaatttaaaagagaaaaaattaacaaaattagcatgtgatgggtgctcaaaagtaacaagagtgtagccactgcattcataaaagttacaaacatacatatccacgctcactcctttcttatttttcattttttttattattctttttctatgcttttcaattttttctcttatacaaacgtttaaactattttttattttactttattttattattataaaaaaaaattctattcttgagaatttaaggggggcactgcccccccccccaattgttaacctacatccacccatgcttctatgaatgagtactgttataatagtttgacaataccttaatcaatgttaaaaacaataaaaatcatgcataagaaaattgttgaaatatatttactttttgagggagagcaagttttggctttaatcataaatggatggtgctacggcgggaatcgcaatagttatatgcacagttgtaaaattttctcatgtcattaatttggttgagataatgagttagtggtttaattgattggtatttattttgattcgatatatattaaaattttcaaattatatatgtatctatatataagtatatgcttagtattatttgagtaagaaaagtttattaatactccaaaattcaaaatatatttttaaaaaaaaatccaaattttttataataaaaaatccattttttttttataaaaattgtaaaaccggtcgggttggatcggtccaatcgaaatcggataacctaaccggacaaatttgatcggatcaactatataatggatccaataatgaaaccgatcaggataaatcatcgggtttcgatccgatcggctgggtcggactaagttttacaacaatggttatatttgaaattttctttaaaataataaagaaaaaagagaattgattatttgtgtttataacttaagaatgaaaagactgaattgttttggttctttaaattgagtttttttttttttaaagaaaaagcaattcatctccattttattgggcatgttttattttaaaattattttttgaaaataaaaaaagtgaaagcttaccatcactctaaagataccttcattataatttgttagttgtttaatggtaaagatattacaactaaggtttagcttaacctaatccgttgaattttgaatctctccccagtgttcctgtctccagcttctctccatctgttttgtagaccattgggttgatctcatggctgaaatttatagttaatgattgggaaatggtgacccttggatcaatccaatggataagaaattataaataaaatagaatgaaagattgcagaaggcaaaagcatcgaggctcgtgaacacgaacaataacgtgaagtgcattatcccacactaatgtgaaatttttagaagtcttacattatttcatgattgtacaatcaatgtcactgttcgtaattatgcaagagaggttaaaaactacagccacacaggttattcctgtataagatatgaaaattacaaaggaaaaataaataaaaagcaaaaaagtgtcatgagcagaactttcgggaaaagattttgcaaaactatggcatatgcttttgatttcatgatctttgccatttggatttgcatttccctacataaatttctctaataccattatcctccactcattctcattttacttttcattctttattttacttataatttctcatccgttagattaatccaagggccaccatttctcattcattaacttctgtcatgagatcaatccaatggtctaaccaactggagagaagttggacagagacacgcaggagaggattcaaatcccaactctgtttgatgaacaagttaaaagttaaaacaacaatttaaagcaaatatcttttatataaatctccattattagtgactcaactttttttctttttccatatatactattttttgaactgaaaatcgcgggagagtaaaatatattaatcttaagaaaaatcgataaaatgtactaaattatcgatgcgataataaattaaaacaaaacataaagatgataaaatatcaaattctatagtccaggtaacagaaaataaagtattttaagccaaattataagaaattaaaatgtaacttatctttttttaatttaactgacaaataaatattagaattatctacttttttagagtatttttagtggtaaatcttaaattaaaatgttagatcattttttggtggacactatagtaccacataggattgaatatctctcaagatttttctaatttatttctttaatggtaaatctcattttgagatttcaaagagtaagaaagagaaaaaaaaattattcttttttaaagaatatacaaattttaagagttcttctataataattcattttttatattagaaatccctttatcttgaaagatttagtaaaaatcagatcttaaacttaaaatctttattcaatagtaacactaaagttaaagataaagataaagatgctcttacaccaccatatgaaaatccgaagttgggaaccattattaagtttcagccacatatgagtcatgatagaactgtatgtattaaaatacaagatcgtaaataccatagtcgcataattcttcgttggcatccacgtggcatgatacttgtaggcatgtgcaggatttgtaggcttcatttcattcaaaataacatcaatgaatacaactaagaatatatatgatcaaaaatattgaatgctaacaaaaagacaatgatactctatctaacttatgaacaatattattatcttagcttccttataaaaattaccaatgataggacctctctacacttaaccaaaattatctcatatgttttgttgccattgcagcacattaaatcatcgacaacagctttacactcaagctcaatgctaatgttctggtatccaagctgctgaacccatgtaagaccttgtaacaatgtcatatgcttctacttctgttggacttggttctccaataaaaagtgaaaaataacaagataatgtgaaaaaattaataaattgagatttgaagaattataaaaataagaattaaataatagtgaagcttatgtatcaccaaaaaaaatataacataataatctcatatacacatccctgcaccaaatttgaagtgtagtgtttcgaaagatagcagcatctatatttaattttaacgagcctggttggggaggagaccagctgtgatattcgtgattttggactgcagtaggtctgtgaaacatgtttcatctagcaaacttccattcgtgtaagaactgagaagagggggagatagatatttgtggatgaattagtgtttcttccaaagttgctggtttcttcgagtccaaatagtccaaagaatgatggctagctgctccctatcctcgtgtgagagagagagagatccttaataccttccgccacctgaaccttctgctgacttttaggccaaaatcctgataattgccaaatagaaattgcatgatcacatccaaagaacaagtgccattcattctcaaaacctgttccacaaaaaggacaagcatgggtgcatgagaatcctctcgtttgcaatctgattcttgttggcaagcaacctcgtaagatcctccaaagaaaatgctttattttgggaggaaatttaaggttctagatttgcatccaatcaccagcttccttgagatggtcagtttggatgatggatttcataatgcgaagataagctgtccgaactgagtaattaccatttttaaaatttccaaagaagttgatcttgatgcgtcacattcagcaaatgtattttttgaatttcatgaatatcacgatggcagaaaaaattatgaaaaagatccatacgccaatcattggattgatgttcaatgagacaacttacattgagattacttaagggaccaagtggaggtgatgatgaaggatagaactatcacttgcctttagccaaggttgatcccaaatgcagacgctattaccattgcttattcttcatcttttactttcatttgtcattactcctcaagcatggatactaaccaaacttggattgtgccccaatcgatccaaagtgtggacttcgttattaatgataactgtatacgatatagtagtatcattgaatatgagttttttttttactcttcttttttttatgagtattgataaaatttattttagttaaaattaattttagagtgatatgatttatgtttaaatatctttattataaaatcaagttaaaaataaaaatacaaaattttggatccaacttaaaaattacttaaaattgttttaatccatatttaattttagatccaaaatcaattttaattttttctctaataccaaacatatgaaaacattttcaaaattaattctgaactcaatcaattcttcaacttgatatcaaacatgcacttattccctcagtcttaaaatattatacagttctacaatattttttatgtctcttttaaaggaaaaatttgtttatatttatacattattttaatacattaagatgaaatttgttattattgtttttgttattttaattatatttttacaaataataagaagaatatatgaaatttcaaaataataaaaaagagatataaagaatattaaaaagttacaaataattttaatacaaatgaaaagatcgttttcttaatgtatatgctagaattttaaactagagataaagaaacggagaaataggcaaatagctatctagaaaataattttatttatttttaaaaattacaacagtaaaattaaatgtcaattttttctattatttttatttcttaaaggatactggttaagttttctctctctcctgtaagattatcttaacttatactactatcgtttttcttctgaaggaatatgactatcgtttttatttggcacttttaaagaaaatttttgtttttataggctaatatttgttagggagggattcactaatcacaacatacaacatatttaccaattgttcgacaccaacataatttcttggatacaaccatttgcatatatatcgcctagtgctcattactaatttgccacaataaaaagtgtttccaggaccgaatgtataaccccgtgtatgccagttatggatggtgaagctttcgggttgctgttggctatgaatttcttcatttctttgggactgcaaaatgttgattttgaaactgactgcaaaggaattcttgataaagtcaataggaatcattctgatatttctgatttgggcctcattatagctgaatgtaggagagtactgtctttacatccaagtttctgtcttgaatcttgatgttgtaaggagataaggcaatggagttacatatgctttggcaaaagtagctccatcttatactggtttccaagtttttttttattatgtttccctttgtattgttcatttgatcattaataaaattcattgaattgacttttgttataaataaataaaaagaaactttaagttcaagttgaaaaagcttcgtgaagcacttgaatcaaaatcataaaaaataatataaattaaaaattcattatgagcaataaaataatcattataatctgaaccaaatcaattaaaattggtttagttataaaatttatctttttcaatttgaacaaacccaatcaattattttttcacttttaaattagattaaattgtaatttcgatacttttataatttttattttatgatattggtcctttcattttcattacaaaataaaaagtcaaatttataacatattagttgtctaatagaatgtctactttgtttacaaaactcatgtacaatttttttaacatgctacatgtataaagtatttatatcgggtccagagttaaatttaagttaatgttttcctttcaaaataaggattgtttttttttttattttgaaacatgattttcagtccttcttttagtgatgtaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtctggtcagtagggtgcatttttgctgagattcttggtagaaagccaatcttccctggaactgaatgtctcaaccagctgaaactaattataagcgttcttggaagccagcatgaatctcaccttgagtttattgacaatgcaaaagccaggaggtttatcaaatcactgccctgtactagaggcagacacttctctcagctatacccacaagcagatccattagccatagatttgttgcaaaaaatgcttgtgtttgatccaaccaagagaattactgtcttggaagctctcnnnnnnnnnncatgtacaatttttttaacatgctacatgtataaagtatttatatcgggtccagagttaaatctaagttaatgttttcctttcaaaataaggattgtttttttattttgaaacatgattttcagtccttcttttagtgatgtaaaatgtaaaatttttcatattaaattcacttagatcaaaattatgtaactcaagtattcaactactccagcaatgtcaaacccaaaaagggtatatttacaatgatttttatgagtaataaaaaataaatgaatatgatattagaatttttattttctagttgcttgtgagactttttcatacaatttttttattatcattttttgctatttttagttaaattattatgtattgagttagtcataattataatcaaaattgtgtcccaaaataaataaaaatgatcattatttcacaagaacaacataaattcaaatttgaaagttggaaaaccaaatcaaataaatttttataagataaaagaataaaagtatattttatcgtttttttaattagactacgtagcaaatcaaatagcacaaatcaaatatttcaaaaccaaaccaaatcaaactcttcaaaatattagacttggaatcacaagttcaggaaaaaaaaatactataaaaaaacaggagtgatgtatggatagaaatagcactacgtagggcaagaataggaggagtcgaggaggtaacgcactttccctgcccgagttaacattgaatggcttttggttgtacttgtagccatagggttggtaccgaataattttgttagattttctacagattagttgagttgaaaggaaactagccaatttgtttgcacctgaatgaaaataataatgaaatttaagacgaaacggctgaaccaaaatctgtgaatgttaacgttagcgtggaaaagaaaaaggcaagacacgtttatattttagatttagatttatagttcccaaaggccaaacacccatagagtacatacttacgttgtcgtattttacattctctcttttacgggaaaagcaaagcaaacccaatcattattaataataatgccgtgtgggttggggtcgttgtcatgactcatgtgagtcatggggtatgccgtatgttaaaaatgttaatgtgcttatttcactttctttcccaaccataccctaaactaaaccctcctttgatattttattttattctatgcctttatgcctaggtaattattattattgttattattattattattattattattatatggatacgttatgatatatttattaatatgatgactatggctatagcctccttttcttctctagcctgatctcgattaaattggacatttattattgtttatatgataagatttgaaatgatatgaaatccacttcttgaaatccaatccattatccactctattctatagattattgcttgagctgtgcaaaattgattttttgtacagaatgtttacttgaagctccatcaattgaggagggattcttcatctttggattcgcttttggtgcctcggagtcagagctgcaaggaaagtggagattctgggatgaaagctgaattttgtggtatgaacgcttttctcactcttttggaatcaatttgatttggtttctttgttattggggtgtgtgtgggttgaaggctgagatcaggtgaagaggaaagataaaattgaatctttgttatattttaagaaaaaaaagatgtccaaaaagatgggcttggtgagaataggttctaaaaagagacaaggtgacatcaaaagatcaaaacccagatgtagaaatagcaactaagaattgattcgaaccttctctaacatggcataaaaaagtatccaatgattcaccctttatcctgcaacaatgccagtggatgtatatatgcattgtgtttctgatatttgtttgataccagctttaacagactgttgattgcttgtcacagttagtaaatgcatgattcatgcctataataatgaatttactgttgtgagttttattattagtcccctgtgtgtgttcacttattgagaatatattgtgttgctgttaatttgcagggaaatggcaactttagttgaaccccccaacagaattaagccaaaggggaagcattattacacaatatggcaaacattgtttgagattgatacgaagtacgttccaatcaagcctataggccgaggagcgtatggcgtggtgtgctcttccatcaacagggagaccaatgagaaagttgcaattaagaagattggtaatatatttgagaattctattgatgcgttgagaactttaagggagctgaagctgcttagacatattcggcatgagaatgtcattgctttgaaagatgttatgatgccaatccacagaacaagttttaaggatgtctacttggtctacgaactcatggatacagatcttcatcaaattattaagtcctctcaaccactttccaatgatcattgcaaatatttcttgtttcaggtactagccagtttgttatggtattttcctttcctttagctcttctttctaatttctaaacctttgtggttgtgacttttcttgaatttgcagaaatgtataaatattcatttgaaggagattttgttgggggttgaactatagttgcaatgcactcttgcagtgttttaattggcattgccatgcttcaaagtgaattccccattttcaattattaacgtacaacttaaaagtgaattaaatatcgaatatcctctttcatgaattcttatactatatcatcgggctgtttttgaggagttgggacaatttgagttgtggctttacattctctagtttgaatgtattactatgtttcctgagtcagactttagtgtttcagttccatgatttttcaggtgaagtctagggaaggggtctgtattctcttcttccggctagatattgtcatggtactagacaacgaaaatcattggcccaaattgggaaattgatatgaccttagcattgtttgattgaatgatgaagcttcttatgaaaaagaaccctattatggactattcttgtcaccctcatcttttctacatttttatgagttttgcagagaatgttgaacagaattgacaaataataatctacaagtagaaagcagttaacggattctttatgagcttctaatctttgcatattttaactattcttgtgaatgatactaaccatatactcttactttagctccttcgaggtcttaaatatcttcattcagcaaacattcttcaccgggacttgaagcccgggaatctgctcatcaatgccaattgcgatttgaagatatgtgactttgggcttgcacgaactaatggagttgatggccagtttatgacagagtatgttgtcactcgctggtatcgcgcaccggagctcttgttatgctgtgacaattatggaacctctattgatgtctggtcagtagggtgcatttttgctgagattcttggtagaaagccaatcttccctggaactgaatgtctcaaccagctgaaactaattataagcgttcttggaagccagcatgaatctcaccttgagtttattgacaatgcaaaagccaggaggtttatcaaatcactgccctgtactagaggcagacacttctctcagctatacccacaagcagatccattagccatagatttgttgcaaaaaatgcttgtgtttgatccaaccaagagaattactgtcttggaagctctcnnnnnnnnnncaaaaataatattcttagttataatattttttaaaatatgattcttgagattaaaatataatatcttgacaaatactcctataatattattattatttaacaagatagagtcgcatttgattcgttcgctgtttcaaaaattagcaaaatataaacaagaatcactctgacttaatcacatcttcatgtgacagtatgttcgtctttaagcttgagataacaaaaaacaattcaaaaaatgttgttaccaacgtatataaattagtaagaaatttataatttataatttattgtcaattgtcacaatgaacagacagatgacgtannnnnnnnnngatgtctggtcagtagggtgcatttttgctgagattcttggtagaaagccaatcttccctggaactgaatgtctcaaccagctgaaactaattataagcgttcttggaagccagcatgaatctcaccttgagtttattgacaatgcaaaagccaggaggtttatcaaatcactgccctgtactagaggcagacacttctctcagctatacccacaagcagatccattagccatagatttgttgcaaaaaatgcttgtgtttgatccaaccaagagaattactgtcttggaagctctccaacacccgtatatggctggcctatatgatccaaggtgcaaccatcctgctcaggttcccatcagtcttgacatagatgaacattggggagaaccgatgattagggaaatgatgtggaatgagatgctacattatcaccctgaagctgcttctaccaatgcatagattattaattcttccaaggctttctagtcccgttgcttgtctcaagggatagttctgatttgccctagataaactgtaatcttaaaaggatttaactaccgaattttgtactttgcatgagattactttagaacctttttaatttgacgtctccacgaggacaatggcatcttgtaacttgtatatagccatgcacactgttttttggtttttcggctaaaaacccatttgaactagtgttgttcatctgttgtttcctaaaatttaacagaaaagagtaagataatttgtgctttgaaatatatccatggttatgagatgatgttttccttaaataacacggctacctggatttcaatcgtgggatcattagtgaaccaaatgtgtttaggttcagacaaaaagcttaagaaccttcaatagattcttataatgtgcttagacaagcaataaactgaagtaattcttttcattcgagatcttattcacaagcttaattaactacggaatttatcgaaatatgttgaaaataattatagaaaggtcaaaaatcactttcataaccctaaatatagtctttcaaatgcctccttagttgatttacagttctcacattgtaattacttcatttctaagggactagtatcagtggcatttgcattgtggcacttaccacaggtttgaaaatcttgtgcttgtgctttaccggtacagcatcaatatcggaaaatgtatcagagtgtcatggaaagttcatcattccgggtatcataggcacgttttttgaaagggaaagttataaaacaaaatgaactatatttttttgatgaactttatgtgacctatgaggagtgtaatggtattttgaagtagaaacagtaaggagattataaaacatgtaaagacctcagaagtgcattttacctttttcttgcaagttgcaatcatattaaccattaatttggttgctgacttgactaacatggaactgctaatgtagactgcagaggaaggatattttttttggccttttgtttccttttatgccaaaatataaattcatattcagcattagcataaatttacatggtaatgaaattaacagtcttttcccccctctagaaatgttaatatgtgtgtggaaatcttaacataagccgatggtactaaagagaaaaatgatccatgaacagttagtgctcgcattcacctacagagagaaagatggagaagagagaaacgtaattggactaaaaattaacccaagaatatactctaaagagaaaatttaggataaaaaattaataacactcaaattacttgtcatcatgtaaaaattaatagcaataatagtttcataccacctagtattttattgaaaatagaaaagagaaaaaaaaaaaatataagcatctgaggtcgagtgtttactctgcagtaggagtgtgtatatcatttctctaatgataagtcggattccaagaaaatagttcacaatgggatatgtttactctgcaacatttaaaggatatgtttgccacactgataaacttcctgcaacatttaaaggatatgtttgccacactgatattactttttacatattttaagtaagttccatcatcacatattaaattttactttttacaacttaagcaacatttctcagcaaaacattaacttttatttattttttttaaataggtctcataaataattatacatcctcatattttatcatattaatttttattagttactttttttttttaatattgatgcgcctaaataagatataagagcctctgcttatttaagcaacttgtatttgaagaatgcttggtaatggcacgttaaagattggtttagtttgtgaaaaacaaattcatatcttataaaattatgagtctaaattttattgtcaatgtgaaaattttgttaataagtaatatataagtatatcggtaagtatttattgaaattatattcatcttgacttgatgagtcattccttaaaatccaactcacataaatttttcagaaaaaatcctattaagcaccattgcataataagaagaaacaaaatgataaacacctcattgaggcctaactctctgtaaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttgaagatatagttatcaaattttagcttatactacatgaataattaaatgtctagtttctcttaggaaatgggtagtctaacaattagctttaacttttttgttcttactaatctaatcagtgtcttattacattggtcaaaaaattaaaataaaaaatatttaatatgaaaattataaaaaaatcataaacaacaaaattttatacatttcaataaaatattaaaaaattaatttaagacaaatactaatcgatatttttgatattgattaaaaagttaaaagaattttttgattaaatgtataaaattatattaattataaatttgtacatacttctataatctttataataaatatttttttaattctttaatcaatatcctaatattttaacgacagattaacaatatccttaatttaatatctcaatattttctctcccgtacgtccaaactccaatctcagaaagtgagggggaggagtgggcaatggcccaagaatatgccagagaatctccgtattatcatgtgagactgtgactgtaatgcgatgttctttaccgatgaaaacgtcgtgaaaagaaaagcaactaatagcacccgccagacgcagggagtgctgacaacgtaaagtaacataatgagcatttttagggtggtgctcgtacgtctttgtatttggaggagcacccatgatatgatcagatcttgtaatagtaatatacagtatttcgtttttctaaagtgaccaaattttagaaaataacgtacacttataattattgaaaatagttgagtattgtaataaaaataaattaaatatatacattaaaatatgttaaagaaagctctatatatgctttcggtttatcaacgttcttgttgagaatgacaaattgaccatggatatgcatgattttggacagtgaggctgcgagtctgttttctataacactttgtggttacataatgttttcattttcatctcatacttcactttttttttttttcacttctgaaattgttggtgtcttctattttttggtcatagttggatatatgaacaatcaatttcgggtaccgtgcgtaaagtaacatgtcttccatttagcaactgcacacattcaggaaattttctgaagggtgatcagtgaaagcaatttgcggctctgtttagttgaactttttttatcagagtagtgtgtgtgagagagagagagactaggcatacttaaacacattcatcttttgtttttgacgattacttctcctagtcaatcaggtttgtaattcttagttctaactacataaaagccgacaaagatacataactacagaaacaggcgtcgaaattgtcataagattttaagaacatgtttagggaattcagaacaagttatttttttgactggtcacaagaaattaccttacttttaagttaacacaattgaactttttcaacagctccttaccaatacaactcgagtttctttattaatcatgtcaagtaaacattaacagttgagctaaaaatctgattttgttttggaaggggattgagattattatcaactcagaaatttccatcttatcggtagtattaatgatgcaataattgtgcaataaaatcattaaaatgtcatatataagagtagtctttttctaactaaattggactatataataagtttaatagataatcgacgcaatggagattatcggtcaaagagaagatgaactgaagcagccatctgatttttcctaggataaaattataacatcttatatcaattggcacaatgaagattattgagtcaaagaaaaaatgaacagaagcagccatctagtttttcataggatacaattataagttattctcccacgttgaaagcattagtaattttcctgaaacaggagtcataagtctttgaaaatattaaaatcggatttgctggcgctggtgatgtcaatgacttaagcggtaaggtttatatgcatagttgtaacatcatgaatgtaaccagaatcaatggtaggactggttcgatatttttgtctcttaattaaataatgggatattcattttagaaatgaaatcacaacttaaaatatcttttatcctattatagattgattcggtgagaaaaatattagttagatgtaaaatagaaatctaatatgcttattgattaaaaaaaatgcatgaatgtaagattagttgaagcttccgcgaaacaacatataaagttgaaaatgagtgagacccaactcaaaagggttgttctgcagacatgacttgtacctatttgtagaatatagtgttattaaaactctgcattcacattgaaaaatttggatccttctagttctagcttatggatgatgcaagagagagagagagaggaacctagctgacaaatgggtctcacttgaatcttgtatgatcttgctttctcttaactacatcaagtaataaaccaaggaatatatatactattctcatttcttttcttttctttggatcagttcacttgtagagaaatcgagcaaaaagagaataaataaacattaaaacgaaatgagattcacacttacattttattttaattcaaaattttatgttatttcattttttttttactctatggacgggtacctttttctcttttcttccttgtaaagtttagtgtaaacctcctctttaaaaaaaataggacaaatagctgggcaacttggactggcatggccacccttctggattttggtcgggaacctttttctttcttttccaacacaacccgtaactggaaccatgtgcttaatgtacatcgtaaatgaaataaaatattatggtggtcaaaagctggctctattgaaaaaagcatcgatcaccttcggtaaattaaataccagtatagtattgtgttagttatggtccatcatgtgacaataattgatttaaaattatttctgcagaatatggagtatagttaagtttgttaatattcgagttcaactcctctcaccaaaacctcacatgaaacgctgtggaaaaaattagtccatgtggaaaagatttcttaatgatgatagtaatattttagtaattaaaaatgtgaatgctgtgatttcaagatgtccatatttttggtagatagaaatataaatataatagcagtgacggattaatttaaacctaaaccatcttcaaattatatatctatatataacactacatcatcaatggctctaaacaatgtggaagttttatcttttatgcaccttacttttgaattaattatttgattcgtttatgtttacttaattattctgttttatagaatgttgaaatgattagagagagttatttgttgttttttcgtgagttctaaattctgtttcggtggtatgatttgtgaggaataaaaaaaaccattttaagtgattttcattaatttttgtattaaatttagataattaaagacaacggatcaattgaatgtaaaaataaattgtgcatatgagtggattatttctgtcgttaatatttttgacttggtcatatacgtaattttttttatcggcacttggttattatatacgtatttttatgtgtgtatatatatacagtactcccataatactctatggaaaaatgtttaaagctcttgatgtttcattaaaataacagggtagttaaaacatagtattatttgttgaagtaacttatatattttaaataatgataaattttaaacaaacttaaaagatgtttaatacatggaaagaaaataatcacacgttgaaattgattatgtataataataatttgagtttacagtaagaggtcaaaagcttttaattgtagctcacccaaacaaataataggtgattggcaatataaggagtagaatatcagacgccaaggagcaccaataaaaaccagaaaatgattattatagaaaaaccagaaggaactgcaactacctaaaattccactaataaataaatatttcaaatgggtggtccaacatctacgaagtagatcaccctcatattgcgtttccacttggtaaatggcaacatatatatactaggattatatatcaacatctttaacccaaattatatatgttaagtataagtaaataaaaataaaactgcgcgtgctcatgaacagaaacagtgaccatcgtcgtactgtgtgaccctttccaagtcctttccctctttcaccttctcttatttctattgacttttttaattttgcagtacacagcaaaaagcatgaagtccaaagaccaaaaaacctcactagccaattattttattgtattctattattacaatgggctatttttttctctataaattccgccccatgaatcccttcaaaacctcttccccttctcatcttatcctcctcctaaaaattggtcaaaatctatccaatctctttgcatattccttcttatcatcatcatcatcatcatcttctctgttgcctctagaattgaaaagttcttcttcctgcccatagtctttgacacccttttccaacctctagattttttcttccctctataattatctccttcacaccaaccttcttattccacatatcatcaattaccttgttcctctcaaagtttgattatttttctcttggattggattgctataatttttgttcatacttacatgttatgcagttatgaatgattgagaaacaacacaaatgtcttctccagtgatctccgagatcctcctctctggcttcaccataaactcttccctaagacgcaggacacacttggtgcaatctttctctgttgttttcctccactggttctacgttttctcatgaactaaataaattaacctcgtacatagtataaacatagtacgtacccgtgttcttttttcaaattcaatcattaaatctagctagcaaattagagttattattgttcaaatagcatactattgcatggcttctcctggtggaagtggaacctattcatctggttccagttctcttcaaaactctggttctgaaggagacagagacatcatggaacagaggaagaggaagagaatgttgtccaatagggaatcggcacgtagatcgaggataaggaaacagcagcacctggaaggtctgagtgcccaattggatcagcttaaaaaggagaacgcacaaatcaacacaaacatagacatcacgacgcagatgtacctcaacgtggaagctgagaacgcgattctgagggctcaaatgggggaactgagcaacagattgaactctctgaacgaaatgatcagtttcattaactccaccaacaacaactgctttatgatgttcgatgaggcacaggaaacgaccactcagctgttcaatgactgtggcttcatggattatgcttggaatggaataccaatcatggcttccgctgagaatgacatgttgatcatgtattgatcttgattgtaacacgacacccacgtcttctcttgttttaatttgcttttgtgttttacttgtaatagtaatgtctattgttttcagtttatgttatgtttagggttgtcttgtcttgtgcgtatttcaagaggaagattcttttttcttctcgaaaatgtaaaatatcgaccttttattttccaggtattattttcgttcatttccactctttattttattaaatgtctaatttatttttcaacttttaacttagtactatgttttacagattaaaagattcttttgaggaatgtgagcttgaaaatataatattccatatttgttgagaattttgttaaaatatatttctaggcattttttattcctagaaagtagtattatcatgttttattgtacttttatttctaaaatgagggttgaaaaagtcatatttttcatgggaacgtgaaaaatcatttttcaactcaattataacttctacttttattttttgttataattattttcatttttaaaaatatgtttagaaatattaaaatttaatcaaacattttaaaatatatccaaaaataatattcttagttataatattttttaaaatatgattcttgagattaaaatataatatcttgacaaatactcctataatattattattatttaacaagatagagtcgcatttgattcgttcgctgtttcaaaaattagcaaaatataaacaagaatcactctgacttaatcacatcttcatgtgacagtatgttcgtctttaagcttgagataacaaaaaacaattcaaaaaatgttgttaccaacgtatataaattagtaagaaatttataatttataatttattgtcaattgtcacaatgaacagacagatgacgtatgtcatataaacaaaattttaaaaccaatcataactagttaatgtgcaagttcttttgattaattgtaaagggggaannnnnnnnnntacttttattttttgttataattattttcatttttaaaaatatgtttagaaatattaaaatttaatcaaacattttaaaatatatccaaaaataatattcttagttataatattttttaaaatatgattcttgagattaaaatataatatcttgacaaatactcctataatattattattatttaacaagatagagtcgcatttgattcgttcgctgtttcaaaaattagcaaaatataaacaagaatcactctgacttaatcacatcttcatgtgacagtatgttcgtctttaagcttgagataacaaaaaacaattcaaaaaatgttgttaccaacgtatataaattagtaagaaatttataatttataatttattgtcaattgtcacaatgaacagacagatgacgtatgtcatataaacaaaattttaaaaccaatcataactagttaatgtgcaagttcttttgattaattgtaaagggggaaactaataaagtcggtggatgcttagatcttttaatttaggaaaagagacaattgtttcatttcatatatatgatatttttcttattctttcatttcgtttcatatatgatatagtgatacatttgtaccgtttcctaaaatccaagtgttaatttgtgcatgtgaatataatgtttgcattattgctgatgcatgttttcaatgttgaagagaataaatgggaaaagatataataatcaaagtgagaattaaatagttagtagttcaacatcctcttaaagaaatgaaaatgggaaagcaaagaattggaatctattgaatattttttccaccataatattaatataaaatatttactaattttattaataattaattttcgttaaaaatctatttgttcgttttttaataatttttttttctaatcatatttttcattcataaaattcaaaactgaaatctaattttaaaaataaatctataactactcaaactaactacttatttaactacttatttattattagatattccttcatgtgtgaacggaattatatcatgtatcagaaaagggcctaagcatggccactcgctagctcatcctgaatccagagaattcgaaatcaccaaactatagcctgattgtttgtgtgtgaattttttaaaaattacttttcattacttatatttttttaacaaataataaatttggaaaaaatccaaaatacaaaagcaaacagctttagattttttcttaaactttataaaaaaagttataaaaaatatcattaaaagttttctttttctttttgcaaactttacgtgattacgggttagtttgagtcatgatttgttttgtggggggaagtcataatttattttaatcgatcttagagaagttccataaaaaaatgagaattctacaataaagtctagccatttatgcaaatcatcgattattataccattttctaaaatataaaagtttaattgtgcattagaatataatattcgcattattggtgaaatggtgatgcatgccttcattgtttcgaatttcattgttggacagaacaagtgggaaaaattcacatattccaagtgagagttgaatagttagctcatcatccgtataaaaatgaaaatgcaaagacggtgtaagcagttcggacaaattatgaagcatgcagatgaactcacatctaaataattttaattttctagaactgaaatatttaatgtgtcgtaactcgtaataagacctaatcatgtcttcaggatcccagcatcgacccagaaaatccgaatcacttgattgtatatttgtattattctcacattcgtttgtgttcataaaataaaaaataatttataaagaaaaggctaaaaacagttgatattttttccagaattaaaaaagtagtctatgaaaaaagtaatctctttaaaaaaaattcaaacttatatgaccagtttgagtcatgattttgtaatgagcaaaagaaaagtaatcttttctaatcttaaagaagttaaaaaaaaaatatcgttaaaattgtaaaataaattataaccatttgtatcatacttccttcccagacaagctatcaagtttcaacgacacaagctatttcaaaacaaacggcaagatgatgataagtgtttaaggattataaataaataaatgagatatgatttagtcaatttatttttaaaaaataatcacttattttcatcaacatttaagggtgttttaaaaataaatgattgtttttatttcttttcaaaattaatgttaatcaaacatgggctaattactatatagaatgaccgaggtagttataagctttaaagaaaaattgtctagaaaaaccattcaaactttcacactaattatttttttgtttaaataaccgtgtactgcaaattagtcactggtctttgaaagagaaaaaaaaaaactttatccgcacttaataaaattatcccaagatgataagcaaattgccaatgttgtagttccttttggaggaggggaagatgtatctttccttttggaagagaagaaggggtatatgcataagatagataaaattgaagtgattctttgaatgttacaagttaaattaaaataaaatgatgccacctaccacaatgtttaagtgcatgtttagatttacgttctaatgactcaaacgttcgttcatttcaattattcaaggagaaatttttttcatttaaatgcattagaatgcatgtaaatgattactcaaacatagtcaaaggcagatgcatgtaaatgcattctaatttacatacgaataaaaacatctaaaatttaatcctctgcaatttcaaagttgcccattgcaattaaagacttaaatttagaagtttctggttagatataaatgtcatttaacatggtgatatatttttattctcaattttatttccttcttatctccatctaaaatagtaaaaaggtttttttctgaaaaaaattctttattctttgttttctttccttattttaagaattattagggtaacaataagtaagaagagcactttcaaaaacaggtattctatcagcccgctaaatgttttccaaacttgttaaatattcaataaccagttaaaattacaacattaataagaagaaaaaaattgtcctactagataaagttgattgcataattcgcacgacataattgtattggttaaagaccgaattctaaatgataaaagcagacatgataaaattaaaagcaaaaaaatataagggctgcttttagcttatttcttcagtataagcattgctttatttgtcattgccactataaagtttcaggatggtaccataatcaatgcagtacggtttctcacattccccatttacaacctttgattctcatctctatgtaacaatattcaatgttactacacaactacattgatcatgtatctatataaacatttgctttcccaaggacaaaaagtctgctagctggcatcacttgtcttccctatccatttttaacactcttcattaataaattgaacaaccctgtgaaataaacaagtatgcagttgatttaaaatttcaacatccttctctaatagtttatctctaggctgacacaaaacagttctttacaagcctctaatttatcagaaatggaaaaaggtccctctcacttcaaattttttcttccaacatcaatatgtcaacttttcacccgcatatggctatatagccttggtcaccaaaaattactgcaagaacaagcaccattaagaaagtggtggaatctcgtgttatccctcacaacaatttttcttcctgtaacttttgacgatccacacattacaatatgacaaaacccttcgcacaaccatctccgaatcttgttcttcttcctcccttgttcattccactaaccttcaggtcacaaggagaattattattccaactcatgcatggttaccagcatgagcatggtgtttgttacgttaaggcccagccaagcattagtgtggcctggatagaaagttgaggaatgtagcgacactctaaaactctcctaacactttttatgtaattggttggaatttggaataacttattattaattttggtaggttttattttttattttgtacatcagtgataaaccttttggaagtaactttgcaaatggtgattacttttaataattctaacgtactagatattttttattttatttattatatatatatttgtatgagatatttatgtttaacttttcaactaatgttaaatttaaatatttttattaaaattttaaaatgtgtaatgataaaataaataaattattttacatttatgttgtaaataaaaaaattattaatgttataatattcgaagttcttcaataatatttaaattttgttgacatgacattacattaaccatgacagatgacttgacatggatatggcagttgacgcagaaaacctagcctaggggatgttttaatgtgagagtataagctagaaggttttatcctcgatcatttctcttgtcaactgaaatatttaacgaaaagtttatcgaaggattattacaattgcataatttcagaacttgaagatttcaattgaaacttgaagaaccaaattagataattgtgatacttaaaggtccaaaagtgaaattaagcgattatcttttatctattgtatgtattttttccttatcacaattgtacattagctaatcaatgagttgcaataaagagtttaatttctatgctttttttttttgtgaatgtttaatttctatgctattagtgcaaaaaagtgcattttataagagaattatcctcgtaaaaaaatcaaccgttaacattttgtcaattctagtcattgttgcatatacatatgctctaaaatctcaatcactgttgcaacttactaatatagacatgctacttcccagcgattcaattcacttttaatgcccatctataacaccgatgtacgtgtccccgactatgaaagcatgaacttttccccccaatgattggatcaatcaatgccctccatcacgggattggatactttaaagtgaaataaacctatccaccctctaatgtaatttaagcaactcacaaaatttagtttgaaatcaagggtgcacacacccacacatttcacttcacatatttttttacatgaggatccaaatcttaataactcgaatacaaaaattttgcaagacccagatgcattcccatactacatacaaatcatatgcttttccctgccctcaagtaataccaaattattgtttgaagaaacaattgtctgcaaacttaatgaataaatagcattaaaatttcatatggtacaacttcatgctgtctgataaggaaataaaaccaatacaataggccaaaactgcaagaattgccccacagacaaccctatattctcacgcaatatggtaagaaaaaacaatagaggaatagaacgagaagctcaaccctatattctcacgcaatatggtaagaaaaaacaatagaggaatagaacgagaagctcccacgccacaattccctaacctcttttggactcaatcgcactattaacattcataatatacacattctagagaaagctccctttccaatcacaattgactctgcattctcaaaactgatacagaacaccatgcaagaatgaatgatggaaaccatcttatggcaaaaagaatgggtaacaaatatagagaccaccaaactggaaaaagcttgttcccaaaaagtgcaagacaccaactgccaagccagatgctatgaagaaatgatggatatgcagcaaaacaatgaaaactacgaagacaggatagattccaatgcaagttgttgctgcggctgcaaagatgaccaagtagaagcgagtgtagagggtggtaaagtttgctggagctgtctgagtaaattaaccatacgaccagctgtttgttctgtcgcaaggtctttaccagcacataaaacctgtcacaaaaaatgttttccattaaatggagaaataaaatcaaacaaatccaatataattatatatattaccaaaaagaagcattcactgaatgcgtccttgtttgatggaacaaaagactgctcattttatacacactaaggtattcacgggactaatgcacgaggaaaaaatatcaattaactatgtatacatgcacattgtcaatatcaacaccaaaactactcaaatgaactatttaaatgattgcatgacatcaactaatattacaaaagtttataataaaagaatctaatggctacaattacaaacaaataattcattgccttctggtatatattccttcatgcaaataacttacagttgcaatcaattatgaaatgacattttactcaattccaaaaatttctagacatttcccaaatattaatctttcatcatatgacagggtgctacaaacaatttttacacttccctggtctccaaaacttaccaaattgatcaaatttccaataaaaaaaattgaaccttggacattatgacctatgtgaaaaacacacttcattgtaggaaattgcctaggttaacaagccaccattggggagttctatacattaatgtattttttctattctatttagagaagtaatcttattctccttactcttgtatacagcttgctttctatttaaattctttcatcaaaaacaaaaagtctactagtgtttctgattcaaccctacaacccaaaaatattaagcaaacaacccttaactttaggcaatgcagacagtcacacagattacaaattggcaaagttgcaaccaaaaactaacctcagcaaacactgaaactatttttggaaggtactgattgtttgggcccaacagctcactgtcagacctgcagatcaacagacaattagtacagtggaaaaagatatgcctgacatcttgagcatatcagaagattggaaaagaagagtagggcccctaacctctcagccattgaacaaagttgatcatgcacaactttggcctcaatcaaatcaccttttattggcaaacagtttagccatgcaggaactacctgcaaacatgacagaacattacaaaaatattaactatcatctcaacctaaaaacaacaatcagactcagaaagaattgataataataatgacaaacataatcaagaaccaaaacacaaaagcaagttataaacagaattgacctgggcagaatcaatactgtcgcgatgaaattggcaaatttttcccaaagcggaaacagcattgtcatatgccattacattatctgaatgaagagcattaggatgctggatcacagcatttaacctcgaaagagcctctgcagtaagccaacaacaacttgttactcaatatagtacagctttttcatagtttgttaatggatcaagcagtatgataggaactggatcaggaaaacaggaaaatatggaatagcaggaacgtttattcacagtgaggcaatttgcctgaattacacagtaacaatggtgatttcgagacaccactctccactctctgtttctaactaactcccttcccttttctctatctatttataatatctatctctctcctactaactactgttagttagctactaacctccgtttcatttaacagctatcaactcttataacagagtcactactaactccccttctatgatacattttgccccatctattattattatatctatcaatacccccccccctttcaagagggaccttgtcctcaaggtctaattgaggaaacacaatactaatttcttctaaactctcccagctatcttcatgatgcggcaaccctttccatttaataagcacttcgtgttgaccctgtgctgtagtcctcttctgcataaccttctcagcttgcacctgaagttccaggtcttcagtcaaagcttgaggtaaaggttgaggctgacaagtaggtttaactgccttcttaagcaaggaaatatgaaatacaggatgaattttgctttccacaggtaactccagtttataagctacttcccccaccttctgaattatcttgtaaggcccataaaacctgggactcagcttctcattcggtttctttgccaatgacttcatcctgtatggttgcagcttcagaaacacccactccccctcttgaaattgcagctcccttctatgtttatctgcatatttcctcatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaatcgcatctccagcgtttcgcgattcgcctctaaggctctctctatcgcgtccactcgagcttccattttcgcacttcccttcgccaccattaatgtccacagctccaagatcggagctctgataccagttgataggaactggatcaggaaaacaggaaaatatggaatagcaggaacgtttattcacagtgaggcaatttgcctgaattacacagtaacaatggtgatttcgagacaccactctccactctctgtttctaactaactcccttcccttttctctatctatttataatatctatctctctcctactaactactgttagttagctactaacctccgtttcatttaacagctatcaactcttataacagagtcactactaactccccttctatgatacattttgccccatctattattattatatctatcacagtacctccaacaagatgtttgaacacagatccaccaaactctgcacaaacaccgagaccatacacagctgcctgcagaaatatgaagcaataccaacatcaacaatcaaacagcttaaaagttaaaactaaactatcataccccagtgcccaaagactcctcactaagcaaagatatgggagagggtaattgtatgcatttccggattcaaacccatgaccaatcggtcaccaagacacaactttactgttgtgtcagggcttgcgctctaacaatcaaacagcttacgcaataaaaatggtattcaaaatgttaacagaggatacctaatgcttacctgtctgacgtcaggagtttcatcattacaagcctccaacaggaatgggagataggtatcataatacctgttcaattggtatataaaagaatgaagttgataaaatgccttcataattatcactgcacaaaaaaatggtaacctagcaaaacaaagagtgcttacttaatagcagcttcacgacactgctctgcaacatcatcaaaaatacaaattgcaattcttctctcttctggagtcttgtcccttccctatatccaaaacattaaaccaagagtcaaaacaatgatgtacatgttttaggctgtgtttggtaccacatcagaaagccaaaaagtgcatctgatatgtgaaaaccataagctctaaatactaacttctatgttggacacgagaatcaacgtgtgtactatggtctaaactaacgtgcaaccaaacattagttctttgaaaattgagtttaaaactaatcagcaggcacaacttgtaagaaatctgctgacataacataatatagaccactcaaattgcagaacagaacatggttaaagtcaatctcacagtttaaacatggtagaatgatacatttcatcggaaaaaaaatcttgcaagctaatgtgcattggagaatgaaaatgaatgtgaactccaagatgacaagtgtaataaaatagtgtaaactggtaagatgatgatagatgtgaagatcagaattagaagtcaaacatagatctatgcaagtatgtggcttgcaagtttatctctaaatgactaaatctatagttaatgttgcacgcaaacacagtaatctttcacacttttgaaaaggcacgagttcaaaattagcaatactgcacagattctacattttgaaatcatatttaaaatttactaggtaaactgagaaaacagaaaaatttagacataattacaccaaaacaaaatacaaaagataatgcttaaaggccagctgaatgaataaatggaaatagaaaaactaattaataatagagttgctagctttctcaaagaacatacccacataggtgtcagatatgatgatagttcatcaaagaagggtaagaaggaggctttgaaggttttgatcaaagttcccaatatctcacccacctgggacaatgtatacatacattagaaggaagaccaggaaactgatctgcataaacttaaaaatacaaagatagtagtccagtacttaagatgtttcaaattatttttagattaaacaactaacttgatcaaaaacttcctcctcttgttcattttcctctttaatcagttccccctcttcatcatcaaaatcttcagcttgggtcctctctgctctctctcgttttctacttgaactagctgtgatcacctgttttatctcatccacgatggatctgacctggctttcatccaaaagcatcccagagatctaaaagaggaagaaaaaaaggattggaacacatccaaaacatatttatagtgcaccataggcactcaagggaaagataaaaaaagacagacaaaaaacaagaaaagggtcgatcattacccaagcatcacaggaacaactactaaacactcatgcacaataaacaaaagcacacattgtgaaattgaagaatataaaccacaaccaagcatcctctgttaattatatataaaccattggcctctaaatcttaatagttttgcctataatatttctcagtcgcactctagctccagtggtaggactaattgacatcttaccaagctctccttactagggcctcctagagaaattatataaagtgacatcataaaaggctgtgccaaagtaaataaacatatgcagtcaccttcacaggaaggcacaccaattttttgcatggcatacctcactctaatactgcaaaatctacatctacattagtataaagtaatgtgcacctagtgtcacctttaatgaggcaggcagttgctaagtgcaaaagacaaatttcgtaattaagtcaactaaacaataatttaaatcctcaacatgccaatcatgaaaagggaaatatttaaactgtaaaatgtagtttttatttgccaattgatcacaaaacctagcagggatagacatcagttagaagaataaataatagcagagtcagtgaggctcttgattgaattctaataatgataagcatcaaacttcaaattataatatataacatcaactatgccaaggtatattcaacactcatggctctatataataaagaaaagaaatttatccagaaaaaaaaaaaaaaagacaaaatatatgacaatgttatctcatgatccaaacctgtaagcattcatttaatgaatccaacatgcttgcacaaatctctgtgtcaggttcctgcaagtaaacagaaatgggaaaatctcagcaaagaaataccaagggccactgacaagtcaggcaacattcaccaccaatatcacctagagtaatcttagtcctcaaacccatgccagaaccgggtctcctaaactaacaaaaaataacatgctgcactcacaaaggattgctttggtttatatgaatattcagaacttaaaatattttcaagacaatttcaaatcaaaaaataaaaaatattcacttccaaaatccaaaaatagaaacttcataacaacacaactaggaatggataaacttgaatatcaatttaccttgtgcaatgcttccaccagagctgggatgatactgtcagtcaaaaatttcaaataggttacatcccggccatgagattgccccttctcgatagctaatttcgcagatcgtaatagctccggcattgctgtagcaatattggaaatgataaacattaaaacagatagagtaatgatataaaacacatttactgtgcaaggaaaaatcatcgaccaaaaaaggatgcaaagcaacaataatttttcatacctgaaacagctgctttcctaacttcctcatggaaataaaatttaaggagtggaactaaagttccagcaacctgcgttgcatacaaattattaacaaggaaaaatatgtaaagaaacacttaaacaagcattaatgtgtaaagggagtcaatgaaggcctaagtctaacctgatcaatccatggaaagaatccttccttcagctcatcagcatagcaacaaagcatgttacatgctgtagctttttcctctagaacactagtcttgattccaattcgtttgtctccaagagtaatagtctccatactgcaatggataaataaaacttaattatatctgtcctgcctaaaaaaaaaatgttttgatgcgtgcttctaattctccataagaatgaaatcgctattagtaaataagaatgtgttagggttttgtgtgtgcgcaattacacaagtggatgtcataatataaagataagtaaagcaataaatgcaccttaactcctaaggcttaaagtcactattagtgaacatacaagaccaaaatgacaagcgatgtgtgataaaagcgatacattatgcattcataatttggtaattgtttaaacttttacgtagaaaagggactaaagttgagacctttcatcatcagaatcctcaatctcattgtctgaatctgctgatgtaatggttacatcaggcttaagtgaagcagattgaagcagtggaggcatgacaaattccatgtaaggaagaaaatcttgtcccagacatttgcagagtctagcccatgcctgtaacaaattaaagttgttagactaaaacatagaccaattggcagtttatgcatatgttgtaaataatatataaaaagcatacctgtagcatgtaacttgttgttggatcatctgtctccatttgagatacttgaagggacataagaacttccataacctagtgaagaaccagcacacagaatattaaaatcataagacatagctaaccagagagagaaagaagtgcttaacagagatgcaggggcagttaacttcctattttcctgttctagaccgactatttttccaaatgatgataaagtggtataaaaggtgaacatataaacaaaaccatacataatacattcttgtttggcaaagtaaaaaaataaacaagaaacacctacctgcttcgcatcagccctaaacttctccttcccaacagccattccaactaaacttatacactccatggacttagcacgaagcatacggttagatttgtcggttgcattaaccaatatagccttcaggtatggcattacagcatcataatatttttggaagtgttcctaagaaagaccataataattaaatgagtgatcaaaagaaaataaattataaatgttgattgaacaaagaagttaacaaaatacctgagaagaatcagcaactgatgccaaagcagttaaggcaccttcttgcaccatctgcttaccattctgaaaaatgtatagaaaatccaaaattaattgaaggaagaattacgataatttagcaaaatgaccatcataacattattcttgagattaattctcaataaatatacctgaagaagtacaagtagtttgctaactatcccatccaagtatggcgttaagatatcaggtgtgcagttctcgctgaagttgagaactgctgaagcagcatgtgcctgtgtagacaatattttgagaataattacaccagatagcttatttaattaaaatagcatgacttcaattataaatcataatgactatataagaataaaagaataaatgaaacacacttcataaaattgaagtatatcacaatgcttcacatttgtataataaagtaacattgcagttactgtttgcattgtattttaaataattggcatctttaatgagatgcaaagttcattaaaagaatcacaagactttcaatgcatgttcaagaataaagaatatcacttcaataaaggggcagctaacctgcacacgagggttctgaaaatcatccatggcaccagctagtgctggcaacactccttgatgatatttaacttgcaaatcaggacccaaatcagtagacagctgcccaattgcattaatagctgcccatcttacacgggggtgttggtcagggaaggagttcaggaccatagccaccacttgctccaaattctttatcatgacctgcagcaattaaaagttggtagaaagtcaaaatcacaagtggtacacacaagttattgcccaacaagaaacaaccaatcacaatcatatcaactataactaacacaaatattctaactgccatttacttgtataaaagcaaaaatccacaagaatagttgacatctccgatcaatataatacctttgaacagccctcagcaatctgagcaagtgcaataagtgcagcatgccgtttctgccattctggagcagccaagtaagcaggcaactgttcggacgcaacaggaacaatggtgtttccacccaaagatatagagagcctatccaagcactcttgtcccacgctataattactggtttcaccagcatcctcatcctcagtctcagcactgtgccacgcaggatcatcctcaatatcaagaagcatcttcatgagtatcgcaaacaacctactaataaactgcggcaacttcctcatcatcccgggggcacgctccctcgcctccgcgagagtaatcacaaactcaatcgccaaatgccgagtcccttcctcaagggattcagcctcggcaatctgcaacatggcgccaacgacatccacaagctggcgccggagaaaacgcggctcagtcccggcgagctcgatgagaagctcaagcgcctcctgggcggtggcctcctggccggaattaagcgcctcggtcaacgtccgcatcattgcgggcagcaggtcctggaaccggtcgcgatcggcggaaccggacaaacactggatgaaattgataacggcgttaagcgcggcaattcggacgtcagggttaacggaagcgttcgtgaggcactgcaagaaaatatcgtggaggtgcttgatgtgaggagtgagggaatcgccgatgtactgcgacaactgcgcgaagattaaaaacgcggattcctgaagcttaggggaatcagaggaaacacactggaacatgaaaggaagaagctccggccaggcgttgtcgggtaaaataccggaggcgagttcggagatggtgtcgcagagcttcttggagatggatttgatgttttccgtttgaatcgaggagagaaggagcgatttgagagaagactgcgtgtgaggggagaggcgcggccagaggtaggagtcgtcgcgcgtgagctgtttacggaggaggatggcggacatggcacgcgcctcctggtgcggcgaggagtggaggaggtgtgccagcttcaaggagaggttatcgggttcggtttgcttgcataggttaaacagcgcctccgcgtgggagcgttgctcgttggaggaggacatgaggtgcgagatcaacgtctcaaagggggagggatcggcgccgaggatggcggcgacctgcgattgctgcacctcagaatccatggcggccacgataaagaagaagaagatgagagagcaatgacgagtgagcacgcgcgggttagggtttttgatttatgattatgtgattagagagactagactcgcgtcgccactcttctctctcggggtgtgtgtgtcgttttatatatactgttgcgggtgttggagcgagcgagggagtgttgtgttgtgtgagttgtggtttattgtcataatatataagtgggaaaagggttaggttaccgtgctcagcgagtgggactaattagggcaaccacatgatttttattagctgtgttttgttttttaggtcacggttcatcattagcctacgctttccttacttctttttccccccttgtggcttaattaaattaaatttatgtatgtgaaaatttttgggactctttggggatcaatttaaaatgcgtgtatgattgtttctttttagttaattaattaatggaactatttagaagattaatgtagattttaagttttttctttttattttaaattttgtgtacgaaattcttttttgaagaataaaatggtgagaaatataaaaatacgtaccagtaaaactatctagcatgtgacaaaaaaaataaaatcatccagcatacaaatatcttatctagttctatcggatatgctatataagacccagtcagtaccnnnnnnnnnnnnnnnnnnnnnnnnnnnnnnnnnnnnnnnnnnnnnnnnnnnnnnnnnnnnnnnnnnaaagtttttttttttttttgtgtgtgtttttgagtttgttcctaccctgtattcacactattattttaaatgaaatgatataagcattttaatgtgagaaataagatttttaaaatatatatatagaactaatttatatttttataaattttaaaattaatttaatatttttttgaaattaatttactaatttattacaacagcaacggcaacaaaccttattgaatgagtttataggaatttttaaattttatttcaataaatgtgatataaaaaaattcaataagaaaaattaaggttagaacttagaagttgtctatccaaaacatcaaaatgagtaatctgacttttcagcggatcaagcttaggtttatagggattaatcttatcgtatcatatatccttaattaattcccaaagataagatataatcatatgtgacaagaaagcattactagataagggaataaatatggattataaaaataaaaaatacaacgatttttaaatttaatcaaaatttatattatttttaagattctaattattttataaagccgaaacaaatgcataaaaatttaaaagaataagtgattattttataaaaatatgacactaacaatataaaaagttttaataaactgtagtacttactcacgaggttttatgaaattatacgatttttttttgttttttattcctacactatattcttaattgattgaaaaatatagatgtatattattagtatatattatttactctaatttatatattaaaaatatttatttacttattatgaactctaatgataatataatttatatcttaaaagtatttatttatgtaacatataaaataaaattctgttttttttttaaaggaaaggggtcggaacccactctcaccctcaccccacttccgccagcctcttcaaagtctaaaaagtaatgcatctaaaactgtggaaaaagacggtgtttttgtaaatactatgattactcaaggtaaataattttttaatattaacaacgtatattttttccttaattcatgtttgaagagaaattaccgttaaataacaaacacgaagtcgaatctatacaaacaagcacgagagttacagtccaatacatgctactgcttgcaaccttttcatcggcataatttgttccaagagatggttaatcacaataattgttgtctttaataattgaggctttgggtcacaaggacttttccccctcgtcttttatcttttccctttatttcgggtcgtagggtctttcttttctatttttttaacactgtcttttcaaactaagctacgtgcatacatacgaaatttcagaataatttgagttatttaaaaaaaattaacaaaaaaaaaagtgctaagatgaaaataaaggcggtaaagtttgatacaaggaagtaaagttacaagtgattgacccgtaacataaaatttcatcttttccgtttcaagaaaaaaaatccatgatttttatttttattttaaagtactattttattcggattcatatatcgacgtgttaaatgatatgacattaatatatatatatatgttagtcattttcatcaaccttaatacaaaaaatacggacactactcatttagcagttgaatgattaggtttataagttattgatatatgtttaaattctaatgataatattattacgagttatctacaagttattatgttgttaggtaatagtttatcaagtggctacgaattatctataagtgattgtattgttaggtaattgcttatcaagtgacaattaactatctatagagttgttatgttgttataacaatcccgacaattaagggtattaagctcccgtttgacactataaataatcaagttctaccttcacttttcatttattttcaactcattcacttacttacttgaatgtcgaaatctttttcgcaggtactccactcacgttcctctggtggaggacacatgcaaattcgacataggagatcatggagcccaatttgacgaaaatcaactctaacgtcaatttgctatagattttggtaagtacatttgttgcccaacatggggtcgcagtaaaacttcccctgcaaccacccacattcatggttagcacacgcttcgaccttcggtaagagccactcctagaaaattccaatcctcctccaacgacaacgacagacaatgatgctctccatcaacttcaagcctgcatcgcaaagatggaacgtcgccatgaggaggaactcataaaattgaaggtcgaccatgacaagttggaggctcgtgtgagatgccctcaaaaggacaaacactcctcccacacggtcaatgagcgcacccagggcgaatcgcatcctcatgagaccaacaataccctggatgacaacaacaggtgtccttggtcgaatctccaaacgctcgtcaaaccccaaggtccacccttgatgagtctcgtcaaacctaggacgaacgcgtccctagtcaaatctcccaaggcttgtcaaaatcaaggttcgtccttggtgggtcttgtcacaccaaggacgaacgcgtccttaatcgaatctctaaaggctcatcaaactcaaggtccgcccttggtgaatcttgccacacacaggacgaacacatccctaatcgaatctcaaaggctagacaaactcaaggtccacccttaatgagcctctttgctactaagtttcatgtttcacatgcacccaagacacactcttggtaaacttattcccttgaaaccataacaggcatagtcaaagttcagattaaacacttgttagtgtaactcaagtaagtccccacggccttgggtaagaagctttgtaaagtgaaaaggaagcgtcatcgggttgaacctaacccaagatgattggacaagaccttcaaccagattgaaatcaaacccgagatgatcagatgtcatctcattctctattccatacagacatgccatgtaagaaaaatcgcacctagcgcaaaggaccactctcattattctacgacaagtattaaaggctaaacattaagggaaacacaacctagacattggcctcatcgtcttcctcgccatcaacaatctcttcctcgtcgagaagttgacagacctttacatctttaaacgggtcaaaaagacataggtcaagaccctcagtgaagaacctggcctgcctgatggccttgaagaatccctttttgtgctgctccacaacctccttttcgaacatgagaagtttctcctctagctccttattcgcctatttctcctttgtcgcctcaagctcagactccttcaacctagtttgtaggctggatacagtgagcttcgactcttttagttaggcttagagatcagcaatcaccttgacagattcatctactgtcgtgtgaagtttctccttctcttaaacggagcgctccaccttgctcgtcaagtcattcttttccaataactctttatgacattcgaacacctcgtcaccatccagtcttatgctcaccagcttagcaaagacatcgttgaccctggatgacaactggtagttagacctaacggcttcagcaagggcgacagtagcattggccactatgagtcgttccactcgctactcagttcgagcattgactctccatttggtgaccttagcctccaaggaagaaatcctactcagggcctacttgtgcctttgctccttttcctccaatatagccaggctcctttgaagaaaaacctttgcaacattgattgagtttgcaccccaactaatcgaataagattttgatcaaaaggagaaacaaagtcaacaactatcctttgctcaagtctaaagcccatactccaaagagaattcgcatgtcgagaactatacacatgatccaatgaagcgtttatcttcaaagcgctttctaacggttagaattgtcaaaaacaggagcttctctcataagaacaccagattctacctgaagggacgaaaaacacactcaccttagacaatctatcaattttaacccggacactgtttgtccaagctggggggcttaacaaaccctcaacccctaaatttgtcgaggttaccaccattgacattgaacaacctatttcgccaacaagtttgacttagagctcgggggcttttgtattgtccgtgtccacaaattgacgtgacaagtgcatgacattaaaatatacatgccaacacccttcgtcagccctagtacaggagcaccgacactacttgcttaggagtcaggtgattgagttgataaactattgatataagtttgaattctaatgttaatgttattatcttttttttttatgaattatctataagctgttatgctcttaggtaaccgcttatcaaatgactatgaattatctataagttgttgtgttgttaggtaatcacttatcaattggctatgaattatctatagagttatgttgttataacaaccccaacaatcaagggcttaaggctccatccgacactataaataatccaattctaccttcattttatccattctcagctcactcaatacttacttgagcgtcaaaatcccttgtactcccctctcattcctctggtaaagggcatctacaaatccaacctaagaaatcatggagttcaacttgacgatagtcaaccctaacatcaatctgctccaaattttgataagcacatatacaaaaaataattctttaaacaattttttttatacaaaaacattatttttcacttatttcttttaaaataaataaataacattattttatttatatattttttttctatttctcatctatcgcatttctcttttctaaacaaaagaagccccttacatgttaaaactaaataattgttgacttcttacttgtttcactcgtttggcgtccacatctttacttgtttcactccattttttaatccttgctttcttttttctctatcgtgagtggttttcatcgacatgcacattccttctctttgattctcatttcttctccttcttcccaactcttatgcccccaggaaacttattttgtaagcatgggagtgatcgggaatattcgccaactccctaaaaacttgcttcaatattgttgacttctgtgcatattgatcaaaagctactgcatgatactggcagtttaaaggtctgttatatattgttttgttttgaatttcatgatgtacgtatgattgatataacttttttttttggaaactacgtgtttcattcatttttgtcactcggtattttgtttgcaattgtatgaaaataattagagatctaagagcatatacaagaaaaatgccgttcttcaagtttaaggtcaatgcgtagtttaatagtattacacttattttcagacatgtctatttatctacacatatgtctatcatattaagcgataacatggttaatattcttgcaggcatgcatctaattaaaccatcttgggtacgactgaaatcattttctaaccaccaaaggatgaagggatttttcatttactaatcacaacttattaaattatgtttttcagtatcaaagggtaaaaaagagtcgagccaagcaactaataaagtgaaggagttagagtttttaaggagttggaactttctttaacatttgtgtaagatttgcccgtggattctgaggcaagatatattttttttaatctccatatcatcttaatacgtttttaaatttttttaaatcgataagcagcaataaaccattttttaggacgattttaacaggattgatatttattagttaaaattactcattttttaattttaattttttttaaatatttgttaattttaaaattgattttgattgtaaaactgtgcaggtcgcctcataattctttatttactttttttaacaaagacaaattttttggtggtttagactgaaaattcaatggactttatttcacacggttacaatttcttggtggcttgttcttctatgatatagatagggatgacaatatgggttgggctcgacgggccagcccgtttagccagccaaaaaaggtgaatcggattgaaaatttcagcccattttggaaaatggggcgagccaacccggcccacaaaaaggtgggccaaaggcgggccaactcgacccgcaaaaaatgggctagaggcgggccagcccattttacacttttttgcttttttttggcttttttcttttaaaaaattttttaaaatttttttttggtgggctggcgggctggcctattagtccgccaagccaccttaaaatgggtcgggctaggattttcagcccactttctaaaagtaggccagtccaacccatttttggcgggccagcccatattgccatccatagatatagatcatattttgtactgaaaaatattggttttctcaatgagtggtatttctccctttgctctatatgttagtaaagtatcatttttgtgtagatatatgttttgtttgtaatgactaatatagactgtatgtttaactataggtcatgagcaagattgatgcatggaattttgcttaccttcttcggtgacccattgatcctgtgaactataattagcattggaaaaaggaagctaaaaacgagatagagaaaggaaaaaatgcaactaccacaggttgtaatttttctataaatttttgtataaattcaatatcaataatccatacggggtgtgccgaatcaacgtccaagtccgttttcttagttaagcaccttggaagaaatgaatgtttcgccaccttcgttttagaggaacagcgccccatgtgcttctgactgaactaattccttctttttgtcgggggttttcgcagaattgggttcgactcccatagtcccgcggcattccccctgcggatcgggtgctccgggactcagagcgtctttgactcttggtttttgggctttgccctctctccaaataaaaaatcagtcacttataaactgaattctaagttctaaatataattatatagtgaaaaaggagcagaagatccaatctaaaccagaatgagctttagctctgaatctcaatcttctggagatgtctattttagtacgataaaacttaatttgtatattcattttcatgcgtatagaacttgtatatgtattctttgaatttaattatatggtactatatcaatatttacttgctctcccttagtctccttggaagttgaatatatattagtattacattacattgatactttacataanttttttttttttttttttatggagaaaaaagaatatattgcaagtgcccaatagtgtaattcgtaagtgatgctaagagaaaaccaaaatacccctttaataacaaactgtttataatcgaaaaccaaaaattggcaattaccttgaccttagtttccaaactttagaaaacacaaatttttatccctcctaaaattttcatggcaaggaaaaaaaaagtcactgtgtttcttttttagatttcaggaccaaattaataaaagttgaagtttcagaagtaaaacatattttatccttttaaaatcagatactaattaaaaataaaatatctaataaaataaagaatttattttaataaaagcaattattttaacaaacatttgaataaaatcagatactaagtttcaggggagtttgtttaaacgtattctaaaaaaacaattatttaataaaataaagaatttattttaataaaatgaaatagtgtgtttgtggatggatttgtttaaatttaaaaatatctagaagtggctggttgaaccagctagttacgaagcagcaaatatatatagacacacttaggttcatcactcattgaccgtgccgacgttgaaaccgcgattgaaccgcttccggttctcggagaacgggagagtagctgcctagctgctagctgcacgaatcgattagtgattgtgaagatgcggagagacaacggtgatagctaagataggtatttaattaccattgcatattcaactcttataattttcttcttcgttcataatgaattattctcctacgttcgcagcagaggacatgcttaataggttaagcagacgctgcttttgcaccgttgctccacgcccttggctttttgtggggttgggcaaccctggcgacaagttcaaaggaaccaggcacaatgtacttttccttttacttctgcttctgcttctatttgcagtttgtttcaagtttttgttatcaacatcaaattgcatagaaagtgttctgtagtgtaaagggggtatagttagttttgaattagcagttttgtggtgaaatatgaaaatatgttttttttttttttggtctgaattaggttggctttgagatgattgatgcatttgctgagtcacaggggattcctatggacactgtccattccaaagccatttctggaaaaggtttatctgctgttctctgtttctcttttgatgtttcttgtaattcatgaattttattaggcaaggtggtggtttgttacaggttttgttggtgaagttcctgtttttcttgcaaagcctcaaacttacatgaatctcagtggtgaatcggtaaggaattaagatgtgctgccttttgttttttctctcaaccatctagatattttgctttagtttctacaagttgtttcatctagatacgttttggtcattttgaagaattgtagttgccttagtgtgttttggggttattttagtattagattatcccttttgttgcaggtgtttttgtgcatggaatttcctgggagagtcttggggcagttgtgatggttaagttttctgtgttttctccgtagttttttgtggtttcttataggggattttactttgtgttccttcatctctgtgaattgacttatgtttttttttttggaaaatcttttcatacatgatagagtaaggttatagtcattgtggaaaggagtatcattcagattagagaataatgaagggaataagaaaatgctgggaagtagggaaacatagcttcttacaaatctcctgtggattaataattctttggtcagatagaggtccttattgaatgctattaatccccttcccctttttcatacaaaaccaaggagaagaggattgaaagatggccatcatgaccatggctgattggttcatctttcatttctgcttttactggttttatactaatatggattccatggcaggtttctgtgtttgtggtagcacgcaaatggtttcatttacttgtttgttgatgtttagcttacatataaagcctcaggcttattatcaatatatgttttactgcagacaggaccaatggctgcttattataagctacctcttaatcaggtgcttgtggtgagttattccatatcgtaccttttcttttaagtatctaatcagtgataggtgtgcgctgtttctttatttaatcatgtattttttgttgcagttccatgatgacatgaacttgccttgtggggtgcttcgtcttcatgacaaagggggtcatggaagccacaaagggtacaacattaaatgataattgtgaagcaaaattactattatttccatccttaagtttttttttactctgatcataagaaacttgttgctaattcaagtgcctactcctctaaactctataaagatttatggtgtttattacgcataattagattgtgtaattcactaattccagaacccaataagtatctgtcttgaacttaacatgtagatgttattggagtcctattccaataaccaacattttggaagtttattctaccttttgttataataagaagatgaggacagactaagaagatgtaataagccaaattagttaacattgtgagagtcctgattaggttgtatattggtttgtggtttgagggaaaaaattccattacttataaacgtttccccctcaatcatacattgattggaactagatatagattggaaaaaaataaaagaactgatatatattgaaggatccccttacaaccaacagagtaatcttctgttacagtatattagcagaaagcaagaaactacaggaaacaaatgacaatgaatggagcaagctccttacaatatggcaaataggaattaggataaaaaagaaatggtaacacccagtgactgataaatgataagttcctctgctcagactaacaaaccccaacataacccttcggaaattctctcattccttctatttggttgcaccttcctttaaataatcattctctctctacttgcctgattctctgcttcctgcattccctcctccattctcaatgccacctgtttattctgttattccccctctctccttccaatccctcgtgtcacatttttcattttttccttctctcatatatacccacaggccttgattttcgggcccactttccttttccttcaccttcttagttcttatatacaccagcctcctgtaagttttatgcccgtgcctaattcttaaaagcttgttccagtccatctggaattaaaaaacagtttttcctgacatttattgttgctatccaattgcttattgaaactatgggaaatgccttctttgcccatttaaagtaggtttaattatcaatttggtccccaaatttttaaaaggttcaatttggttctcaagtttttaaaaattaatcaatttggtctccaaattattttaaatggttcaatttgatcctcaagatcttaaaaatttgagaaccaaattgattcatttttaagaatttgaggaccaaattgattcatttttaagaatttgaggaccaaattgattcatttttaagaacttgaggactaaattaaatcttttaaaaatttagggaccaacttgattcattttttattgaagaccatattgaaccttttagaaatttgaggaccaaattgataattaagcctttaaagtattgaaaaaactaatgattgcaatattatagattatttcaattctattatggacccgtgcggagttatccatgactccaattgtggttgtttggaatttaaatggttagaaaaaatgcataccagcgagagtttatatcaagaaccctgttactcaaagaaatgctctcaatagttgatggttatctttcagtaaatgaacatctattagtactttgtatggaaacttaatcatatagtcattcttcatagtttttctttatctattcatggtggatatatagcttcacaattattcactacattttcacttttcaaggggccatatattgtcatatctgtgatgcttcactgttttaggtaaaaaggaaagtaatttttatgaagtggctgaaaaagccttgtttaatttagaaataagaatacacaaattgaaagaattactttcaattcaaatgaagaaaaaagttgtttcgaaagcatatcaattgctaagattcgaagaaaaaattattactttatatgaatacactaaggatcactatgagcgtgtttataattcaataatattttttataagtggtgatagtctgatggaaaatgagttcatgaaatctttttagctctgatattttcttgttaagtgcttctcgaataccactactcatcttgtacatggtcctcacttctcactgaaccaggctgaagagtgtgatctatcacttcagaggaaatagagaatttcctaggctgagaattggttggtacttatgttgcaaatcctttattctttccctagtttagattattgatgtaatccttattttcaatttgctttgtcattagggattgggagtcctcctgggcaaatggatcctaaagcatttttgcttcaaaagtttaatgtaacagctaggcaacgagtaagttcttcatttactgttaaattcacttttggagttttggttcctcgtgtaatgaaagtttcaatttggttccaatggttcaaattgcagttcaaatataatgggaaaaatgagtggcattgtggtgatgtggtgccaagaggggatggtgtgtggcttcgctatggggtgtgaaaaaatgtcaaatatgattgcagttacttgtctcgttagtgcaatgtcataaatatatgctaatagtcccatttgagaatgaatatactgaactagaaaattcaagggcaaggtttttgcaatggagccatagttattaataccatgagatatgtgtagaggcaataagcaccaccatgaagaggcacactaccccacttctatattatagcaaatatttttacattgggctacatgcactatattgaaaactggccaagtcaataaaaaaatctttatctcagtgatgcttcttgttttttcttgttggacagattgatgaggctttgcaagagggggttgatgtcttgaagctccttttatctaaaggtttggcagtgagtgcaaaaagattcaacaaagaacaaaagtataagcacttaagagtgcagaatttaccagtttgataggattccgtgatggaaagttgcattataagtctgattagttcttcgctttataggttgcaatacgtgtaaaacttaagcgataggaaattggcttaattttgtaacattccagagatagatataacttttaaaatggtttatgaccaacttttttccatcttgatttgttttaatttggatactgtgtctgtaatgtgcattttgcaccgagtgcacaagggtgggataactgatcacgcattaaagtattggtaaattgtgtatagtgtataaacttggtgaaaggggcatctttcaaagtagcatgtaccttttcccgccgagggaaattgttattgataatcgtaatcggagatgcgttatatggtatgaatcatagagtagatagggaaatgtgatatgcagttaaatggggataattcctcaaaatttaatccaagatattcgacttgggtgtaactagaaaatgaagatcagggacttaaattatactttatttcactagctatgtatgtgtcttgatatggatgttagttaggcggtacaaatacctggataaggacaggaaaataaagtatttagaggattgatcatctatcagcattatacttgagttttaaagccatgggccggtgttaaataatttggttggtaaaccatcactcatgctacttgatttattagttgtctttaactaatttcttgtgattctttttatcttgacttttggaagccatttcaggcctgaacattttgtcttgagctaagtttgatttttagtttgattttttatatatttgatttgatgcttgccgtagctaattcaaatttaaaataataaactatacggctaaagattatatgaatttattatcatatgaaataacaataaatatatttaatcacagttaatttttaacaaactgaatattcactaaaattgaactttgcgtccctaaaattcgatccaatcggtttcataagctccatgttttgtttatcacgctgcataacgttatgggccgaataagatattaaaggatttacagtagccagctgttctaagatccaaccatcatgctggaaaattcagaaattcaacaatgtgacgagtagaaaatttccatgtgctccacgtcctaaaggtaccttataaaaaaaataattgacagatttgattttccgtagtaccatatgttttaggattcctcatatttattgtagttatgtttaggattcctcagcagtaatggttcatttatgatgaaatactatagccacaggcaaaataaatgagtacccaccatcattttaaaaaaataaacagatggcataacatgttttatgagatacaacgtgcagatcctttagccattttgtactttttctttggttcttttcaaaagaaaattttatgttgtttgatttattttatatcttcattttcaacattgttactagtaactataaaaatgccatcttatttttattgtgtatattttcaaatattttattttcatcattttccccacaaaatcataaagttaatgtgatttttttataactatcaatgaaaacatatatagcaacagaaaatgaagacaacaaataaatcaaacactacttcgaacttgtttcatttaaggaaatattttttccattctctaataaatattaaaaatatcactattttatttaaaaaaataaaaaaaatggtgaaatcaacactaaaaagtaagaacaatcaaaccaaacaccaatattttgagtaaaaatgatcacatggaatccattatggggtgatgagaatacgaaaaatattagttttgattgaaacaactaactcgcgtcattgtattgtcaagctgtgtatgttgatccagcccatgcagtcatgaaagcctaattaatgcctagtgttgtccgatagcaaattggggacggtacagatggtaggtggtttcttttgtgcatgaatcatatatatacatatatgccagcttgttcatttggtgtggtttatttatagttgaccctatctcgtgacttgtgagttttttagcctttaggctctagcgcaaatcacttcctaaatcctagctccttgtgattttctaacaaccttttcgagaaaattacaatttataattgttaaacaattaactcgttttgggatctaggattaaagtaatgttatagtttggtcaaagctttatagctctttggtggcattgggcttggttacaaatagctcattacattactacaagcaaatgctataaaggatcacatgctgcctgcaatattaatctagtgaggaaattatctgttgatcacctacgaccatttatttaacatttgatttgttatacattcatagtttaattataaacatgaattaatgttgaattattctgaatagcattttttttctttcactttaatttggagagcatcacaaacacggttatatatgtaactcgggattttggaccattcgttaattagagttacaaatatcattggacaattattgacgaacatataattggctcaatgtttatttaattcaaccactgacatagtgacatgtttctgcttgctttagctgtaggtgtttgcaaaatcatataacctgctccttgatttgctatttcgcctccacgcatgacttacacgatcaacaagcatgcatggcgtgctacattattaatttcatgtcttatttttttcgttgatcgtgtccttttatgacgttaaatctaatctaatctaattattaaattttaagtacttacatagataatttgattaagcaataattcttatgctcttaatttccttttatgtcacatacatatgttctgttcctctcccacacacagaaattccatacatggaattaattgcatagcactgttgcaacttgaaatttgccaaatagcaagcagcatcacatgttgatttctacttctacatgtcaatcatcgaaagcaccttattatacaaggtcacacacactaaggcacgcgctatgtgaaaatacttgatcattaagtaacttgtaattatttaactagtggttgaccttaaatttttgcactaaacacttgtcaactccactctcaaacaaatgggagaaaaatacaaagaagtttatgtataaacgtgtatatatatctcactatatatgccagtatcataatcagtgatctagatccttatttctagctgtgacacacagatcagaccaaacacaagtcaaacatgaaacatggacacacatttcaagcaacttcgtggctgcttcctcactttcatttaaaatttggttcaatttttttgtgaaagtggcaaatcgcataaaagaccaagtcaccgacttgtctcacaaggatcatggacctactatatatacacagatacggtttggtgacaggcagaaagaacttgaaaaaaacgagagaaaatggaagaattggaattccttgattgatcgaatcaagtttttttgtttagatatttcgttgaaactataaaataagttacaatgtattataagaaaaatgactaaaaagtttacagaaaatacatgtgtgcgcgcgtgtaagtttttagaacatgaattgcattttttatttcgcattggagatccaagtttaaaattgattttatatataatatgtttggaattatggtgaagacgtggtttttcacgtcaatttgatacgtgtatccatatacacataatttttttatatattttgatttcacgtgaaaaataatttaaaattgattttaaatttaaacaattttaagtaagtttttacattcgatgaaaaattttatattgagttctattatcttaatttgtttttataataaaaatatacaaacataaatcatactgttacaaaattaattttgttggcacaaaagcttaattccaaaatcacgtacattagtatttgagacgaagatatcaatgttgtgtatatagttgatatatctattttctaaatatatgattagaaatttgatcatcaaatttgttgtgtataaagaatatatgtactgaaagattaacctcttaaataagtttaatacattaagaaattagtctaccacttttcattagaaaaatatcttatgttaaaaaaatattgggatggataagcataatttataattattattttgaattttggtaagttacttttctgattatttgacgggttcaagatatatactatgttaggttgtcaggttggtcaatattaatgctcaaaagtgttaacaaagaccagacaaaaaaacgaattatttggtaaaaaaaataaaggacgacgtggacctagaaagaaagagagattacagtgaggttgctacttttgaatttgcatactttttgttcaactgtgttgacaattgaccctaaaattcttgcttgacaagtatacactatagggggcaggggcatgcatcagttttgaaaatttgcttcggcaataacaagtggcacgaaaatgagagttgaaaaatggtgccaacaatttagcagcaagaggatctggtgggtcatttactcatttctattgtctctactagttgtaattaaagtactaaagtatattcataaaagtggttgatggaacccaaaactaatgtatactttattgaaccatataaaaaaaactaaagttaattgagcaaattctatagtcactttgtgtgtacatgactattaaactgctgttaggttaaataacaaatattcatttacagacaactaaattagtaggaaaccgttgtaccttcaactatgtaaactgtacagttataactttatacatgtaacgtaggttttagttgacaattatcatttgtttaaaacaaacgtcggacccaattaagagtaaaagagatatataggttgattgtttaagccttttttttaaaaaaaaattaaaaacacagaatatcaaagttattttaattaattttaatcttaatcatttgtgtgaattatattcttgaatttgctctttttgtatgctgcatttatcatgtgatacattttctatatatacatgtgtgttgattgttaagatcaaattacttcaaatgtaatttttcnnnnnnnnnnnnnnnnnnnnnnnnnnnnnnnnnnnnnnnnnnnnnnnnnnnnnnnnnnnnnnnntatatatatatatatatatatatatatatatatatatatcatttttatgcatgtaaaagcactttgaattgacagcgaaatactaaacaaacacgattggttgaaaacaatttgagattctttgtggaaggtggttgagaattgagagtggaattaattaaaactgtctttactgatccagcttcaacaggacagacacgtctttaacttttgatcttttatccctcccaacatttaagnattatatatatatatatatatatatatatatatatatatatataaaataatggccaagataaaagaaggaaatgtgtgaataaaaatatttcaactgttgacatgtgtttagctagttaaaactttgttttaatatataagaaaaaaagtatgatttggtatttttaaatgaataaattcttaaaaattatttttctattaaattaggtaacttcttttatattaaggatactattcatttttttcaaatgttgttattggagtttaattgaaatataatttaaatatgtattgaattttaagttttaaatctcgactctctatattaaattcataaagataatgattatgcacccatacattatttcgatcaaattaaaatatgtattgaacttttaagttttaaatctcgactctttattttatcataatttagtgttgatatatatatttttattttttagtttccttcaaatttataaaaacatatgtactaatacagaaaatagttaggtatgcattttcgttaatatcactccataaattacttcgcctatgaagtaccgttttttaaaaattaagcactagacatataattaaaatacatttatgagcatagttatctctagatcatagttatgaatgaaaatgcatttgtgatctaattaattttgatataggtttgttgataaaatctatctgaatatataattaattgaattcacaatacataaattggttcaccttttataatcagctacttgtataaacaaattatgattggttatttaaaattgtccaaaaactcaatactagtgaatattaatatctacctctaaatttatatttaactctggattttactcacacggttatatatcgccaactggcaacaaagatataacgtgcgcgtatattggagtatatcgattaattaataaaagttttattattccctttacctgccgccattgttactattttttcttcgcattgtattcaacattaatattttgtcgtagattacatcaaacctcgaagcatcggagtgacgttttgcttctctgaccacatcaactgagaaacgaataaataaaaggtgtcacacatttcaaggcaaaaactcgtgtaccctacgtcttttttttatgatttttttaattactttacatatttcttttacaaaaatttagttaatttagtcaaagatattaaattaatgaatctgtcaataacttataattttattttaaaattattcttacttttttttatcaattatctctctcttttctcaactaatcattatttttatttttatcggtaggattcaagaaaatataaggttaataataatacgttagatttttttaatctaatggttacttttttcccaaaataagtactgtcttgtgttatttaatatatatcaagaaaaattaataaactataaataaataaaagagtaataattttataaaactagtcttaaggaattgaaataaaatatttattatgtaaatcacaaaagagtgtaaaaaaatcatagattttaccctacttcaatgacaattgtttaccattctatttggttctactcatccgtatctaattccaattgtttaacgctacaaacaaccctatcaagtcattggtacacgataaatttaatatgtttttttaaggcgataagtttactgtgctaatatatagtctagtttcataacttagttaataattagcaagacgttttagttatttatttctgttatgagtcgttgaaatggttggggaagaaattcaatgtaaggagtcctattaattactagagaaaactaagatatatgttttgattatactttcgttcgtatgaacttaagataaatataaaaagaaatttacagtaaattacatattttatttaataaattgaattagacttttttaattatatatttcttttgtcactaattataaaattcattttataaaataatttttaaatttttagatacaacaattatttttctctatatatcttcacttaattattctttcttaaatattaataaaaaataattaagtggatagaaaaataaataataataaaattaattgacatatttaaaataatattttttatgagacgtgaattacattagacataataattccgaagacaaaaatagaggtatggtttgggcggcggtagaagataaagataacgtagaatggaatcagaagcaaatccaaccaacgtcaaacaaatgaattaatgactgggggttgctagtgtttgacttttgggttatttatttatggtgtttggaagccacaaaacttttcgtacggtcaaaacactcgaaacacgtacaaaaaaaagaaaaaaactcacctacaaacgtttgagtcggtgttacgcgttggggtcttattttattcttctttcttttcttttcagtttcatttcagagtttacattggggaccaacaaaagttgataaatagcacattcattccaaaacaaaatatgagtttaatttttattgttaatataagaattttcgttactgataatttataagtatttttataaatatttaaactatgagtttagttcctattattaatataagaatttcgtactcataatttataaatatttttataaatgtttaatgaccttattgagacttactataaccataatgaatcctttatatccaagggagggaaacttattttttttttttaaaaaaaaaagagttcacattagtggcatggctagtagtgaccggtgaatcagtagaaaagtagtgagcaaaacataagaaaaatcgatgacactttataggccagctggcattatttaattgagaaacatgcactacagctacgttctcgtttggtggccgattctttatgtgcttttattcctcatcttaaaatcccatcctctatacgacgtcaccgttatatgtgttctcattccttacctcacattcctatatgctatagtttctattcttaattttatgtgcgacaactacttatatgtaactagtatattgatcagtattacgtatttactcctgatttattcattaagaaaaataggtggtacgcatgtatgatttatcaatctatttcatgtcttttgtaagatgagaataaaaaacaatcaataatgagcagtttttcgaataaattataattatatgtaaaaaatgaattggtggaaattttatcttttatatattaaaatggatatttgatatatttatatataagtttaattatatatggaaataattcaataagtaatatataattaaactaatataaataattcaatggtgataattttttaaaaattatttattattattaatttaaaattatatatgaaattatatatcaaaattttcatttttaattatctatatttatatcattattaattaatgatgatgatttgaaaatatatatatatatagacaccttttattaccatggatattttattttatattagtttgaatttaattaaaatataatttaaattcaatatgaatttaaagttttttttatacaataacagaaatgaaaatcaaacttaagttttcatgcatttacccaactcctcacaactaatttttttttcaatttcatccatatgatatgataaccatgcatgtatgtgtcctaatcggctactacttagacacttaacatgcatgctaatttagttttttattttctttttttaaagacgcgaagctgaccccattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataattaattatcaaatataatgaaatgattgatttttataataattatatatatatgataattttaaattagttaatggtgtaaaaaaattatactgaaaatgtataaaattaaaattttatatttaaataataatatttaaaacaaacatttttctttcatttcttaaactaacattttaaaaaataattttttattttcaggttacatataagactctaaacaaaacatacattgtgttttttatacacaacatacattgtgtttagattggcgtttggttgttttactcttaccatgattttcaatcatacttgaaaatacatgaaagaaaattttagggtgaacgaaaaaaaaaatgataaactaggataagtaaaaaataatgtgaagataaagatatttgatttaagaaaaaaataaaaacagatgcatgtaaataaatgaacaaaacaggttaaaaataacaagtttcagatttttaaatttatatctttgtcatctcttctctcataaacacatttatctttttatttctgacttatttttttcactgtttttcccccaccgaacaaaacataagatattacacctgattttcaaacacgcacgtagtaacgtagtaacatacaatacaatgtacgtaaagcaaattttcttattacatcaaagcaaaacatacgatacaatgtaaaagggacagcagaaactggcgacgagattttgtggtctgggggaacggtacggtgctaccaaatgatggtggcagcgcagcgtggcccactctgcattcgacacgtgcacatccatgtactcctcttgtacgcgatgcatggagatctgaaatatgacagttggaagtgacaatgctttgtccatctaatctaattatcatcatttcactacttttttttaagagaaaaaacgtatctatctattttataataattctgatttcattcaaatttattttattattttggtcaatttgaataaaaaattcatttctgcataaagtttattcttaaaatattcagcgttaccttttaagaacagacacaagtgcaaagaaattggcttactggcttagcttagttttccttagtttcggtttgacttacaggtgtattcagggtatatactttttctaaattatttaaatatattttttttatttctggtatatatttagattttacgttgatcttttaataaaaaaaatttccgcatctgcatcttgatatttttaaaaaattgttttaatctttattatcaattaagtaataatataccaattaaatatttgatagcataatttatgattttttaaaaaacattaatatttgttaaaaaattaaattatttttttgacggttaaaaaccgtcataatcaattaaagttagaaaatgaataaaacatacattgtgaatcctccttttctagctctcatcttccacttctgtcacccatcactcccttccccatacttctccccttcccaattcctcgacctcctttgcctcttcctcggtccagcccaactactagatccacccctccatcttcctgtgctcctccgccaactcgactgcactgactccttcgactcaatgcttaccttcctctgccaaatgcactcctccaaaatcctcatcgacgagtccaccgccctcatcttcctcaagacctatgccacctcccaccacctacacggcgaaatcgaccccctcttcctcatcatggagtgcgacatcgccatcaaacctgacacgcacttcaacaactttgccctcagcctctttgtcaaagccaacaagctcaggctcgtcaaaacgctccactctgacgctgtttcacacgacgtctccactttcaacatcttaattagggctttatgcaaggtcccttagcttcatcccgtgattcttatgcttgagcaaatgcccaactacaacaggggaaggcacgtgtgggaatttggcgttcgagatctgggacatgcgactgcaacgacgaaagtccacagtggtggtggagtgggggcccactgcagatcaacaccgacagagacaaagaggacacataagtggttgaaggcagcgacacaaaacataagtgattgaaggcagcgacacagagaaggaggtggtcgcggaaaaggaggggggagaagaccttccctttaaaaagttgagattttttttattattatttaaacaatatttgttttgaaacaaatactgatgatttttgagtcatcacaaatcgcgttatcaaatatttaatggacacgtaattacttaactgacaacataaatctaaaacaaaattttcaaatattgggaagcaaatacgaaatttttttttatcaaggattaaacacaaaattcaaatataaataagagaccccctccctccagtgatgcacgtggaagcatgtcaaatgtctatgaattttttagattttggtttggaagagaatgactgatcaatgagggaaatataaagtattcctatattggattaaaatcaatggtcttcatttgtaaagctaagctggttcagttcaattaggatttaggagtaattcattatactaactatctaattataatgttattaaatccttttattatggttcagacttcataacgtctagtatattttatcctaatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtagtaccattttttggttgtcgttacttgtaagcaaaacaatcaaggtaaatagcagtaaaaagaaaaagcaatcaacgtaaaacatcattataaactctataatgattgttttttaaatttattttaaatatgctaataatttatagaaatgaaaacatatttgtttatgatttttttgtacaaaatgcaattatttaaatcgaatatcacattcgggagagacaattatagagagttatgttgtctacaaaattgtgcaaattgacacagttattcttcctttttcttttattcaaccgttattcttcctttatacataaaatttcgtataattaaatcatcaaggtaatgcatggaatttctactagtaattactattttattctatttatttatttattttataaaaaattatttatgttaaaatatgtcttgatccgggcctacaaatttaatttgtatatataatgtattatattcaacattaaatataattaggctataaaattatatttaaaatatattttacaatatatattttaaaataaatntaatttgtatatataatgtattatattcaacattagatataattaggctataaaattagatttaaaatatattttacaatatttattttaaataaataatattaatatgaatataatatcatgttatgtaaaatattaattaagtcaatacatttcattaataatatataattgttaataaaaaaataaattttaaacaatatataattttggatcaaattgaactaattcatcaaaagatattttaagtttatttttaaaatttaaattcgttcaaactactttaaactaaaatagattaatgtgtcagtgccgaatgtgaacgttcctcgctcgatcatttattgaagatatagatcttgtggtttgaattatcgtcatacatagtttttattgaatctgaaatggtaatatgtgctggcttgatagatatacttgtaattttttaaaataggaaaagaatcagaagaataaatcaaatgaccgaaagatgaaacataaacacgtagattcccaacgtatgtttccttaattaccacctaaagcagtccttttcaattttcatattaaaaaaacagaagagggaagagttagtttaattatatatttatatattatcttctcaccaacttatgcatatgctgtacaccactttccaacaccgtaagtttgcatacccaattattataatgccaatgtctaatttcaattttggcaggaaattgatagtatacttggtttagtttttttaaaaatgtttttttttccatttttttaaataactataaaaagtaattatttatttaataaaaacgccaaaacatttagacttgtaatcatataaaatattttacaaataaactgtttgttataatttttattagaataaattaataatgttattaattattaaataaatgaacaattcttgtcagtttaacttattcagtaaatactttaaattttaacgaatttcacttcatttttgttctatttaccattgcattttgcaacattagtaatcataaatattacttagtttgttttatattatacatgctttacacatacgtacccatgcttaacataccgtatgaagtgtaaagggctatacgtgacaaagtcttaaaaggcaaatcatcaagctaacgataatcaaacggtgtaaatggatttaataataataataataataataataataataataataataataagcctgattatagattttttttacaaaaaatataaatattattataaaaaattattaaatggaaagatgccataatcatatataattataatttaattcagttacgattatatgaccatattgcaaacaatgacattcacaaatcacgatgatattgcaataaaaaaaaactataactaatttcctgttgattatatgaatttatttttcttaacctcctattttttaaatttgtggaaataacaaatgtaacaatactttatacaatttctaatatagtgaggactaaggatagcaaaattaattataattcatcaccatgtgagataaagttttattcatttaatattttctcttacagataatatatgctgtgtatttaaagagctaacatggggttgatcccttttgactatttggcctgctagcaaaaagactttttgttgctactaataagccaatgatacaatacaagttcaagtttagagcctgtgggacatcctgatctcattacaaggaaagttccaactttttagctttcacatccccaaacacaatttcaaattgataactttgtatgcacctcaaattaacaatcttttttaaggtacagtacgcaatgaacatataaaaaattgcaacatttttcgttagcaatgagctccttatatactctttaccaaatcagccacagcaggcagaaagttcataagccacgaattcaattagatatatgcaaattaatggttagctttggaataattgacaagtgtttggtggttaaaatacttaaactacgtaacgtactaccccttcgagggagtaggaattatctgagatgacataagcagtttggaattaatggttgattttgctaaagtcaatctcgttctcacttggaacggattgaagtttacttcaagacatggtcatgaaaatgacccctcatagaaaggaggaactagaaagcgaggattatttcctagaaaattatccacaatttcattggaggttaatatgttataaaagaaaaatccccgcaagtcaaatcaaataactttttttatttttttatgtacattaactcataaaacgcccaaaaaataaaatagacacactaattgttacaatataatactaaaaaacatatcaataattaacaataataatttataaataaactatttgtgaatgttatacaaagaatgcagatgaaagaaaaaacgtatataaagtagaaagaaaaattcagagaaaaaatataaataaataaaagataattacaaaaaaaattaattaagaaactctgattttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttctccttgaaatttcattgttaaagaatgtgattttatttaaaaaaatattattaatgtccacttaatgcttcaaatataaatttactaacattatgaagcttattttcttaattggacagtcaagaaagtgtacgtttaattgacaaaaaaagtctaaataagatagaccgaaatatactccaaactcaaatataagcgaaaaaatttaattcatagtaattaacaaaataagttaacatcatttaattttgatagtctcactataaaaatgaatttgttttttnnnnnnnnnnnnnnnnnnnnnnnnnnnnnnnnnnnnnnnnnnnnnnnnnnnnnnnnnnnnnnnttttgtttattttgttttagtccttttaatatatatctatttttttattttattccttacaaaatttcttcattttatattaattcttttgaaaaacatttgataaggactaataacaaatgatctatatatattatagagataaaaatgaatatatatatatatataaaggattaaaacaaaataataaaaattaaaaaatatatatttttgttttatttggaactcaaacacaaaaataattttattaaagattaaaataaaatttgttaatttatcgaaaaacaaacacctaatttattagtaccatctaaaatcatggaactaaatttaatcaaaaaataaattaaatgatcaaattgaaaaaataaattaaataacaaacatagtaattaaacctggaaattaaaaggataattgccccacaatcattttttaaaaaagaaaattttatttctatattttatagattcatttttttaggaaaagttatcttataagacaatacctattttttggtggggtcaattttttttattatgcatatacaaataaaaaaaaattcttatgagataattgccctcacaccctccacgtgcatccgccagtgtgagtgcagattaacactactcttattgtatttagagtgaaagtttaatttgacatttttatttttgtattaatattttattttagttaatttttgcgacaaatgaatctaaccttctgttgaaaggattttaaggacatacacataagtcagaagtgaatttagtagtacatataatgaaattattattatttaaataaggctaaaaattaaatttttttgtaactattatctcacttcaaatttaaacgatacataaaaactgagtacaagttcacaactaataaaatcaacaatttgagtttctaaaaaaagaaaagaaattaaaataagggtacaggtcatgtcatgggtctgttggtaaagaagccacataccaaaccatggtctttataaaaataaagggaaaataatcccaaaaccaaaacagaagaaaaaaaaaaaaggaatttgagtatacttgttcgactccacatggttggaaagtggaaacactgtttctttctctctctacttcctatctcacactttctcttcatatcttattcttctcctcctaacatgtataaatatgttaagtgattaatagcaaaggatcccattaactttgttaataagtgcaagttagctacttagttcaattttcctgcaccaacatttcaaacactatcatatcatatcatatcttaccattaactcaaagtaacagtgttccattaagattttctcatctcatcaaccccattacagattcttctcttttctccttcctggttttcgaatcttcaggtactctaccacccttcatcaactcactcttcattttccttttgcttttaagaatctattttaatatgtttgtttctttttatggaataaatgatatgtatatccatttctgcatattgcatactgtgctgaatgtttgaatgctatgctattctacccaatctaactaaatatccgtgaagaaaaagaaatatgatttttttattcatgttttggtgatttttttttagatccttgctcttctttaactgggattatctgtgatattttgatttctgttgtttggtttgtttggaatctgtttaagagaatgaaatgggatttccttggtactgtgtttcaggttctcctttcatggatatgagactgttttcttggatttttctttaaaaatgggagtttagctaatgggttttgcggatccgtgatccttttgtttctgatggttttgctgcagcatagaatttgagttcttgttgatcagttcgatgaggattacggtgctgctgttcctgcctagatgataataaatagaacaatgcattctaaaaaatgggtcttaagaattttatttttctattttttttttatttccaacattcatttatcttgatgtaaattgtgtggttgtgatgtgagtacggtctgaatttgatggctttggaacctttgtatttcgaattattgttcttagcattgatgtacgtattccatccagtttgacacatgaaaaattcatcatcttgtactttaatattgactttgcaattttcaggaccacggattgcacaagtttctgcagattggttttgctgtcatatggggatttccttctcatgtccatttgccaagtacaatgatgtggaagatggcttagactccgttgttgtaaaatccatcaactttggcaatgatgaaatcaaaactccaatgcgatcggtcagtttcaagaacgaagatttagaacccaccatccttaaatctctaggttctggaaagatgacaatagaggcatctgtgagcttcaaaagaaaggacattgataacattatctcaaccaacactttgtcatttgacaaagaggaaaacatgcctatctcaaggactagcaaaaagagcaaagaaatggatgatcttccttttaagtcagagtgtcaagtggaaaccatccaatcagcacttctaaatccaaacagccccaaacacattgcagcacttaaattgcagaaagtatacaagagctttcgcactagaagaaagctagcagattgtgcaattcttgttgaacaaagctggtactttttttatttgcctgagaatctctttccttctttacaaaatttcatgtgtttttgacatgttttaatctttaattttataggtggaagctcttggattttgctgaactcaagcgcagctccatatctttctttgagattgagaaacatgaaaccgcggtttcgcgttggtctagagccagaactagagctgctaaggtactttaacataattagctttggaagggtaataatggtgattattgaaggttaataccttcaataactactatgctctaccttgctagttcaaactttcaagctgcaagaaactgaattaaaatttgctctgtcattgcaggttggaaaaggtttatcaaaagatgataaagctcaaaaacttgctttacagcactggcttgaagcggttagtcaaacatggctgctctagcttttttttttctgcttatgtatcggtctgttagtcattcatcaatttttacttactgagttttttttactgtgtgatagattgacccacgccatcgctatggacataatctacacttctattacgataggtggcttcagtgtcagagcagagaaccctttttctactggtaacattctttgtaaaatatatttctgagttacaacttatatttctcctatatagatcttaagtcacatgtgtttgaaattaagcttctttgaaattgcaggttagatataggagaaggaaaagaagtaaatcttgagaagtgccctcgttccaaacttcaacagcagtgcattaaatatcttggtccggtaaggtttccgcaatttatacaaacatctcttgatagacaaatttgctggagattctttgatttcaattgttattaactgttttcattttatgttcttacagatggaaaggctggcttatgaagttattgtggaagatggaaagttcttctacaagcagacaggagagctccttaacactggagaagatgcacatgccaagtggatttttgtccttagcacatctaagacattgtatgttggcaagaagacaaaaggttcatttcagcattctagcttcttggctggaggagccacatcttctgctgggagactagtgattgaaaatggtgtcttgaaggtacaaatctggcataaggcttgtaaatatattactcttttactggattcttatagccatagatgactactttttttttatttttattttatatgctcagaaaatgagtttgttgtttcttttcaacaggctgtttggcctcacagtggtcattatcgtccgacagaagaaaattttaaggaatttatttcattccttcaggagaacaatgtgagcctttcagatgtcaaggtatagatacttagaaccattgctttacattactttagtattgtttgtaatggtttataatttagatctgtaattacaagatgtgaaacaatatattctgaggaaattcattttgttatatgcagatggatccagttgatgaggctgatgacttgctttctctgagaagtagtggtcatcttagaagccactcatctgaagaggacttcactgagaacatgaatggcctggagattgaagagaccattattgaaggctcagttgcagcagagaaggccaatttgatcgaaaccgagaggtcttctgcactgatggcaccttgcacaaggcaatttcaaattcttggaagagaactgagcaatctagaaataccaaaaaggggtcatgtgtttgaaggactagaaaatgagatagaagggagtgaccaaagctgtgtgagtatccaaatggaatctcaagaaacaaaacaagcatttgtaccagagctggaccatacaaattcagagaaaaacttatctgatgacaatgatgtagaaaccattccacaagagtccatactaaaaagaatcaattcacataaagaaatgaaatcatatcaactggggaagcagttgtcttgcaaatggacaaccggagcggggccacgcattggctgtgtgagagactacccttgtgagcttcagttccgagctttggagcaagttaatctgtctccaagaagtggatcccgctctaaatcatcctttgctcctagaagcaccactttgttgagctctagtctttcaaatgtagcaagtctgtctggggacttaacaattgaaccacttcacatgcctcatagaggtgagtccaatagttcaagatcagaatgctcccctttgatcagaggatcatcagtgataccagttattcatagttcatgagtgaataggattctccattgttttattcttttttgtgtcaataggtaaccaattaatatatgtatttttgttattctttccattgatgcacacaggcatttttttttcactcatgtatagtattataggatcaaaactcagaagtgtaaaattattttgggatttatttatcctcccaatacaaaggaaacatttgatcttccaccatgcaacaagttcatgggttcaattcaaatatatctatttatagttaatatattgaaggtttattgatgatgcaggtttatattatccttttctcactgaaatttaagtctaatccacattattttttgttatgcggctgaggacatatttggacttaaatatctacaatggtttaatttttcagggaaaccaaaggtctctctgatgaaggcaaaaaaatttaaataatatttttttccaattatttaccaatatagggctgtttcaaacttatttaccaaaatggtgcagccagacgcgcttgcatggggcgtgtttcaggcacaggtggcgcgatgtaaatataaactttgaaaaatcataacttttgattgggatgtccgattgaggcgaaaccggtggccacgcgctcaaaattgagaggagaagaatcggacatcctagtttagaaaagaaatattatttaggttcttttgccctcttatgaatcttgtttttgctaatttgtttatttttatttgtatttagtttggggaataaagaaaatctttaacaatataacataaattcttatcaaaatctttatgaagataagataataatccaccaacccacttgttatttttatgaggcacaataggtagaatttatcctgaaaacagaagaatgatcgagaactaatcataagagtttatgtacaaagtgcttaatgacttcattaatattcgattttttcagcaatttagttgacaaagtcccaaaatcttcatatgctaattgaaatcgggaagtatttatatatttaagattggcttattataatgttttgaaaaaaataatataaaacccactgttcaaattggtattgtctagttgggcttattaagcttcgcattccatgctgtgcatgacactatctatctatccattagtatgtgcaaaatgatgaaatataattgcaaccattatgatgaaaagtgactatctttttccttgcattgcttggtgcacgttaatctttctgttcaaacttaactagcaaggatagcccgtgttgtagacgggtcaatatgtaagatttaattaatatattagattgaatatattgaaatattatgatgaaaatgaattttcttttagactcgtggcaatcttcttttgtggtgcatattctctgaacattgatttctctggttcccttattactactttttagctattaaaaatagtagttcaatttttcttttctgatgttttggtatctcgtggccttttttcggtcaaatttcactgttagaggatatgatcaacaaatttggatttatctcttttaaaataggtatataaaatgagaaaataaggataaatttgaatgaagcactactatcttatagaatgaactaacttcaaatcaatggtggtggacaaataatgctattgctgatagttatcacggattcaaagcgtatttgattttccgttagcacaaattttcaagcatataaacaaaataacaattattaattactttatgctaaacatgtactcaattcgcaaccctgtattaatgattgctttctttgattgagaaccaaaatttggctccccctaatttgtcaatattggcgtgatgtatatatagtattaaatttggcacttaattttagataaaaaaagtgagatattcaatgattaaacttatatatgaatttaattaaaatatatattatattatcatctaatcacaaattaatatatatatatatattataataagattgataatttttgtcttaaaagtaatatctaagtttacgttatcaaaatgagacttcccacatatacctatatattgtggaaaaaaaatatatataataggtatagttggtttcattgcatgtatagatagaaaacgagatatttaactagttaaacccaactccttttgttatcggtttctatcaaagggttgacgcctttttttttctctaaaatattcttttcacataaatatgattctattatacatttgtaattttatagaaaaattgtgtttatgttgttttctgaacaagtgtgaaaataaaaacaactaaaacaccatttcgtggtatgttgtataatgaaatcatagttttgttactttatgagggggtgaaaaaaataataacggaattgtgaatctattttttttaacccaaaaacataactaagctttcattgcccatttctttcttctttttcctttgcacgtaggggtgatgaatggtggggaatatctaggtcgatgggtctagattggtgtagatcaaaggtgtttggtcacggtgacaacgagaatgcgtagcattatggacagaggtgcaaggtcaagggttcgcacgatgttgcaactatgtggtggtggttttgccaaggggtcacgtgcacagatgtactgttggggcaatgagcggtgcatgacgatgttgcaatggtatcagggttgctgggttcaaagctggacaaaggtggtggcgcgctgcgtgatgtggtggttatgggttgaatggggtgaaaagaaggtgaagggaaagaaggggggagggtaagataatattttctcacgtttgtagtggccaataacaaaaattgtaggggttacctataagtcaaattagctaatctgaagttgaaaaacatttttcatgattagacaagcccagtaatttaggggatatgcagactatattaaattgagaagagtccatgaattatttatttatttttaagaacataagagaaaaagaagaaacgaccaaactaggaaaattttaattagtacgcttctaattgataagaaaaaataaataaaaaagataacaaatgaataagcttctttgacaatatttattttatcataaatttaattatactaattaaaaacatagacactaatgtgtttatacttgcatttttattataattttaatttatgcaaaatggaaaatacatattgagtaaaaaataaattaataaactaaaattaatacagatgtcaatgtataataagaaaatttattacaatatatcaaacttaatgtcttgcctaaaaatatacacataaatgagtgataaaaataaatagttacaatgtgtcaaatttaatgcagtacatacgtaaacatatcgacacaacaatatataaagaaatttttataatatatcaaagttagcattttgaaaaaaataaatgagaagacnnnnnnnnnnnnnnnnnnnnnnnnnttacatacgggtgtatataaacgatccaatccaataaggatcgaaaaaattaatccaaaaaagtaaaaaattgaaggatcaacaaagttgaaaatcgatgttttttattaaatcaaattggattttggatttgattttaaaaattgattcaaatttaacttatgcatatgtatatatttttattcatacatttataatatcatttatttttatatcttataaatttataaaattatcatagaaattatatcaatttatgaaatttataattaattaaaaatgttttactgattatttgaggaagatgcttaaatattctattattagttatacaataacacataaatagatgtttgatattttaaattattttttattatatttattatatatcctatattttatttaatatttttctaaaaaatnnnnnnnnnnttaaatcaaattggattttggatttgattttaaaaattgattcaaatttaacttatgcatatatgtatacatttttattcataaatttataatatcatttattttatttcttataaatttataaaattatcatagaaattatatcaatttatgaaaaatataattaattaaaaatgttttactgattatttgagtaagatgcttaaatattctattattagttatacaatgacacataaataaatgtttgatatttaaattattttttattatatttattatatatcttatattttatttaatatttttctaaaaattaaataaaagtatgattataattgaaaatcaatctaatccaaaacagtttaaattggattggattggattaaaagtttaaattaaatcatttgaatgataaattaaaaaaatcaaaaaaattgaattgaatgattttttttccaaaattaattcaatctaatccacgaatatcactgccattacgggatggttttggccatgctcatgaccctaacttttttttttccttttgttatgtgtttgcattatttatttttttgggtaagatgctaaacttgatataaggctataatttttcttattatattttgacatgtatattaattttaaattattattattatttgtttaatgcatgcttatatgtatatattttgttacaagaggtaaaaatgcatgtttataggtatgtttttttgttatgtattattttggatttaataaaaaaaattacatgtttatttgtacatttttttctttttggataaattggtacttttttcgatttcaaacataagttatttaatattttttcttcattatattaagagaaaaggaattatatatgcactaacaacataaaatatttttgtagttatttaatcttaacttattatgtataataaatttattaattttaaaaataattatcttaaaataatttatgattgaatgataatataaaacaagtttacaatgttaatgtagttatattaaactcccatattaatgtcacaaaataaaaaattaatcactatagtttcattatattacttagtttgtcaaaatattttttaaataagattatataatatttatttatttatctttattttataaagataaggacaaagatcaaagagtaaattacatttgtaccccatgtattttgctcaaatttagttcgacaccctctcttttttcacattacttttaccccattattaatgtagttaactaaggtaaattaaaatatgtgagaagacgaaattgtctttacattttaattgtaaaacccaaattatcccttcccaattagtttcagaattaatggttcaagtcttattccttttcatcattcatgagtactattcatcttctacttgttggtgagtttttcttcatcgtccagagtgcgagtttcttttcctctcacgatgttcacgttccactcctctttaccgtttgcgagttctttagtatttctcttctagttcacgagttctccattgttcctcttcccgttctatcttcacaaacatcttcatttgtcttctttcgacattcacgagcgctgtgtttctctttctgttccatgatttctgttcatgctagagttatgtttgtatgtgacacttgaccttgtatatatgttactttttaaggttatttatttaatattgattgtttattattgcctattaatgaatgggatttcaatgggggaccattttgggaccacttataattttcaaaatcatttatttattattgttgataaaatgatgttgatgtttgggaccacaagaaacacaatggatgaactgattgtttattattgttgattaaaatagtgttgatgtttgagaccacatgaacacaatgaatgaactggaatacatgagtcctaaaccagacaacgtggatattttggtccactttacggactaacgagatgaactaagtgaaatatgtaatgttgatcatgataagtttggaatgtctgatgcacataattgtgtgaccaacattgctaatgactaatacttgtcatcatgtcaccctcttattttatggttttgttctattgttagtggtaaattttttccccttaagactgatcatgacatgctgaaaatgtttgttaagaatcaaaatttagtttatattcatatgtatgttaatataacaaatgatgagttttagaacctatatgtgagtggaaatgtaaatgaacttgtaagtgaaattgtgaatgaatatatgaatgaaaaattgaagaagaaggaaaagtgttaatagtgtgtatcaataatgtgagttcacatccaacaaaaagatgaatttatttttaattatagaaagaataaaatgaaataatagtcttaaatattttcaagttaagaagaagataaaagtatttttttattaaattattaaatcatatttaagattgagtacgatgtaatgtaagttaaataattaagaatatttttgtgattaaaaaagagggaggcagcagatgaaatttaagcgaaactgaggatatagcgacggaagactacgattgaactcaatttacatcgaatccctcaattccaataacgaaccaaccaaccagcccttttttattttgctcgtgttgatcgcaaatcctcatctctattcgttgcaatccccactgcgccactttccaggttaaccctaattcttgtattctcccactttcaattattattctttttcctcatcacgttctcgttcaatatccaatttatttgtcttgctgcctaaacaaattaggtcatcgcttggtttcatgctttctgctaaacaaattgctgtgttgtttgtgtgtgtgtgtgtgtttaaataacttcctgattagtgatcaattcaattgcaacactgcatgcaatcgtgaaacatttttgaaagcgtttttttttgtcaacttctgtttcttcgtaaggtgtactgcattgtgaaggacaagatttttaagccgttgctttgttcttggaggtgttagactattaggggctgattgttaaagacggcacttgtttatttatatgcctaattctttatagcaaaaaacctaaaactactccgaagtagaaggaatagacgcacccagtgattgccaagggccctaaaaattagaaaaatggtgtttcattggaagtaaccttcttatgttgaaagagtaaattgtttgggagaacatgcgtgtctgataaagagcgatcgatgcctcccacttatgcagcaaatcacttgtattaatcctgttgagtactgttgcctcaaaacaaaggacttgaccttagagagagttatccatttctgtctgtatttttcaagagtgaacttttggggggttaagagactagagtgtccgaagttaaacaaaattattttacaggtaagcagaatccaaagttcaaactttcctactagagttggttgagtgagaagtgagaaatttatagaatccaataaagactaaaggggttttaattcacttaatgtagttaagggtttgtggcacctcttgctttgaggtattaaaaatccccagtgcctgtagggagcttttgcctttaacttcatctacacggaccagtttctctataactcaagcatctatcaaactgaaaatctcaagataaaatatgactctgaataaaatacttttttttatgggtgtgtcatgcactgtagagaggttgtaaaggcaaggaaaagcctctaagagaggaaccagccaaaattgatacagcatcttgttggggtccaggggagcctgaaagcaaagaagacctgcaccattgggcctagcaatgaactacaagagtgaacttggcatcacattttcacccaaaaccttagggaattgggtatattggtctgttcccttatgttaccttcatctagcccattcttaactaatgtggaactttgaacaaacttgaatttccaacacatgtttagtttcacagcctttccttgttggcgttgatagctttttcctgtgtttgctatgatagatcaataactagatcattccaaatataatattatatctaataatagttttataggggtctgcagaggtttttctttttaaatgctgagtattgtttatgttttttttttttttttttttanagacattccaaatataatattatatctaataataggtttataggggtctgcagaggtttttctttttaaatgctgagtattgtttattttttttattttttttaataaacagtgatctatattttccttttgttttgagtttattattctgtcactagcaaagtgaaagttgatagctgtctaatatgtttttttcaataccatttcatctattgcaaggcaactaggtttttgaagttttggttttcttccccacagataaataccttcattaccttgtgtcatgcatgtgagtaccttgtgaaattaagttttcaggcttttgttggagacttgcagcagcagtagatatctgtagtacatatcaaatctcaaaatatttaagtacactttgctattttaataaaaaattgaacttacccctccttacaaggcaaaaagatttatgggtgaaatacaggaatgtttatgggttttttccttgtggattgatgtttttttctagtgcttatatgtctccttcaggtgacacaatgccattagattttaagtatttattaatcaaaatgaagttcttccatctgttttaattaatttgaaattttgtaattgtcaataaaagtgtccaaagaaagtgcatgttatgtttataatttttaatgtactatttattcctgtttatggaatatgtcagaattatataggcatgtataaattgttgatatctaaattctatttataagaaaaattaacagcttgaacttcttgatccatgattactagaaactcaattctgcattacgttctagtgcttcctgtgccttctcatttcttttaaatttataaactttttatgcaatcgtcaactatgctagattgctaggttaatgaaatcttcaaaacctcaatatttgtgaatagatacaagaatcagttactcttttcttgtatacaaattgtgtcaggataaagaggcagagaatttctatttcattacgtaatccgtttaattttggttgcttgaaataaggcagatcttgtttttagcagcatcttgaatttcaaaatgcctaaagttagaagattgaagtccccgtctactgattgtaatagaccatatccttacccatccaactccaaaaacattgagctgcataaacctataaatttgttgggatcagctgatgaaataaaagaatgggaggaagctagatgtcctatttgcatggaaccccctcataatggtgttcttttgaaatgttcttcctatgagaagggttgtcttacttacatgtgcaataccagttaccgccactccaactgccttgaccagttttgtaagtcctttgcttctcatctctcatcagaagtactgcaagaaattcctgtcacaggcagagtctctcacagtagagaaattcagtcagagtctcggcaccccactcaatgtgggagccagttacaatcaaagctcatttgccctttttgccgtggagaaatatatggatatatggttttggagcctgctcgaaggtatatgaattctaaactaaggagttgttcttctgaaacatgtgaattccaggggacatatccagaactcaggaagcatgctaggtctgaacatccttctgttcgaccatcagaggtggatccctcgcgacagtgtgattggataaggatggaacaagaaaggggcttggaagatctttttagctcaatccattcaagttctgttgcagattacaatagagataccattttgactgggggtcttgctgacttgatgtcctcgttcttgtatgaaatatttatctctattgaagatgttaaccgtatggctagttttttgactaattcaagacacagagtgccattatatgacagaaggtctggtacaacacacagggtatcaaatgatacacagacaaatcaatcagctcgatggagatccaatttaccttcaatgcatcaactggagagaattgctaggagtagagtgagaaccaattttccatatttatcatcccgtaatcttgaggcagaggcaaatcgtactgctagatggagaacaaatatgtcatcttttagaatgcctcgcaatgagcatcagttttatagagacctcagtgcagaggtcacatcttcaacaaggatgcctcgggcctcacaaggtactcagactaatccccagagcaacatttcttcatctggaagtggaaggtttcctggtcgtcaattacgctggcgtgatcaaagatggtcgacaaacaaccaccaatgatgaatggcaatagatacttctgtttcatataattacaaatgtttacttctgctatccattatggggatacttcaaactatcatttaacttcgttttattggaggatttggttaaatgcaatcgttttatttgaatttaatgattccttgcatgctcaaagcaaccacaaaatatttttctaattatttttgtttgtttttcatctaaattttagggatagactatttttctaacattttttctttttattaccacaagattagaagcatcatttttcaattttcatatcttgcattacgttgtcatatccaatttcttgtaccatgtatctaataattcaaacattggcttgatacctttaattgcattaatttcaatagattttaagaaaatatttttacctgaattgtcaataagaaaattagcaagtgatatctctttcttttttgtcctaccatcacatgtcaaactgcaatctcatatctcgctcacctgtatttttttaaactttttttatttgttatcatttgttttattcataaaggaaatcttaccttataataagtaggtggtttggaatatctatctattctttaatatcttttaacatttttttaccagattaattttctttttaacattaattaatgacaacaaagatagaacttaagatccgagcaaattaaatggttatgtgcagttccaccatgtatgcatttgcttatttcttgaaagatatcattcattatcttttagcatcttcatttaatgacgagtctattttcccctttgtattagcatcttcatttcctgtgtcttctaaacgccctaggttctttttatttttttattttccaacaataatttggtaaacattttcctaatctcgtcgagaatacttgaacagacaacacattttcccttattctaaaaatgtgataagatgctttattcttcaactaaacaacacaaagcacaatacaacaagaacaaatctaagaggtaggagaccaccgaccaatagtataataagcaccaacacaacaataaaaggcaacaagggaccatcgaactagctcctgtgctgaggggaaaaaagcatgaaatggagcatgtaaagtgtcgtggaaaagaaaaaggaaaataaatttgtttctcttaaatatttcgtatgggacactctagttatctttagagaccagagaggcgagatcagttgatttcctctcatttgcatttttttttactgaagattaaaacaaaaaatattagactatgacaagaatattgaaccttttttttacactgcaaaatacttatatcattcattaataatcaagacattgatacaatcaggagcaatatcaaatgtcagtggactagcaaatatcctaaaatcatttaagctatactactttaacaacactaagaaatgaagattaatgaagagtattagatggaaaagatgcaaatggatccacaaaaggaatcacaaacacgtgttctattctaccatactaatactattaccaaacaactcagaagttatgtctcaaaggctcgtggaacgatataaaggcgccttatctttactttcattaagattaaacaaaataagcatcaagaagttcttgaaaaaaaatacataacaaaatgaatatgttaaaacaataatcaaaatgtcagcctgcttttgatgttcttgttacatttggcagaacaacagaatcaagatccccaggataaggggtaaacaagcctagtcctcccctactttcttttaaattgcctttcttaagttcatccaactgtttaacccattctatgggagaagagtgctctcttgtgtgaggatgcaacacaaacagtgaattgtattcacagttgggaaacataaagaatttgaacgcgtcccccaatctgtatgcaacatagccaaaactcagttgatctctgggagtgaagaggtgaacctcattgaaccacaagcagctaaataagttatttatggcagtatgttcccgaatgatgacagctccctctggtacatctgaaacatcatatattattgttaacaatacgcatcaccaaacattatcattagagaggaacaagagaacatttgaatgaatccatgtgtcttaactatacagcagatagtttcatttataattagagtaaaaaatacaatggttaacggttacataattatacagctcataatatccctcagaaatctgtttttaaagagcccagtaacatcatgtgatacatgtagtcaacatcatctattgaaatacggctattgttgttattgttgtatatggaacaaatatgaacaaaattagaaaattaacagaaatgtgacaaaacaatatgtttcctcttaccaaaattgttgaaatcaaaccgtagaaataaaatataaaaccagaggtcttgtttcctgtcttaccactattggtctttttatttgaattccatggcttcattccctcataataatagattttaatgtggagatcaataaggggtcgagcatatcgctttcgcctcttgtttgaatcagcctcctcatatatactacggtgatgcttgtgttgagcaatggcaaacgtatgcttgcctcgccataggtatctgcataattaaggtagttttacaaggttacagtcatcacaagtcacagaaaggcttgcacagacatgatcagcagttttttcaacaatacagatgtagtaagtatgctcttaacatgaaacttcaatgggtgagtttataacaatagtttcagtgtggtttctcctgctggttgaaatagaatattcattcaaagttatcccgttttatatttttacattaatatccctcgtggtatgtataattgtatgaattagtgctttcaaaaggaattaaatatgccgttacacaacacagggtatgaaagtgtcatgtgcaaataaacgcaagggaagtaactccaggaatcaagaaaaaagctatccattctgctagaaagttttagccttatcagtttcaagtaccattttcatttgtttgagaagagacgaggggaggttagtgtcaaaactacatcacaaggggcaacatagaaacctaacatgatacaatcaactgttatcccaaaagaaaatccagaaacacgtaacaagcaagtccctaccaaaccaatactttgcttctataatgcatcaacttcatgattgtaaatatataaagactatgtaagagaaaaatgggaaagcaaaaaaatccattaaattgagtccttcaaacagagtgccccataatgtttttagtgtaagtgactgatcagtacatgaaatgtatcaaattcaaaattatcaaatgcctttccctcctatccttctaagctctcttgagtaagaaaaggatggcagtttaaatatctatccaaaaaaacaaagatttaaagtgttgatgttatcataaaattagggataaaacatttaaacagatataagtacctatcaaggattagcagtggatctactatcagctccattttaccatcaatccaaatactatactgtgcttgagggaacaacctgtgggttaaaattttgggaaccttcccattccttcttggttcatcataaggaggatgcttaagaagaataagtcgccatattcccacccattttccaccagctccgtcttctttgacagtaccattttccctcatgaatttcagagatacctcatccaccaccataagaaagcaaaaaagctcctttgagcgaaggcttatatttgatggttgatgaggtaaatcgtagccatcaaaaatgccagatgcaacaacaaatttgcatttcttgacatatttgatgtctacatgattcatttcagcaccaccacctcgaatgaatccacaatgcacctaatgggcagagcacatgggaaaacatgacttgttgattatggcaactacgacgcaatcttgcaaaattgtgaagcaattgagattaaaatgaacttgagcaaatcatgctaactaatctaccttcatatttgattttagtttgaaactttcctccctttgtttccaacttggatggcctccaaatagaggagatgactgagcttcactatgtcgaacctcatcttccataacatatgacagatttttgagaattttgttgggagttgttccagttgggataactattttatcagggtcattggaaagaggaattggacatcctaacgaacataggcagcaccaatatcaaacacacagttatcatttggtgaagttcaaaaagaagggatggaagcaaaaccaccaaaatcttactgtgaggttttgatacaagtcccatattgcctaacatgttgtaaaccttgctatctttgttacacatagctgcaggtcaagcagaaaattgctatattttcagaaatgttgacaattttggtggaaaaaataaaataaaagacaaaatgtttataatgaacaagcatttcttgaagtatgtctacctaacagaacctcccatcaagttatcatcctacatttgtaaattctaatcatagcaactttgcatctatattcactaatcagattgtagatatttgtatttacaaagttagtttcaactaacttaatatagataaaattaagacaagtgaagtcctagttccccttacaaataccatcaaagaaaaacaataattaacaagaaaacatcacattaaattcaattttctgtactaagatatattatactaactaacgtacccccgtaccagaaggcttctatacgaaagtatgggagaggactattgtatacagccttatccttgcatatgcaaagagtttgtttccgaattcaaacctatgaccaactggtcaccaagcgtcagagctttccctctatgcctagaaatattatactattcttatttcaactagaaaataaagagttgctaaccttctaattccacagtaaatacttctaaagaattaagctacgagttgaacttatgagtatgaaagagaaagagacataagacttaaccttatctatagtgaaaaatgaatttccaaactgttctttttaaaagccatcatctatgaattgcaagaaacttcctgtacatgttggttttctagtaccaggaacaactaaaatcaacgggcacaggcagctacgaagatcaagttaaaatataaagcaacgagatttattcccttcaacccaattctcaaaatatcacattgagaatatacagttagatgaagtgtctatgttattacttattacaattaagtagtagttatcaacaagagataaacttaagaagatttcaaaaaagtaacgaaatttattaaaaactttactaacctgataaaaaggagacggaagtttgacaagaccatatatggaacaacaatgcaagaagaattaataacatccacaagatccctgctacaagaaccaaccgaacaaaccctttcttccaaacgatcttcatggggtaatcttgaggtaccctccctgaagaaaagaaacccacctcaaaatctgcatcaccaacaaacagattttatttgccaaggccaaagtaactatttccttcactgttatataatctagtaaagaaacaaaagagatatttctcagcagataaaagaaccaaaacagtgtataacagtccttcctaacctttagcagaattttgactacttcgatctcctctacgatttaggcgcaaagatagagacctttgaagatcaccctccatatctgattctttcttcatgttatcatcactgccattgcataacaaaaaaaaaaaaagatgacattttggcataacccatgagactaaaaatcagaaaagatgcacacacagttatcaaaagcaaaactgataaagagaacgaaaagagggaaaaaaaaaaaaaactgatncagcaactaattaccccataagttccttgaaaatattcaaccaggacaaatttaaaaaccaaaactttgagcgaaaaaaagagggacagaaagggagaaaaagaatagggcgagacccaaatgaatattaagaatagtatagtgtcggtgaggagagcgcagatgcatacaaccacaaaaataatgggaagaggagtaacgagttggggcatcactatcaggtgtaaattgtgaatgaagtaattgaggaaaacgagaagaaattggtacctggcggtggtgaaagaagggatggttctgttgtcagtgaccaaaaagggaccagatctgtgtgaaatgtgtaatgttgtgttgggtcgttctaacaacaacagaagagataaactagaaagaactaagactgtgaagaagagatgttgaagtttcaaactgaaacagatatccctctatcctttgttttctcatcaacactcacacgggatcatcagaggatcatggaagctgcagaatctcttgttttattttaatgttcttttttttctctttcttttttctttactttcaattgattgaggaggatcaaaggcccaaaataagagggtggagcaatttggaatgggctgtaatggaactggaactagtatcccagccgggtttcttttgtctatatttttaaaataaaaaattaatatgaaagaaaataaaataaaattcgaaagaacaacaagcattttggttggttaaactttttccacgggcctaaacggcaagtagtagtcaatttggaaaaaatcgtatcagaattctgcagtttattttgtaagtttttagtttttaccatagaggtgatttgattacagtccttcgtttgttcttgtccattcatagctccaagctcctaatcacccacgtggctttgtgatcatttcatgaaatgccacaaagcgataaggtccttattacaaagccaaaatcacttggttgatggtgacaactggaatcacatggacttccccttaaatttgagcatcagataaaaatgaacgtaaaacgtgagcctctagttttgagttgaagcatataactttggggtgttcattgtgtgttgccactctcctctcttgttgtactcttgttccttttggttagcagaaaggaacatggaagctgtgtgtgctttttctgttggggcacttcacatcccaacagcacatgaaacatcaaagtcatttaggaaatctatattcttgagcaacctagtggcttcaccagtttcattggtttttctcaggggcagttcaaaatccaagcttttaactgccttgtcacccactccattgacagaatccagtaaccaacctgaggttgagccagaatttgaaagtcatgcagagaaatttgactggtactctcagtggtaccctttgatgccaatttgtgaccttgacaagaggaagccacatgggaagagggtgctgggaattgatgtggttgtgtggtgggataggaatgagggtgcttggcaggttcacgatgatgcttgtcctcatagattagcacccttgtctgatggaaggattgatcaatggggcaggttgcagtgtgtgtaccatggttggtgtttcaatggcaaaggagaatgccagctcattcctcaggcactccctgatggccctccggtaattactcttggtcataatttgtagttaatgcatgttgttgtaatatggctcccaaattcactattttttttgtatgtttcatttcctgtgtagtaagtagccagaacgcatatgaaaatgcagacttttcagcctttttttcaatcaaaagattatgatttgcatgtaccatttactcatttcctggccatgaattttagcttgtcatcatgatttcatgttctgaaacgtgcaatattgaaggtgagatcatattatgttgatgcgtggaacattagtggcttgtgagtggctggtggcgtactttctctctaagttcattggttctagatctcaccaatgcttcaaactactcttgacccctatgcatgtcacgcatggccacctcttcctcctctttttgttgatgtgaagttatgttgtagacttgtaatttgtttttcatggctctcttaatggaaaaggtatgagttacacctcccaagtttaagagtttccatctattctttacttgatgtgtgacaatctagtcttacataagtcgacttatccacttaccatgaccagaagttgacttgtacttaggaaagtcaacgtacaacattcatactcagttaatagtatatagacaacttacagaatacaaaagttaagcaactgacacaatacaaaacttctcatgtttcaaaaaagcaaatccaacttggtacatagtcagttatagtacatggtttagttttgtgctttgtgaggtccaattgggtaagtcagtacatgactcctacacctgaatttttttaacccttttagaaactcaggtaaatcacacccaactcaaaatttgagtttttttatactttatccattagccagatgaatgtatgttggtactttgttgaatggggtcttttgcccatttagtaaataatgagcaggttttgtgacccttatgaaactcaggaggtaagtcacatatgacccaaagttggactttcctttaaccaattttattttcaaaaattttaaatgcttccaagtttcttcatacaatgggacaatctgatgctcattaaagtttgctaaaaaaaatgtgtaggtacatacgtccaaaaaagcatgtgtagctgcttacccaagtactgtgcagaatgatatcttgtggttctggccaaatactgatcctcaatacaaagatattattacaagaaaaagacccccattcataccagaaatggatgatccatcgtatactaaattaatgggaaacagagacattccttatgggtatgattttagactattaagatctttcctgtgttgtagaactacacatctgtacgtggctcactttcttttacctgaagctactgaactattatttttttctttatttttttgtgattggtaattggtctaattatttagctgattctggaagatgaaaacacaagcatgacgttatgcatagaatttgcatcctgggggcgaaaaccacattccccacttagtgtatctttgatctttctaacaaaatgaatatgcaattttaggtatgaagtactgatggaaaatcttatggaccctgcacatgttccatatgcacactatggactaatgcgtactcagcaaccaaaaggtaggcatataaggtatatcttttttaacttaattaaatttctatttacttatatatgacacttacatatgtagagcttaataacagtgaaagctgatagagaagggggcaggccacttgacatgtctattgaaaagttagatatcaatggtttttcagcagatcaggcttgggccaaaagcaaatttatgccaccatgcattttttatgtgtatcctccagatcaacctgcctcatctggtgaaactaacgtaaaatattgagtagatgctatttttagatcagaaacaatatgcaggcagtatttctaagggtataatttgtgttacacttaatgcagaaatcatcagctaagaagaaaatgtgtttaatcttcgtttgtgttccggttagtcctggtaaaagcagattgatatggtgcttcccaagaaactttggattgtggatggacaaaattgtaccacgatggatatttcatgtgggacaaaacctgattctggattcagatttatatctcctccatgttgaggtaacgcctgttattatttatcctatcaactaattggttccatcactctactttttcctcttcaaactattgtaagttctgctgaataaagctatcataaagaggagcaacattttttcccactaggtggtattagctgcatgaattaaacgatgatagtgttttgttgtaaatgatatttatacacaaacagacaaactatttttattgggcttcctctacctctaactacccatctgatatactctccttattgggcttctataggtcttctcatacatgaccaaactacctaagacaagattgtatgatcttttctacaataggtgctaccccaagttttcccccaatactattataatcctatcttgtctagtatgtcatctcatccaactcaacattctcatttctgctaaaaaaactacgtacctcattgtcgagaggttcctcgctatgctaagggaagggagagagatattgtactcagctttacccttgcatatgcaaagagtctaactctcaattctgctacattgagtttattctctcgtttgttttttaccacccaacattttgttccatataacatcacaagttttatagttgtgtagtaaaattttgtttgagtggtacttttttatcacagataactcagggtactcttccatttcatttttcctactttaatcttatgatttatatctctctttttctaataaaaaacaataaatgaatgatattagttgttactactacaagtgtacaacaaaaacaaagtcttatcccactaggtgaggtcagttacatgaatcacataacgtcattcgacaaaattaaaatcaaagtttcagaactattattaagccttagatctcctttggtgatttcctccaacgtcctttttggtttccctcttctccttttccctaatctaaaaatcatacaatttactcttctaactagcacctttggaggccttctttgtacatgcccaaaccaccttaacaggttttatattgctactgttacatcataacaatataaaatttgataactgtggaatttttttcaatggattagattattcagcttgtctttgtcctgattaacttataaggccatttgcaatgaaaattttattcatagtagttgccaggttaacttttccttgcatttgtgtacaggttaaattttttaattgattttttatattaatctcttaaattatgatagattggttacccgagtttcagtcagtattacagattaggcttgctgaaaatttatattcttctaacttgattagctcaaacgaatttttcttagccttgggtgaacggatagagttttcaggttaaatgtaaactgtcaactgcacgttcatatttccaacctaaattaattttctgttagtctaattgttgggggattttgtcccaataatggctaaaaaataattcttattataatctgctgctatataattccacatgtgcttcagattttatgacagaatatctcttagaaaggtgaataatatcacttaacattgatgcaaaatcttaataatttatgtttcagcatccagttgccactggtattatgttctacatgtaactaaaatttggtacctttctttcttgttgtctggtctgttttattttcttcagttttaatgtctccatagaaaagtaatatgtccctggaaaacaatttaatttgattcctcatatttgtttgttaaattcttctgataggaacataaactaaaggatattggaccaaacaattggcacaaagcctgttttgtgccaacaaagtcagacgcccttgttattggttatagaacatggctaaggaagtatgcagatggtcaggttgattggagaggaaaatatagtggagctcttcctccaacacctccgagagaacagcttttagacaggtactcatttaagattgctcttgaacatggaagtttcaatatagttataaatagattggccatttcctttaattcagggaagagttacaaagagttagtattcgttttggtcctcggaagtggcaacttgtgttgcttaggtccctgaaaaatctatacagattagtctttggagggatagaattatttacaagcttaaaagggtaaaattgttaacaagttgacacattcaatgatcaatttgtgtagataggcactttcaaggactaaagcaacacaagttgttttgttgctttaagggaccaaattctatattaaatcaagcataaatctttaatgaagtccaccataatcaagaattttatcaatctaaaattcttagccaatggagaaagaaaaagttgttctgtactcctgtaactacaacgtaatcagcagagagaaattccatgctttaatgtgtgtttcacaaaagcagcttgatacctctgactttgagtatatatttttttttcctaaataattgaacaaaggcaagtaatcacaaaaacgaatttatgtcgtaatttgggtttcaatgttgcatctctatatctaacgaggtttcactaacatgcttgcatatgtactaataaacaatttttgaaaaattttgttttgggattgttgattacaaattaatttgagcaggtactggtcccatgtggtgaattgcaagagttgcaattctgcttataagagcctgaatgcggttgaagtaatgctgcagatcatatctgttgcttcaattgggattgttgccgtcatgaagcatggtacaatgtcagtggcaaaaagaaattcaatggttgccttagcagtactatcatttgcactgtcacggtggttagctcacttcatatacaaaaacttccgttatcatgactacgagcatgccttccgctgaaatgtgttttccatagttcttcatgtctaaatatgtgtatagactatagtgaaggtccactagaataaagtcactggcactttatttgactttttaaattttaaaagttaattcatctatgacaagtattcacaacctcttcatacagaggacaaataggttgatatcaatctcatgtaaatctaatttacattgtccgacataaaatgagtagaattgtagaaatattgcatctagttatgaacgtaaagtttgtgatcttttcccttttatatatgtatagacactaacacacaaacagatagataatgatatggctattataagttagtacttgtagttcttaacaaaacacagagacacctgtaaattagttggatggtacttgacttgatgcccaatagtcaagacggcagagaccaaaattctcggctttcgtcataaaatcaattcctaaatccaattaataagaggtgaatttgtttaaacttatttcttggaaaaatatttattttaatgaaataagtactttttttttgttttttaaattttttgtataaattacttttgcttaaaaaaatttaatttttgcttattttgataaacagatcctatatgcttatcttaaaactatttttttaagtctgaacaaaccagtccaatattagtatttgtcaataagaaattttcaaaattaacttcatgattcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattttcggacataacgagtaactaacctgaataactaatgtgtgaacgaagaaaaggcaacaacaaataggaaaaaaaaagtgaagtgaagttttatgttttcttttatggctttgtgccatttggtttattatacttgttttatgttggtgtattaaattttaaaaattttattttgataattttttttaatttctgctactaaaattaatgtgtcattaatttttaaaaatgagtaattaaaataatgacgattacaaaatgatatgtattaattatctatttttttaacttttgtcattttttctacaaatttcataacaaccagaagataaacaatataatatagtaataacatacattataaacattagattttgaaggtgataagaaatttaggatctcatgttgcaatgaaaattttgagttttgcttccatttttggtttcatgactgtcattattttaatctaaaacattaaaataaaacttttaaaatttatcgtaacaattttttttaaaaaaaataaaaataaaaaaccaatgaacatagtaaacaaaagtaacatttaatcttggtttttatgacaagtgaagtgaagtaagtaacactctaacattacacagcactgaatgactcggcatcagattcagatcctccgtcgccatcacccctaacctgtagcccataaactaacaccgccacctctttctcttcctcaccttcagatctcaaaaaatgaaggactcaaactccagcaacagtagcagaaccgaacccatagcccaaaacatcatcaaactcattagcaacctcttcttctccgtcttcgtcttctctgtcttaatcttcaccgtcatagccataacctaccagcccccagacccatggctcgagtccaccccagccctaactaacctcttcacccaatcacaaaacgccactttccgaatcgactcctccgtcctcaaaaccggcgaagacctcgctccctcgccgcaagaccctcccctcccacctccgccaccctcatccgccgccgtcaccgaagccgtcatcgagaaaaccgaacagcaaattgccaagtccaccgttaattccaccgccgactccaccgacgcggcgcttccttctccccccgcctgcgacggaaccctaaactgctccaaccctcgcgttcgtattgctattcagagattcaacctccgcgcgttcaagtccattgccttcttcgactaccagcctccggtgaacggctccgtcgccggcgagtgcgacgtcgcgtggcgcttccggaacaagcgcgagcgctcctggcgcaagtaccgcgactttcgccgcttcaagatcgctgtcaccgacgactgcaggtacaaggtggtgcacgccggcggctggcactctggcgccaatgctcgccggaatatgacgcgctccggcgccgccaggggtggtcggaccctgccgccgcgggcttcagcccgcgatgatgagatcaatgacacgattccgactttgggatcggagactaattttaggaatgggaagtatttgtattactcgagaggtggggattactgcaagggaatgaatcattatttgtggagtttcttgtgtggattgggggaagctatgtttttaaacaggacttttgttatggatttgagtgtttgtttggcttcaacttataaccctagtaacaaggatgaggaggggaaggattttaggtactacttcgatttcgagcatttgaaggagacggcttcgattgtggaggaaggtgagtttttgagggattggaagaagtgggataaaacgcatttgaagaagaagattcctgttaggaaggttgtcaatcacaaggtgactcctatgcagcttaagaaggataagagtacgattatatggaggcagtttgatgcgcctgagcctgaaaattattggtatagggtttgtgaaggtgaggctgctaagaatattcagaggccttggcatgctgtgtggaaatccaagaggttgatgaatattgttactgagattagtggaaggttggactgggattttgacgccgttcatgtggttcggggagagaaagcccagaacaaggagttgtggcctcatttggattatgatacgtcgccggatgttcttgttgagaagcttaaagggatggttcagccttggaggcatttgtacattgccaccaatgagccttattataattactttgataagttgaggtcaaattacaaggtgcatttgcttgatgactataaggagctgtggggaaatacaagtgagtggtataacgagaccacacttatcaacaatggaaagcctgttgagtttgatgggtacatgaaagttgcagtggatacagaggtcttttaccgtggaaagacatgcgtggaaacgttctataatttgactaaagattgcaaggatggagttaatacatgctgatcaggttggcactactgatttggatgctttttcagaatacatggtacactcgggccttgcttttggattcagtttcagattcataccattgggttagatatgagcttggtattgtacttgcttgttcttttattatattgatgatttatgttgattatcatgattttgtatacatactatagaatccctttctaccctctttcctttctgttgactcaagctgctaaaaatccattctcgtattctttcattctcttttctcatttgaataccaaattgaaaattaagaagagtttttgctgaagcctttaagactctatttgtctatgaccttcagatttgggtaatggctctgctttataaattttccaagttatatagtatagtgaaatactaaaatatattcaatgaatgctcacatagtcacattattccgtctttaaatacattgttgccctgatgaacttccaacataactttttgacctcaatcctacgtaaaagttctgcataaccctaatttgtgtaccccaattctaagttctaacttcatctatctatatttccttcacttctgtatttatgtatttggaataacttatcctttttgactcctaggaatacccattttagtcgcagacttcactccatgccacggtccactgatgacactactttgagttcattcttataccttgaggatcttttttaggcaatctatatgaaaccgttggttggatgaatctttttttccttgcacatgacttgtcaacatccccacaaaggtatgttttattgagattacaaattaatctaaatgtattccttttaatgtgtggcacctctaatttggtgccacctctagttcatgtttctgcagaaacaaaaattttcaaattagagacatagccgtgttttagaaaatgaaattggtcgagattccttcctcatcattcgtgtttaaattctgctcgtttgataacttcacttttctgattttatgatagtgattagttgtactctgattttctgattaacttcacataccttaaaaacaacaatccaaacagattttatgcatgatgtccagtacgacacacatagttggtgttaacctcctcactacacagtgctttctagtatttttcaaaccattgcattcgtgtgccccaaacaactattgcgttaagatgcgatagaattattataacaaaagaaacaacgaaagataaggtttcttttattttcgatcctaaagatgttggcatggcaagggtcaaggcaagatacgacggtatgaaagagaaacatcataatcaagttggttctcagtaagcaaactgcaaatttgaaattgagctaatataacggacaaaagctttaacgtactatggcttaaatactcgaattttgctttatcaatgaacgtattttattcactcaccatactttgctttatcctttaacattgtttggcttaaatacatgtatcgtttttatcaaatggggtaaagttgataatactcgttccagtttatataaattatttagctgataacgtactattatctgaaaggtcaataagcaccaaaaacccaaatcaagaacaaattgaatttgagacggcaagtgagggaaatagaaaccatgttaattgtatatcatgctacaatttatagaagaatgaaaaaaagatcaaaacccaatgtcaagagtgtcactaggatcactacaaataagtgactttcagtcattcagactattcatcctcctggctgcgtaatctggccgttttgtttgtcacaacaacatcaagttgcgcggctctctcaactatatcttttctctttcttgtggatatattgtgggcaatctcagcacagtaagtcctaaaataaagacaaataaagtggtcaggaaacattagatgcaaaatgatcagaattgaaatactaattgggacacaacgttcacctgttgtgcatcatgagcagttccaagtccttcacattgtgaacaacaaatttcttaaaaccattaggaagatagtggcgggtcttcttgtctgaaccataaccaatgtttggcatcagagtgcatcccttgaactttctcctaacacgggaatctataccctttggcctacgccagtttgtctgttgaataaaaaaatagaaggttattagttatagaccctagtataataatttcatagacaagaacaatttgatctgcaatctcagccgaaagatggtgatattaggataataatcacagacaatcagcacattattgaaatgtcatcacagattgcagatcagactattttctggtaaaacaaaaagtattcttaactacatgtgcaagaaaagtattaataaaatgaaaacgatttttgagatcaacataaaggtattcaagagatgtaaacaggaaaatagtaacagaaagcttatagtagtaaagaaagccaactgtgtcgcaaggcctgtaaaaattctatatatgcccttaaaacgagatgtcaagctacagctagacaagagtccaaagtctggacatcagataccatgggcaaataaattaacaaataaattcttaatttaagcaacttaaagataataagttataatcactaaataatcaaacaaaattactcaaccgtatgaaaaggatggcagagatcagatggtagtgcatgttagtaatcatcattctattgcagaattgatggataaagatcatcatatctctttacaatcgcatttcataatatacaaataacaaatttaagtggaaatttattcagattgaaaagaaattactaggcaagccaatcaatgcatattaattaaaggatcagacaattaattttcaccagagtgcaccaatggagcaagtaagactgggtgtccaaaaagttaccatcaaatcccatgctcaaattaaaacaaaaaacaaaggaaaactgtggcaaacaggaaacaaatcaacatcaataaaaaccaaacaaagcaccaacaaaagtacaacacaaatcatatatgggatcagatagtcgatctctcatcacatataaaaaatatagtaagactgggtgtcaaatttatcctcctatcccatcggtccaaaacaattgagacttaaagaagcaaattcaaataaaattgacaaaaaaataacaggttgaaataatacagcagaatcagataaaatgtcaatcaccatcttacaccttgtggtgcaaattaagactggggcgacaaagtaatatcatcatatccttaaaaagcagcaagctactacgacgaaacgcatatcaaacaattaactaaaccgaaaataaaaataaaaaagctcaacagctatatgcaacacaaaacaaagtgtaaaatcacaaaattactcatccaaacgatacatcttaaattaatcagaatgaagaggctaaaatgtatactaccttgacggaaattttcctgtcactctgaggcctcttgaacttcttgaccctcttcttcacgatcttcttcgagagtagaggtaccgccattttctcttaagtgtcttgagatgagggtgggaatagagtagtagtatatataggcgctgcggcgtctagggtttttatctcaccataacggagtgcgtctattctagggttttttggatagggtttgtttggatggaggtaaaggtaaatgggttgggccaaaccgggcttaggagtaaagaagtccaaccaagtaaacagtgataagttttaattggcccagatcattcaatactttcacttattcctttttttagagtaaactcagtaaagtaatttttttctaaaatattttcttttcattttgtgactttcttttatatttttcatattttgaaatttgagtaattttttgtgtgtagaaaatatttttttagttctttaaataattatgacctaatgaaatatttgtcatccttcaaacaattttgatataaatttattgacttaaatatatttttaatctcttaaatatgaaaatatacctattttaaccctttaaattaaaagttgtttttttttagttctttaaattgaaaaatacatttttagcccttctctataataatattaaataattaataattttgtagtcatttttagttgtcaaaatttaattttataatttaaattttaaaatataatttatgtgaggttaaaaccaccactaattggaatatatcatcaaacatatagaggaaaagattttcgcaacttcctcgatctcaacaactttggcacatctatcagcttgtagattggagaagaaattttcgatattttactatattatgctctacttacctggtggaataggaaaagtgtttttgtgttttgcaagtgtggggacatgttgtggcgttttgataaatatttataataagattcatctagttatattggttgcatatctaattttgcaggtgatttgtagtgcagtggcgagggggcttagtgctccgcgttgtaaatatcctgttttaataaaaggaataataagattaaaatggtcatttactcagtagatatatttattttcccttattttatttcttatcaactaaccttaattcaaaaaattcattctaccctcatctaatttaatcatatttcttttatttattttttctcacctattctcctttctttcctcctcacaatcaaataatttcttagaatcatcacagaaaatatcaccttatttcaaaatgaattgacgtaggacaggaaaatagttagagtattttttggatgaataccattttttttatgaaaaaaaaaatagctggagttcaaataaaagtatcatgtatctctaggttgcacccagaaatataaggagtttttaatagacaagcagtatcaatttttatattattaaccaaaaaaaatttacttttaaattataaaagcagtgaaaaaactttatggggaatgcattatttaggaattatgaataaagaaattgaaagttgcatttattcacgcacgggaatgatgcagatgtgatgttgtccggttgtaataactttactgggcagtgtttgggacagtaaagtgagtgagactttgcacactgttgttgcctctccctttcttcgccaactctttcacattccttccttttcccaacaccttcacattgcaacctaaaaatctctcaattcaacggtttccgctttcagggttttagcttttgctacgtgttggtgtggtgaatgcactttcttttctgcgcgttccacctctctcagctagtgttcagtgttcattatacccacaacagaagagtagctactcaacacaagctctttcggggtttttaagaaagatcaggtgcacagtccgcgcttctattcctttctttctaaacccctctatgagggttaggttattatgcttttttttgtactaaaagaggaatacacgcttctctctcttctccattttaagaaaaaatgtctataaacggcaaatcttttagtatttatttatttatttttgttttaactgggccttgaggtgtaccatgtactacctatttggaaagcttgttgaatatggcactgttcttactagatttgatttctgtgaacatcaattttatgtaagagtagatattgttcattaatgtttcatccaactagtggacttcgtttaattatctgtctgtgttatgttggtcatttattgctcaaaatgtgatttcgtgtttattgctcaagttttcagctaaggctttgctggacagcaacattgggctgaaattgctgattcactcaggtgatattggatgtgatgaagcttaaaacatggcttgcgagagttttgttgctcactattgctgtgcttaccactacattaggtaatttataccttcttttttttccatatttgtggtgaatatctgaaattgagttttcaaatttctttgttctcacgatcagtctacatactgtatagtctagactgcttttgcagttacaccgtgtgtcaattaaatttggatcaaaagtgtattaaaatgaaattgctgataggtgacagccttgccaatagtcatgcattcataaaaaaaattggcctaaatagagtgaaacttatcctggaaatggcattggctttgtcagattggatttatgtagtttatgttgcctcctcctggactccttatgctttggtacttttcattgtctatcagattctgactgtaaagtcactagtgctgcaagctgactgccgagtggaccgagtctcttgtgcttgcatgtgcatttattatttattaagtacaattgatgaggtgtttcatgtattattggattgggtttgatagttgcaagcaagtattttacagtcaaaactattgcttttcttacataattataatgaccatatgtcttgtacgttggtcagcctgtttatttttctatacctgttatgattaccacaaggggaagcaattagggatgtggatgtatgagtatgacattgactgtctattatctttttgagttgatggcttgatgctagatcaaattgtttaacttgtaggtgcctttgtgggggtaaacattggcactgatgcttctgatctgccatctgcttcaaatatagttgacattctacaagctaatcaaattactcatgtgcgtctgtatgatgctaacgcacacttactacaagctctttcaaacactagcattgaagtaattgttggtgtcaccaatgaggaggtactgaggattggagaatctccgtcagcagctgcagcctggattaataaaaatgttgttgcttatgtcccgtccaccaatatcacaggaatggcagttggcagtgaggttctttccactatcgcaaatgtcgcccctgttctggttcctgccatgaattctcttcacaaagccctggttgctgcaaaccttaacttccgggtcaaagtttcaactccccagtctatggacattatccctaagccttttcctccttccactgccacctttaactcttcatggaactctactatctatcaactccttcagtttctgaagaacacaaattcctcctacatgttaaatgcctacccttattatggatacactaaaggagatggtattttccctattgaatatgctcttttccaacctcttccttccgtgaagcaaattgttgacccaaacactctatttcattataacagtatgtttgatgctatggtggatgctacctactactctatagaagccttaaatttcaataatatacccattgttgtcacagagactggctggccgtcgtttggtggagctaatgaaccagatgctactgaagaaaacgctgagctctacattaataatatgattcagcgggtcatgaatgattcaggttctcctagtcagccaaacatagccattaatacatacatatatgaattgtttaatgaagacaagaggaatgggcctgtatcagaaaaaagttggggcatcttttataccaatggtagtactgtttatccattgaggtttggtgcttccgatccgattgctggaaattcttcagcagttttttgtgtggctaaagatggagcagacaccgataagctgcaatctggactgagctgggcatgtggacaaggaggagcaaattgtgctgcaattcaacaggggcagccatgttatctccccaataatgtgaaaagccatgcctcttatgcttataatgattattatcagagaaagcatagcagtggtggaacttgtgactttgatggtaccgctacaattactaccaaggatcctagtaagtcgatatgacttcttatttctgttttaaccttgatattctgatatgggacgcttgtaacacttcaagttatttctttggactattactcatgtaaccattttttatttcaaattgcgtactaactgttgtaggaaatttcccacaatccctccttgttagaaacaggaaaacagcccctggagagtaaatcatatatttgaaagtcattggtcgttgttagaaagcaattacagttataaaaactattcaagttataagcatataccaatgtgcttttcaaattacacaatgacacatctatggcttcactaaaagttgaatttgaataaatacatctaattcctcccacaaaacatggctggatgataaaataatggattcgtagtgtctttggttggtgatcatgtccctatttggcatattagcagggcaagaaagcagttgcagttttttttgatttgaacctgaagatcatgtttagtcaaaaaaatattagttacattacatcgtttagttacttaaccaattaattctgtgtactttgttgcaggttcttcatcctgtatatttgctggaaggtatagaatcttaatctttatacatccttgatttattagacttagaagtagtaattgtgaccttttaaatttcttatatgatcatggaatattttgacagcagttctaactcgagcactggtggattgagtttacctccaatggcacttggaccttcaggcccctttggtgcgagtatgaacatgcaagtgtctagccttaactatttgatatcagctattggtgtatttttggctctggcggtgttatgaccacaaggtcgatgctctttaaattgcaattcaatgattcgtgtaatgtggtcctatcgattttgtatctagcttttcttgggtccaatttattcttcagagatgtcccatcttctgcatttggggtcattgtaatttatcacacttttaagatagttatttaatgtagtgctttagccatcagaggagactaacctaatacggggcccttaagaaatgactgccagcttctcgaaccaacaaattatgcacttgttgtgatcataaaaaattagagtagcatacaatttatttgaactattaataagaaaaggtgtgttcagttgaacaattaagaaaaattagcatgagatctatgaaatattcagtagcttatactatatatttatatggatggaactacgaagagtttgtaagtacgaacatacgggtgaataatttttctttaccataaaataatattaatattcatgttgtcttctttaaagtctaatttaaaattggtaattattttttatgaattttttttctaactcaatgatggcagcttacaaggcattcagtgcgggtaattgagtctcaatgttttttagtaggctattttcatcaatctttgtttcctttctgtttgctgcttctcctttccgaacaacagtcgtgaattacctatttatggccgatttatttatttacaaaattaatcatataaaatcaatatttttttttataaaaatcttggaagcaaggatagtgaaaaatttatttacaaatttgaaaaaagagggataagaagagtaaagatattattcaagatagatgtatcaaggatgaaaataaaaaaaaacttttggtaaggaatgaagatgtaagtaaaagatgtttaaactactttagtaaattttttaatgagaatgacgacaagagtgaggtggatttggaagatattttttatagtagaagatttgtatgcataattaatacacatgaagttaaggagactttaaagaggatgaataataataaaactttgggacccgattacgtccatattgaagtgtggagaaacttgagtgatgtgacaataaaatggttgatcaatatttttaataaaattcttcaaacaaataagatgtctgatgcttataagaaaaatatgtttgtgcttatttacaaaaataagaaaaatattcataattattctaactataaaggcatcaagctcgtgagtcatactatgaagttgtaggagagagttattgaacaacgcctaaggagggagaccaatgtttccttaaatcaatttgaatttatgccaagaagatataccatggaagttattttcttgatgcgacaattaatggaaaagtataggaagaagaataaagacttacatataggattcatagatcttgagaaaacgtatgataacgtcccaagaaaagtcttatggtagacaattgagaagaaaaatgtagcattaaagtatgttaatgcaatcaaggatatgtatgatggggctaccacatgtgtagaagcttgtaatggaacatcaaggtattttcctatcacggtaggtgtttactaaggttcagcttttagtccttatctctttaccttagtgatagatgaactgacaaaagatatttaagaaaaagtgtcgtaatgtatgtttttttgcagatgatattatgcttattgatgagatcaaatatgatgttaatagaaaactggaattgtagagaaacactttggagtctaaatgattcataataagcaagagcaagacggagtacatgaagtgtgagtttttgcgggtaagagatgatgatcaagacacagtgcaactacgtggtcaagaggtacccaaaaaagatgtttttagatacttgagatcaattttgcaaaaaggtggtgaagttgatgaaaatttaaataatagaatcatatcagagtggactaaatgaaggagtgcatcggagtttttgtgtaaccgcaaaattccccttaagctaaaaggaaaattctatagaataattgtaagaccgacaatgttttatgatgtggaatgctgaccagcacataagcaacatgtgcataaaatagggttagcagaaatgaggattgtaaggtggatgtgtgtttatacgaaaatggataagataagaaatgaatatattcgacgaaaggtaagagtaatatcggtgtgtgaaaagatgagggagtatagattaaggtggtttggacacaagacgaccactggatgattatgtaaaaacaagagtttgttaccaagagctcaacacaaagaaaggtagaggtagaagtcgaccgaaacttacctggggaaaagtaattaagcaagacctaatgaagtgagatatagattgatggagagttaaacccgttaatatttctatgttttttccttgttttttttttagttctttgtctctttattttttcctcctcctttcacccctcttttatgttagtttatttttcatatcttttgtcttcttttcactttttctttctctgtgtctttctctttctttgtcttattttttatttatcattgaatttatctatcactaaccataattaacttgagttaaaagtattattaatgttgatgttgattgcacaaactaaactaatatattaaataagaaataaaatactactacttaataagtgtcttaaatacttctaatttggataaaaaaataattgactaatagaaaggtcaaaggcttttattctttaatttaaatgtataaattattgtaaaatggaaaataaaacttgatatattaatttattttcataaataagtaattgaagtagggtcttgctaatcaatgtcaaaaaaattataatcaatacaattttgtgtatgttaataaaaatcttataaataatataattttatgcattttaatataatttttttaaatttcttaactgtactagtcagcatttttcatataagtattttattttgatagtaattttcagtaagcgtctctgacaagattagtgcagcaacaacaaacagcctttgggaaaccaacaccactaccgtgcaacagtcaaaagctgaagcgaaaataacaagtaatttgtctgattgtgaattgtgatgcgatcgaatcggagcatggagggaggcaacagaaatgggtacgcgtgggcagtatctgctggattcaacgccgctcttgcagccatttccgttaagctccctcttcaccaggttaggttaggttacattcagattcgccttctaattttcatattactgtaatttctctttcctttaattgaatcttagattagatatatatatatatatatatatatatatatatttatttatttattagtttgtcaggtacgggatggtgttattgttcaatgtcaccatgtgggcttgttatgtcaacagccttaaagctctctcctctcttcaggcaactgtcaccaatttcgctaccaattttatctcttccggtttagccggtttcttcttctttcacgaatcactctctttccaggtatactttctctgatcataatgttgttatgactatcgcttccaattaatacaccctctcaactttggttcatttttatacttttaacttgtctggaggttactccatttgcatctcatttttttttttttattagcaaatgttagaatgttagtttttgttagcagaggaatcaaatccttgcctttttcccccgtttcttctctcttaaccatctaacccacatgatcattttaaaccatctccaaaactatatgttttattattgattcttgttaatgattttagactcttcaatttcaacatttttgaactattatatctttcgtttgatcttggaaaccaaacactcttcccatcaactggaattgcttttggattataagaagtaatcaggttaacttccaaagtgcttcggagttttttaattgtggggatagtaattttggtgtcaccttaaattgagctgaaggaatccgggatgagtttttttttttttttttgtgtctttgatacaattttgcacatcaagtttatctttgggttttcattttcaaggggcgccaaactgatgatccttaatgttgttctgctttttagcactaacagagtagaggaccacttggtttttctgtctgttactgatgcttacagtgctaatgctaaatgactaaaccaccaaagaactcatggccccggttatttgcctcttacgcattcaccttattgattcatgcattttctgatgtataaactgttccacagtggtttgcaggtgccatacttataataattggtgtagtaatacttagcaactcaagtattgagaagaaggctagcactgattaggtgttacagttcaactcaataccttttaggcttgtttgttcaagacggaggctaacatctgcaactgcatggaagcaaaatttggacaagaacttggaaatatcaggaatagtaaagttagatagtttccagggcagttcaattgacatgaaacaaacacagcgaaaatcgcttcttgccttcactgatttaagaactcttgttatatatatgtcattcaggttgaggaattgttattagccacaagcaacttttggttccaccattctatggctacttttttaaatttctatttgtattgggatctcaaggttcaatatgctatatttatggatgtcgttcaaaagttacgtgcaactacaagttttcttgctgatcgaactagctctcctgcctatccatttctatgaattcagtcgttttagtaacaatgtaagtaggattttacatatgtgagagtattgctgcccatctaataactcagcatgacatgcgatacaccagtgctactggtgagatttctgcattagatgaccatgagatacaactacgagtgagatttgatggtaaaagagtgttatagattggatgtgactgatgaggctctattatatttgctacaagaggatgtcttttttgggataagatggaacacttttgagtctccacttcataaagcggtttgatttgaggtgtagagagatgaatgagataatgttgttaaatagcattaagggtgtcagtcaaactccttttggttagattttcctaaagcacaaaccaagacaattggtatttttttttataaatatttaaccactctaaattattcttatgttaatgtaaaaaaaaatgttcttctatttttaattaattaatatttaaaatatgataaagaaagtatcatcagccattcactgaatttattaaaagaatttctttaagatatccaaattccaaagccatatataataatcgagtaaattataattttacttcttgaaattatgagacgttgttataatagtctatgaaattagaaaaatgtttaatatatacttaaaattaaaattattgtcattttaatctggacatatacaagtaactatctttataatctattaattttataatttactttcattgtagtctctctaacaaagctagtgttaggatgaatatgtgactaacaaatttcaatttcgagaattcgtttgacatttttttaattttaaggatttttatgataatattttacgattttaaggactaaaattgtagtttagtttataatgaactatcatgatttatttaaccaaaaaaaatataattgtacaataacactagcatgatattttgctaaaaaaaattattaacaatatatttaaaaaggattttaaacatttaaaaaataatgcttttttattatgaatttaaatgaaatttaatgatgtaaaaataataggaagctaagtgagtggatgaaatgaaacctttgggtccttggcttgtgggaataggagagtgatgatgatatcaggaagtggaggaaaatcatcgtggagttcatcaacatcgtcatgggtacccacaacctcgcggcatcgggaaagaggattcagagggaaatggtcgaactcaacaacgaccctcctcctgattgctctgctggccccaagggcgataacctctatcactggattgccaccattattggaacccctggtagctgcgtaaccctattctattactattaccattactatcactatgaatatcatgtttataataggtttcttctttgcttgcaggaacaccctaccaaggtggcatatttttccttgacatcaaattcccaattgattatcccttcaagcctcccgaggtacatctctcacatacacttctttcaactaatccatttcatattttcttgtataagttgtttcaatttcacgtgtatttcgctcatatttgtttgttttatgactacatgtttggaccatgtcatgtcttaccaagcacctaggtcattcaagcagacagtacatatgacttgctccatcagcttattaattcaattttgcaaggccatggacttgtctttgtctgattgttatgtttcacattcagtataagggctcaatctgacacttgagccatgaggctctccgcccaaataggctagtcttttgggatggactctcgtttggggtttgagtcataattgatgtcaaaggtaacctgaaaaggagtgattagggaaatgcatacctgtactataagaatcagaataatagactagtctttttggatgagtttcctcacgggcttacttaaagtcaagactagggtagtgtcccttcaggaaaagcaaattgattataaggaccattcaactatgcaacacccttgtgcaaataaggatatgaagtgtaattcttggaaaatacataatcgaatgtttgtgtcactttttctttccaagatatataactactagatggtgtgttattgtatttaacaattttgatatgtattccaagatatgcagacaaaccagaaaatgtagagcggttgaagtactttcattgttttttaccgtcttaaattaaataattgagcttgcaggtagtattcaaaacacgcatttaccactgcaatgtagaccctgatggccgtgttagtgtgggaatgttgaaggatgattggagtccagcgctaacaattactaaggtgctactagctgttagatcaattttggcaaatcctgatccttgtaagttcttcccacctcttattttttccattttgtttatataaataggggttgatgatggtttgcatgttagttctattcttcagccttttgctttcaaatacagcagtagaggcagatcttgttatgtgccttgttttggagaagaagcacgttttaacaggacaccaactaatggtttatgtcttttgtcgctttggattcaattaacttagggggttgtttgatttgggaatacattttctgttttatttcttgtttttacaaataattaaaaaaaatgttaccttgttattgcttggtttctttttttaaaagatttgtataggaaacaatgacacttttaaaatttgttttgttttcattgtttcctatggaaatctttgaaaacaagaaattattcctacatcaacttcttacaatacttttaacaactaattttttctttctatctttcttcgtcatgcgactcatcttatctatcccatacttctcttctcttcctatctctttcctaatttgtaaaaaatgttgtggtagtagaaatctcctttccaaccatgtaatattagtgatgccaacactttcaatcaatataacaagtaggcatttatgatttatgatcttggagtgtaaagatgttatcattgttgcagataattatgctgttgtccctggcattgctcacttgtatttgggagacaaagcaaaacatgatgatattgctgcagagtggactgtccgatttgccaagtgaatgggatacaagtgccctttggttggcttacatcttatatataatgttccaatatttatgtaaatgagaatgatagttaatagaagtacgtagtaacaagcttatctcctccttgctcgctgttccagagagtgccttaattgattcgtcataattgtaagtggataatgataatcatgacatgctgtaaattattttcatagttcttgattttatttattttgttttattaagtttgtttatttaaccaaatttcaggaaacacgtcaaacattgttacttttagggattccaaagttattgagttatggatgctatttgacacagtttgatgatatctatgaacagcaagaatgatcatgtatttgagaagtatgaaatttagaactgttttcgaaagagccttgacatgcattgaaaatggtactgaattgacatttgggtggggtggatttttctgcaaatagttattgtgaaaaatccataggaaacttggtgagtttcttgtggatatagatctgtaaaaaatctgctggaaaattcaaagtttcttatagttttattttcacaggaaaaaccatatgttttgctaatgtcataagcaaagttgcaagaattttttatacagaaataatctgtacgaaattgataagatttttttagtaaaatgtactcgattatatggacatgatttcgaaaagttgcgataactatgttatttaattgtgacattattatttcaaacttattatttgattttagggttggaattaaaaatctagaatctgttaacttattatttcgagcatttggaaataaataccaaccagctagcttatgagtttaacttcctacatcagtgttttttctaatacacctaacatattttttttattttcaactttaccctcatatgaatcagcaattcgtatgagtcatatggattggcaatccataggactcttacggatcaataatccatatgactcatatggattggcaatccatatgacttctacggatcgataatccgtaggagtcatacggatcgacgatctgtaagaattgaatggtgtatgtcggtatgtaacttacggattttgaaaagggcaaaattgatattacattgtgcatgctgggtgtattagaaaattagctggtgtaaaaagttaaactcctaccttatttattatatattaacatatttgagttgattatttttttgtctttttctagatagacttttcttttcaacacgaaatatggtttgcataatgcatgtgtattttgatttagtggaacaagtttgcatgcatatgcctcctgacttgagcaaactatggatagtttgttgcttgaaaaaatcatggtataatttgagacaaacacctattatattggcaaattcacttaggataactatatttgggtaaaagtataagggatacagtgaaatattttttttcccatcatctctactatatatatagatctctaaatacgaatctnattgtcagttcgtggtaattctaaagaaatttctcttaataataaacaagactaattatacttgtatttcgtgagattcatagtatgctcgtgtttctatttaaaatggcgttcgatgctaatctaatactcccactgtgattaattataagacataatttattagtttatgattataatatattttttcaatttctataggagagagaaagaaataattcatgatattttaataaaaaaataattaatatataataggaatgaaataaaatcttgtaataaaggataaaaaaattatttgactaattcttataaatagaaataaactaataaaggaagtaatgtctttcatgtttatacttagaaagttaatactacttcttataagtaaaaaatgatgttatacgttgaatttaaatataaataaaattaattatttttgtcatatttaatgatattatttttaaaatatttttatttaattttaattttattttttcaatgacttttttattggtgataataaatttaaataaaaaatattttaaagcctaacaaccacccatcaaaaagagttaggtgacgtgagcgagcgcactccgtagtcaactttgggaactgaagctcaacaaccacccatcaaaagcctttaactttcaagttggaaactgctgcggagacacagagagagagagatggggaagagcgtgcgggatttgggagtggaggatttggtgaatgcaggaggcttaacagtgtcagaaggcaatgaattataccatgctttgagggatatcctctctgagtttcagtctccttcacacatatggcgccaaattgtcactcggagactgctcaaaccatcttaccctcactccttgcatcagcttctctactactctgtttatcactctcaacattcttccctcccactctattgcttcccttctctgtatctctctcttactatgccttatcacttaccactacctcaacacaaacgctaattcatctttcattttttgctttttgatttcagagagcaatccaaacacaccaacctgggccgtctcatggaaacccatgcccctgaccttttaggagcttcctacaaagaccctattactagttatcctctatttcacaagttttctgttcaacaccctcaggtaagcctactaccctcccacctctaattcccttttttattctagtattgtgttttcaacgtgtatcatttgtttgtgcagctttactggtcccttattctcaaggaactttcagtttcctttgttgaacctcccaagtgcattttagatacttccgacccttctaaacatggtgggacttggctccccggttctgtcctcaacattgccgattgctgtttgcaacccagttcacacccccacaaaacagatgacactttagccatcgtttggagagatgaaggtttcgatgattccgaggttaatcatatcacgcttaaacaactccggcaccaagtgatgtaagccattcaagttacactctcgtttttccacaaaagttatgttaattataggtagtctgatctcttgattttttctttaaattgtaacttgtgctaagtcagttatttaaatcatttaagagatatttttcaattgcatcattgcattgagttttgcactgttgattttgtgttaatgtatatcattttgatattctttgtttcggctcttttcctacttgtgtcttactttatatgatgattttttttttcctgttgttgccatatgatttccaggttggtagccaaagcaatagatgccacattctcaaggggagatgcaattgcaattgacatgcaaatgacagccaatgccgtaataatctatttagccattgtcctagcaggatgtgctgtggtctcaatagcggatagctttgcaccaaaagaaattgcaactcgactccgtgtttccaaagcaaagggtattttcacacaggtgatgtttcaattgtaaagcaagctactgttgattgaaatggaaccattcaatatttggaatgtctctgttctttcttacttatcatttgtgcaaataatactatttagtatgcttgaagcaatgctaacgttactaaatctttattatgttggagaataaatactgtcctttcaagttcccttggaagcttaagcatctatattaggcatttcttgaaggtttcaaatttaaatgcctggaactgaacacaaatattatcttcagaagcatgcatcttgtgttgttaaaaactccttttgcatatattagaagcttcaaatttatagcattggattagatacaagcatttatacaatcaatatctgataaatacctattactacagccgatgcgaatgagtagaaatataaagggacaggtagggccttactggattaatgatcacatgagcaagtgaagcgagggaattttttgtaagttgtaactgctagacaactggcagaggggaagaggaatagttagcattgaggaatatttgaaatctgttaaaaacagggaagagtgggaattgggaggaggctagtcccttgaagtgctagcctagttactttaatgttccgtttctgtaatctctggtttaattcccggtattgtgcaatattagacttaatttctatgaatctccaattattttagtaacaaattaagattgttgtattttactcaactttattttgttttcaggatttcatagcaagaggtggcaggaaattccctttgtacaggtaaacaattgttatcattacacccatagctacattttcagcagtttaacttctaaatactaaaattgtattttaaattagccaagggttctgatgcctgtgtctaatttatctgttcagattatggtaggcatgctaagtgtaatgcacacgtcaagcttatttcctgttatacttaacttttggaacaattggcaacttaaccttcattgtagttaggttatttcatattcatctgttgatccgtcctttgattaatgtttcaatactgtgtttttacttaatgtttctgattttaaattcaatgccatggtcgaaatgatggaaaaatgaagtgttgggattactgatattctatttattttgtatcagaaaaatcccagtgttagaatataagagttaatctgaaagtaagtgatgttaaatcatcaaagctatgttgtatttcaggacatgtttttctggaaccctgtttcctttttctcattttctattcacttatttttttgtgtatgtgagaaaaatagtgtcacaaatgactggtttcatcaatgaatttatttttctgttataaatagaaaattcatgttaaacccaaattcccaatcataataagtcttttgcacattaacaactcagatgctaactcaaaattctatatcataaatacgttactcttcttcatgctgatgtttgtgtagcattccatctaacctcttcctatcacatctcccaaatcctgcttgaatttaattattctacttgcaatgtctcatttcttatatgagtacttgtaataataaacatgaattagttcaatatcttacatgcatgctttctgatatgttgattattgttcctggtgctagttataatctctaaattatatctaaacagacctctttaatggtaacaaaagtaattaactgtggagtgagatgcaccaaaggtagaagccagctctccctttacttggttcactttaatatatactgattccccaacttatactgacttaaatgccctctcagattgctttgctgtccaagccttgtaaagatgaaatgtttcaaccttggtagtgctcatgtttgtatgtttgttaaatagatttatggctgttctttaagcacatagaccatgtttctccttgcagtcgagtcattgaggcggctacatgtaaagttattgtgctccctgtgatgggtgaagatgtaggagtacaattaagagaacaagacttgtcatggaaaagttttctctcttctgccaggtaattcatactgcaatgtcatcattaaacaatatcataatataaacaaatggtcatttttggtgactaaaataatcacttctttagatcccagaaatggaagagagaaaaaaggagacagaaaaagaaagagaagttgcatttttttcttgtgctttctctcatcttaacatttaactcttggcaggtcagatcattactctccaagctatcaatcagttgattctatcactaatatactattctcttctggaaccacaggtaaagatcctctcttagaatatatcagatagaaaataccattgtactgattttctggttatattttgactttcatcaggggatccaaaagctattccttggactcaacttgcaccaatacgaagtgctgctgatggatgggctgccattgatattaaacctggagatgtgtattgctggcctacaaacttaggatgggtgattggaccaacagtattgtatcattgctttctaactggtgcaactctggctttgtaccatgggtctcctcaaggtcgtgattttggaaaatttgttcaggtaaattccccaaaatcttatattattttttttttacatcttttctatattttaatcacctaaaaagttgggaccacacaccttaatgtaaatgctgattagtaattagtgacatcataattgccatggttgatgtgtattgtattctgcatcaatagagtttgatactttgcaccaaagcacaaccttattgaactacaattgttcaggatgcaggtgtcaccattttgggaacagttccaagcttagtaaaagcttggaagagtacgcaatgtatggagggcttggattggacaaagataaagtaatatctgtcagtagtgtaaataatcaagttgctactaagaaaaatgaactgaactatggttatatgcagaacattttgttcctctggagaaacatcaaatgttgatgatgatctatggctttcttcaaaagcttattacagtccaattgttgaattgtgtggaggcactgagcttgcatctagctacattgcaggaagtccgttgcagcctcaagcttttggagcatttagcacagcatcaatgacaactggttttgtcatttttgacgaaaatggagttccttatgtaagaaaattttctggatagtttgagttctttggtgatgatttttatttacttatgctgccacttgtgacagcattacatcataccatatctgggtgcaattttgttgtttgcagtgtggctctgtctattcttctcctctcttcaattcttttaagatttcatactcttcccaattgagttgtttgcattttcactagcagatgtccaaactattaactatccaataaatttaaccatcttatcttcatatctatgggcttagataaattataatttaggttttctaatttatttgatctctttgcctaatatgacagccagatgatgttgcttgtgttggggaagtgggcttattccctctctctctgggagcatctgacagattgcttaatgctgatcatgagaaggtttactttaagggaatgcccatttataaggggaaggtagaacttcaattaatatgcttagaatggttttcacacttagatacaactatcttcaaatattaattctttcatgtgtgaaggataccatttctcctctgatctggaagtatgttgtgattacttatatgctagaggctttttttgatggccctgtttcataagcacttgtcttcatgcacaattaacaaattacaaactgaaaattaaaactaattagagtgaaaatataggaacatctttcattctgaactttgtctgttttatagttggttatcaaatgccgccaagacccatgcaagcttttgatgtccaaaatactgtaaatccgtatgatctcgattaaagatttttaaataatcccttctttgtaaactacataataatagaataaactaaatttgtaattttaactactcattctattactatggttataatttgtcatgtctaattgtctatcattgtaaatttattaacagattcttaggaggcatggagatataataaaaagaacagttgacggatatatcattgtgcaagggagggctgatgacaccatgaatcttggtggaataaaggtatcattattacatggaaacagctgaattagaagctaatcaggaatttcgaagattctgatagtaatcaaagctatcaaccagggaagcagtagaagaatatagctctgatgaccaaagaaaaaacggaagagtgtagaaaaaaaataaaaaagagaaaatttttcattccttgattcacgatatctgatcaactttccatttgtaaaggtgcaacataaattacaagaaaaaaagaaacaaaaaaagataaaccataaccaacactgctacacttgactatgtgctacaatcgttccagcttaacaatccattccagcttggcaacaattagaaacactgaaaacaactgtaataactttctgttaagaaaagaaaatttaactaatcactccagtcagtgtagaactagaagggggaattactatgggtgaagtaatgtgaaatgatggtcctaggatgggggatgaagcttttgaaggataggtctgcatgttagacttaatagtgtgagaatactatatctttcatgtccatggtctgcataaacttggtaagaatggaagatactcttaactgatgttcttcagaaattcttaaaatcatttaagaatgctttatcttccattcttacacatatggtgtaagaattctatcatagctttcatgtccatgatctacaagtacaacttagtaagtaatactctctaactgatcatagatatatcagatattctaaaactcacatgattgttgctcttattttgccattcctggactcgttttaacttttaaccttgaaatttctgtttctgatatgcagacaagttctgtagaaattgagcgtgtctgtgatggagcggatgaatgcattttggagacagctgccattggtgttgcgattgcaaatagaggcccagaacaactggttatatttgtagttttaaaggaaggatacaattcaagtgcagaaactctaaagatgaaattcactaaagctattcaaagcaaccttaaccctttgtttaaggtctgactcttagttggttttaaacaatattgaattggttgtggtttattaatttgtgaaaactgacatgacttgggatgatacgatacagttcactaatacattcacaaactcttttcattacataacaggtaagccttgttaaaattgtgccagactttcctcgaacatcttccaacaaaatactgaggagagtaatgagggatcaaatgaagcgtgagctatcagttcagagcagactttagtgaaaccattaattctcaaaagatcagcgcctagcagactcccaacattcagcatcttcatgtggaaaaataagtgaaggattatttggtttgagggatgaacatgatagatagtccttggaattggtatgcagattttcactgtaatatagcataggctatttattagctgaagtccttggtgtgtaatcaaaggcaaaagctaagaaaagaagtactaccggtggtgggtgaaaatataagagatgtaagaatataaatatttttaagtacatgtagcaaaaaatacgtatatctgggtgattttcaatgctctatacgcaattcacctttatacaataaaaataaagtctttcttttctttaaaatgaagacattttttttccatagatacatgattttatcattattcaatatttttagttaggttaaattattaattacttatacatttttttacatgaatttttttaatgcatgcttttaaaagatgatatattttttattgaggaattgaagaaagaggttaactcaaaactttagttccaaagatggacattgttagcaaaagtttttcccttgagttaaagtaaaaagattatgtgcatcgactttttagcaagaaacaagaggaaagagatttagaagtaaacatttgagatgtgatatcgcatgtttctaatttaagtaatttcagatcaatattacaaaattatgcaaaaattaatgacgccgtactaaagacaagctaggtaattaaaatagaaaaagacatcggaggttattggtgactaaaaaatatctaccaagttaaaaaaatgaagttttagtgtactattaaagattagtagagggtgcaaaaaaagtattacacaacagaaaaaatttgttttggttgtgtatagaccctcaactacacaataacagagatacaaactttgggggttgaaaaagcaatgaggggttgcgaatagtaaagtccacttggcagccttgacaaaaaaaacacaaatcatgaaagagattttcttcctgcaccattcaaaactcagagagtaccgtagttaccagaagtgacactgtgacagagtgacgaggagaagaaaggcaactacacacatacacacccctacttaactcgtttcagtggatagcgctcactatttcggaaccccaaaacaaagaaagtaaaggttcatttagttaaactttgggttatcccgtgtgttttgactcctgagcaccagctgtttgataaaataatccaaccattagtttccatttcttttaatttaatgttttcctaacttctctgtttctttgctcgataatgttctgacactcttctcctgtgtgacgctgctgaacagagagagagactcctcattcaagataaatagatgaatttccgttgacaacgttgtgaagttatgaaaatgttgtttcttcaaaccactgtcttacctagacccttctcacctttttgtgatgctagtttgcatccattgtcatcacttaacattcaaaatcctatgttggaatgtgctcacagcttttctcattattcccctgtatctagccaccgcattgtaaagtccatatcatgctctgtttctagaaagtctcattcaaaacccgatcctgaacctccggaacctgaagctagttcgaaccaaagagcaaggcctaaggcaagaagcagaagtggccaatctaaagatgtggtatccagcaatggtgataaaagttcagcagagacattccccactacgattcccaggaagccgaagcgtggtcgcagaagtgaagccgtggcagtggaagattttgtacgcgattcgctcgagcgcacgtttgctgcaattcgggaacaaaacaaggatgctttggagaatcatgagaacataatgaaggagagggatgatgacagttctaaatctgaaagtggtgataaggacgatgtcaatgatgatgaagaggaagatggcggtgaaggcttaagaaataagatggtgattgaggaagagagtaaaagctggcctttggatgcagatgttgggtggggaataagagcttccgagtattttgagcagcatccaatcaagaatgtggtgggagaagatgggtatgaaattgactgggaaggggagattgatgacaactgggtgcaagagatcaactgtttggagtgggagagttttgctttccatcccagccctttaattgtccttgtctttgaacgctataacaggtaatttctactgttttgggttttacttgaaatgctttttgggtatggatttgctggagctaaagagaatagaattattggtaatacttaagacaagagtgggatggaacaaatggtaaaactgaatgagatggtaaaaacttctcaacagcactcttaagagaagaaaataaaatggacatgggagaaaatgaatcaaacttcttaagttatgttcttcaacttttttagaagcttccttttttaacttctctgagtactgataaacctaatagcgctcagcacctatacttcccttatcatagacagcatttggaaacatggggtgggacaacttgctggttggttaactttggatactttttctccacatgcatttgaattggggcccaagaaaacagttttcacatttgatttgattttctttttccccgattgaaattatagaagtaaaactgaactttctttcagaagtgagaaattgtatgtatccatttttagtttataatttgattctcgtctctaatgaagtttcttcttctatacacaaaattcaattttttgaaaggttttctgctggcaatggtttgctatacctacttcttttaagatgtcatttcttcacagaagataattttggtttattcagaggcacgtgataatgcacatgagtgtggaaatgcataaaaaaattgtatttcgataagaaattctgtatttaattaaatgtttctttttgtttgtaaaaattgaatatagaaaatgccacatcggatatataatgaatgatacgttggtagcgatttcaaataatgttagctatttatagctaattttaacctctagtttggtgtttgattttgttttttccacagggcatctgataactggaaaaatttgaaagagttagagaaagcagtaaaggtatattggagagctaaagatcggttgcctccccgggtacgatcatttttctatttcatgtgataaaactgcactttcatctatttatacatgcctaaactgaaaagaatgatgttgctttccatcaatgcaaatcttccttctgattaaccacttgttagatttataaaattatattttctgttatttaattatcactatacaaatgttacaagtggtactattttagaataccgtgtaacatattgaatttcctatttataggcggttaagatagatatcaatatcgagagagatttggcttatgccctgaaagttagagaatgtcctcaaattttatttttaaggggtcacagggtcgtgtacagggagaaaggtgagatcattgatctttctcttccctttttttatgtataccagagttttgtttggttggtacaaagaaatgcacattctctttgtctaggctcttcttttataatgatgcactgttacttgtacctttgcagaactccgaactgcggatgagctggttcagatgattgcatttttctattacaatgcaaagaagcctgcgtggatagatgataaggccttgtatactcgttattaatcttcaagaatgtcatatagcccttggacaacctgaagattgcgtgtctttgtaatgaaacaaacaaaattgacagcaattgttttatgtataaaaaatataaagtactgaataaaagttaaaacaatcgagcactaccaaatttagaaattttaagtggaatagtgagtatacatattcattgttttatcttctacgcattagctatggagttcgaagtcccttgagtaaatggtctatacactaataatataaaattatgttataatttaatcataaaaaatatcatatatgataaatttattatttttacaacaattgttttaaacgtcacatgtagcatatttttcatcgattaataatgtagaagtttctgcacaagtatggaagttaaactcagaattttttggttttttaaaattgtagaattatattttgtgaatagccattcacaagaaacgttcgactctagctccactcattggtcataaatcataatcattagtattccttggtggggtggtcctcttggctttcaagcgatgcatataactgaatatggtgatgtttatggaactaaaaaataatattaataaaaacaaacaaggagtggcttatttgttttggattctattctaagcaggctttgaaggaaacatacaatttattctctttcttttacgccaattttcgttcaaaaagaatctttaacaaataaatttaaaacattggaaaacaatgtgatctttatttaatacttttgtttacatcttcttaatcattcataacaaattattaaaaatatacaacgtcttcattaaaaaaatataaattcaaacataaaaaagtgttgttatgctgccaccttcgccaacagagtgatgggtgtggtttacaagttgcaatgcccgtctagatccaaatttggtgttacatatatcgcgaagattgaatcttaaatgttttaccttgagactcatttggctttagaataagatacatttcattctctttaaaaccttgtatataattaaaatttgaaacatgtttatttattttttgtccttaattaaagaccgaacgaaaccaagcttttcacattaaaacacaaaggagtgcaaaaaggtgggaaggggacaaaagtttgatgtgataatcgccattcaacgacaaatcctaagggagaatttggtatttttgagcttccacgagttttatatccacagcagaaccaaccaattccacaagttggcacctctcatggaatcacatgtcctcgtgtggagcaccaacattagataatagatacagcaaatgtccttcatgcattccttattttactcttgtaatcaggaactgaaccagaaaaaaatgataggaggggaaaaatgacattataaattttatttattttataaaattaaggatgaatggagagtttttaaattttgattttctgatagaacatattaagagaacttattattttaggggggcaattgccccattttcttaaacctgggtcggtctctacttataatccgtatcctattgtcgttcacatgattattatgcatagcaaatgcatgcaaatttggaaagctccatgccaatatttaatcggtaattgctaataaaatactactatagtggagaagttttttttattagtaggaataaaaaataattattaaaaaatttacaataaatcaataatttacttattttatttaatcacttgagctagaatttcttaatataatgaatatgatcgatgagtagagtattatagttgttaatttgctatattatcgaccataagctttcttggatacatcatccggtctatagattaccgattttcatttgcaattaatttgatcatcaaaatcgattttaaaattttgacatactgaaaacaaaggcaagggggtgtatctctcgttttatcgcaactaaagcaaaagataaggaattgacatccccatggacatgtgctgcgatggtccttgcttactttttagtttttactagacctacgtaaagctcattcgttccaagatcccaaagaaaccaaccccacttcacacttgatggagaggccagactccagagcattcttccttttccgttttatcatacaatatatatatatatatatatatatatatatatatatatatatatatatatatatatatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaataatctaaggtatgactattaagataatattataaaagttaataacctttaattaccatgcataacaattttaaaatataaaacatatgtaccatcctatcagacaggtcttcaatattgaagaatctactgccttaaaatgtttgaatatagatttttaagaggctatcgtcaattagacttattagaccgtcgcacccaaaattcgtttctatccctaaggatatgataactaatcttcagaaaaaaaggatgtgatatctaatactacatataatttcagtggctttggaagatatttgaaatnnnnnnnnnntatctcttgttaataacgtagtaagaaattatcaaacggatcggtgtagtaatttacaccaatatagcatagtgctgattcaaaaaattatcaaatatttttttttggcatcataaattaagaccactgaaaatgtcaaatataaaaaatgatatttaaaaataacttaaacttgcttctataattaagtatataaatatatcacaaaaggctattggcaacaactaaaaactaaaatgcattccatatttttttaacttctacttgtttcaattaggtggcatcatcaataaatatatttttaaaaaatatgaaatatatctacttttatttacagaaattaaatctaattattacttatctttcatatgaataataggtttataattaattatcatgagaaaatttagtattttgacgaacaaaatatcacaaaaaattattatcaccaataaaaataagaatttgtcattctcatttattcacaaattaatnnnnnnnnnnaacaaatcaaacatgaaaaacaaacatttaaaaaaactaaaatttgattttgtactaaacgctttctagatgtcaagtaaatcgtttatacatgggtagtgtaatttttctttttatatttttatcaatttacaaattactatataaaatttattgaccatcgtaacaataatagtttctaattaattgagaatataaaattttgtacactgataacgcacaaaaatagttcttataccaaatattaccttaaaataattacatcctgctagaaaataagcagtcacttttatgtggcaaggatcaggattatctccaataaaaaagagtaaataaataaaataaatgacgaacatggatctcattggccgaaaactagtttcgtaaattacaggaatgccaaggttaataacaaaaaaagaaatgccacattaattctatctcatttgttgtgggagggagagaacaagaacaacaacaacataggcgaggtttacaacatataaatgcgcttctaacttctaagtagtgtgtggtctctctctgtaggtctcgcccaatacctactctcagctcccaagagcacgcaccaccactagtgcacttccttctccttctccctctgtttttcttcttcgctaaacccttttttctatctcactaacaacacaacaatgggagacgagaagaaggccaagcctgctgcttccggcgtgtggtccaccatcaagcctttcgtcaatggcggagtctccggcatgctcgccacttgcgtcattcaacccatcgatatgatcaaggtgacgtcaagtttttacctttccgtcctttttgtatctattcctccaaatggacttctgggtctgttcgatttttgttgctggattcagatctgtgggtttttgtgtacgatctctgtttttgtgtgttgtggggtttgatggttttggtggtgtaggtgaggattcaacttgggcaaggatcagctgcgcaggtcacttccaccatgcttaagaatgagggtgttgctgccttctataaggtttttacatctcttcccatgctcttgttttttatgttgtttcattttctctaattatggatccttgctttattggtgggatgatttttggtgtattgatgattccaatttgttatgggttttggtatggccagatgttgtgtgttgtgtttgtttcacttgttttaattacctggctatagatctgcaagtggaagtggatttttgtagacgttgttgctttggattatgagttatgaaggggtttcttattgatgagtgactgttttattccagtttgagttttggacatgcgttttattatctaatggtgtctaaaatgtatcatttcttgtagggtctatctgctggattactcaggcaggctacatacaccactgcccgtcttggatcatttaagtgagttgttacgtctatgttcatcactcttgattaatcaaaagtagaaattttgtagtcttaatttctaaggctttctgctattcctttgctgttttgcattgtttataatatgatagctttgataactggaaagcttatcatctttcatggtttctaaggaattgttttgtgtgattgtgactaacttaatggttttaatgctttttagaatcttgacggccaaagctatcgaggctaatgatgggaagcccctgccactctatcagaaagctctatgtgggctgactgctggtgctatcggagcaactgttggtagtccagcagatttggcactcattcggatgcaggctgatgcaacattacctgctgctcagcgccgaaattacactaatgccttccatgcactctatcgaattactgctgatgaaggggttttggcactttggaaaggtgctgggcctactgttgtaagagccatggcattgaacatgggcatgcttgcatcttatgatcaaagtgttgagttcttcagggattctgttggtcttggtgaagctgctactgttctaggtaagtaaccattttactactgtcaaattattttatttgtatttgttggctttagctttatacattgtgatggtatttgtgagacaagtatgctcaactgtactacaccttactaaagattttgcccaaattatttttagtgcaccttatttaaaattttctgctgatgtttcagaagtctatgctttactcccatcgatccccttgtagacttaaaaacactgaaacaaaatgatttagtcaaaccttacaatagttgggttgtcttccacatccactattttatttgccaaaagctcaaaaattgccaacagatacaatagttggccttgtttttactgtttacaaaaacagatttatgttttctaaattttgtttgacccctgagcacatttctattttctagaagtttgtcctctgagcacttgaacagagtgcttgaagaaaaaagaagggaatgagaaaaatctcacagctgtttctgctttttgctttctaaaagacttgtttgggaaacaattttcataacttcatagattttagatgagaaattaattgctcagtgtggaattgttttataaaacagttttaaaaataaacctgtgagaagggaatcaaacaggtccatagtctttccttgttctgttttctatcatgtaggaactgaatttattgttgatgtctccttttttttacaactgattcttatcaattagtcacttctagtatgcggtagaagacaaatatcagtgcatttttgaaaagtttatgcaattcagggaaaataagagagaccaattgcaatatttctgtatgttattggcagagtagtttactcttttgaaactaaccatgttaatggtaggattttcgggttaatgcaccaatgttgatttgggcaaactcttcaagtggatgactaatttagccaagcattgaaaatggtctaagtttagcatctcattcttaataagtattatgcaatttggctctcgtacaatgtctaagcagtaagcagatatgtttctttctatttctatttttttgaacaaattgcgagacttgattgctctttgttgttttaagaaattatggaagcttgcataatattacacatgtcataattccttgtctgagttaaagttttgtaagggaaatctaatatttcatatggattgtgccataagctacataggttaatataatgccaaagattttattctcactgttaccaactaacatttgttcttctttaggtgcaagttccgtttctggatttttcgcagcagcttgcagtttgccatttgactatgtgaagacccagatccagaagatgcaacctgatgctgatggaaaatatccatacactggctctgttgattgtgctatcaaaaccttcaaagcaggaggaccgttcaaattttacaccggattccctgtctattgtgttaggattgctcctcatgtcatggtattattctataatgattcctttgcttttgtttatttgaattaatgttacattcaaggggtttgttaagtttatgttctgatatatgattgtattaattgcttatgcagatgacatggattttcctcaaccaggttcagaaattgcagaaatcctacgggttgtagttcccccatggtaatttggacattttgtgttgaattcaagctttgagtatattgaataatttgttgggtgtgttgtagccctttttggcagctaaacaccaatggagctgatcatttttaagtttaattaatcatgcgactgaagcgggaatttgcatacaaacattgtattagtgatataatataggattggatgcggctggagcagaatagtataattccatttgagcatggatgtcattgagaaacttgtggagatgtccaaaactagaataagtaatcctatctcagacagcattcagacatcaagttttgtaatttttttccataggtgggaagtatttttttttcaaccatatttcttattgagcattgatacacgtacacccatacgtgtatcatacccccacccaacacctgaaataataaacgggtggtagttgaaataataaaataatatatttaaaggggtggctaatggagggataaacactgtttgggtgtttgtgtaacttttttctttcttatttgttgcaagtttttcctttaattagtattttgttggtgtcttgttaaatctaatggttaaaggtaaaaataagtacaacgttttttttattaaaaatcaaatttgaaaatacactggaaattagtggaagacggaagtacaactacaattagcgttgaatttggttaaagatctcatcaaacaatgaattcattgagattttcttgataatttttccaatgttatttttggtcttttatctttattttaaaaggttaaaaagtattatgttataagtgcaatattttaatttaataattataagaaaaaatagaaagaaaattttaacaccacttatcatgtgtatgaaaagatctgtatgcgtgctatattttggttcacttgctccacaagaataatgtttgaatcacactcatcataattttttttttgttattatgttataagtgcgaaatgctcataacttattttgtcaacaattatttttttatctattatatttaaattcaagaggaaacaatttgaatacagttatactcaaaccaacgtacctanaattaataggaataaaagatgttttttataatatggaaaagacattttttttgtgtggtgggggtgggggaggatgagaataatcatatattcttgattgaaaaatatttatcctctaaatatagtaaaaatgataattctaatttatttaaatcccaataatagaaataatatgtttagtgaaaataataaacatagaagtacaataatttaattataatgaaaatatggttaataattatttttaagttttgaaaatgcaatacatgcgtactaaaaaattgtcatattaatatttctagtagaagagacttcgtcagctatatcaactagtgttttcacatatatttttaacacatgatcttctcagcagatttcttttcataatatgtgcaaggaagtcacaaacacggcagctccctttgatttgtttattaataattaatcattaacttctaaacttcaatttggagcttgtcacttagaaatatatatcatgctgtcgtagctagtttcatagtcagcttctataaaagtaacacctacgaagaaactcaataaaaattaaaaagaccacgcagtgccattttgaagttgcaaaatagttaaaaaattgtagtattttcaatcaaattcatacgtgataaggttccattaaaatgttaaaatggcgttcatgttaatatgttataatatatataaaaatatatatgtatgtatatgtgtgtgtctttttctttttggtgactggtgacatatatttcgccgtccatagcttttctctctatatagtatatacactactgcggtataaaaggtttgtttctatcaacggcgctcctcccaatttctgagcatttgctgttcagtttccaatttgtctacacattcaagttttgtttattagcaacaaattattaaaagagaaagaaaatccatcccctgggactacgcgtgaatataagtatatttatattcttaattatgttccattctcaatcttgctggttttcctgactatatataatacgcaaacaatataaaggttcatcaatcttgccaccaacaaataatcttgctgtctttcatccttatagctagaagctcattgcaatctttaggaaataatgacggttagaatttagaaacactattttgtcattttgccactgctcttgaattatgtctctctactgtcttcttgtgaacttccttgttattatcttttgcacatcatcatgcacacatgactacaatatatttcctttttattttcattatcaaggtgtaaataggttctatatcttccttgattataagcttaaggcgggaccgtatgttaacatttattttgaatcttttaattaaaagacatgcttaagaaattgtaataattatataaatttaaaaaaatcttaaagaaaaaggtatttaagtacttttataagaagttagaagtaacaacttctgaaaatgttaaaaaaaacccttaattacacaagcatactcttgattgatattcaactttattaatttgaaataagaggtttcaagttcgattgagctagctactgcgtattaaaatgttaaatacactaaatcatcaatagtattagagatgactaagctcaaacaaaatctgcattatgttacgtgcatgcattgtacatatattcaactacatgtggcctttgtattaataataattcatatggtttatttatgtttaactattcttcatttttcttttcttgtgttttgtagatagtagagatgtgtgtgcacatggactgtccaggttgcgagaccaagataaagaaagctctcaaaaaattgcgtggtacataaaagccttaactttgtgtgcgattgtttttattaaaatcatataattatattcgtgtttagtaataattgtgctaaaacggaatagaagatcatatacataagttctattttatatttgataaactttacaaataaaacaaaacaaacgtaaaattaaaaaacaatagatttccattctactgaaagagggtgaaaccaaaaaccaaaaatagcagattatatataagttctactttatccacgtacgtatcatatcaatcgctatatcagatttaatttatttcgcattgacaacataatgtcattgagcataattgacgattttttttctctctttttgcttctttaatatagaaagaaaagtataattagaccctatttgtgtgtgtgtattaaaattcaaattaattctgtattcaatcttgcacatagctagcgttggctcaacgatttattaattttgacattatggaagagtactaatattgtgtgattttatatgtgaagctttgaggaataaaaatatttatagttgaaaagaaactgatataaaatatattgcatatacctattattgaatgaattttctaaaatttagtgtataaatacacacatatatgtatatatataactggttttatataattcaagagttcaaatggacccaattcgttttttcctgtaaaaaaattataaaatagtgtgtatacaagtcttatgttagtgctcttcaaacatttatcgttgtagtgtggcaagttcaaattctacatccatcttacctattggtttaaacgaattgtatcatcaggagttgatgatgttgatatagacatgaggatgcaaaaggtaactgtgatgggttgggcagaccaaaagaaggtattgaaaacagtgaggaagactggtaggagggcagaactgtggccgtatccatacaacccagaataccatgccttggctcgccattacggcaatggtaattactttgcttctgccaagccctcctcttcttacaattattacaagcatggctatagttatggtgaagactttggctactaccacaagccaattggtgcagcaattattgatgagaaggccgtgtccatgttcagtgatgacaaccctcatgcttgctctataatgtgaagcacattgatttatcgcatgaacttcttgactttttcctgtcaataaacgtgggctacttagaaagttgtattatgcattggcaataccataataaatatcccttgcacatttatatgtatagatacttgaagtggaaattgagtggggaaaaataccaaaccacggtttattctagtagaaatgtgatttgaatttttgctagctagatagttatattcagtatttgatcatatctggtatagggttgattgatttaggtcccaagtcaaaatacatctccataagttaacacgtaccttaggatatcacgagctactcgatcacttggggattacagttctagacttgttttatcctagctaggtttcccaattagagctcaattgcatgaaaagccgatatatccttgcaacaaaattaacaatatagcttctatatcaagtagtaaggtattattcaaataattcttattatccaccaaaagataaatgtatttatcatgaagaagtgtcacattatctaaacctatcttatatataaatagaagtctagagttttgcactctaggtaggcctaatctctaaccatcttatctaagatttcatgttgacttgaatattggaattcttacaactataagttgtcccttttcttgtcaacttgaattgcatacataattaactagaaaatcattcacgatatgacttttctcgatcatttaggttcatatataatgattaaaaaagagtttaaaattaagtttagacttaattttatctttaagttattaaagacaaatttgacaataaattatattttttaataaataatattaaattataaattttatccgcctaagaattaatatgtgattgaccagtttatctacttgttttgcatattttcagagaatagtaaatatgaattttccatccttcaaggaatgcctcggacctttaggtgggagaggaatgttggaggggaagggagggaagggaaaaatttatgtagagacatcttcttgtttgagagttttaatttttgagggaaaggatttgaggattttcaaaactcctccaaagcctccaaagccttaaaattgttgtcccccctatttggagggttttttagaaggaaaagtaattaaaattattattataccagtcagtattaataaaattactattctaccctaatcagtgtaaaatatataatgtattaattttttaaataagaaaaaaattgtaaaaatttcttattaactttctattttcctctcttaatatatttttaactcccaaacaaggagaaagaaacttcccttattttcttccctttccttcccctcccttccccttcaatctcttttcttctcctcccctcctaactcccaaacaaagccttaaggaacaatttgattatttacaaaaataaataaataaataaaggcgccaaagcaaagcaaacccaaccccacgggtgagtggtgattttgcggtgacgccacgctgtatgtctgcttccgttgcgttgcgtgtcgtttacatgaatcagaaattaacagatggcttgttcccacccgcgaatccattgcccattccgagttctgagtgactcaaaagtgcagcgttgtgatttggtccagaagataacaacacttgtgccttcaattaaggattggttttccctatataaatttattatcatacatcacacatatggcaacggcacccttcattcaatcgcgctgtgcctactcgcctagaatttccaatcgcaacaacaagggagcctcacaacaagcccatatagcttcttcctcctcaccctccagttctactttctcttctggtaattttttttttatttccccttacttcttaatttcctaatcttctattttttttttaaactgatttgattgtggatttgttagtgctccaacttacgtttctcttaattaagatcgtttttgtttcattggccaattaaacatcgagcgttgattatttcaattttcgttctgtcattttactcttcgcctcctgttcttgtgtgcacacgagaggttggtttacacgtgggagagcagtgggggtccacctctgtgtagacacaaggaaaaataaaaaatactacttaggactagtgtaaaaactgaaaatccttcttaggctattgcttcctgtaccttcaagttgcttctttgcaccctttccggaatgtttttttacctttcggatgattggccattccggaagccaaaaaagtgatgcagtaaactacatcccccttcttaagctacttacatagtgggccagatttatactgttgggctagagggtgagttctgcttcctacaccagcgctttttccaatacacctacatattttttatttccaattttactctcatatggatcggcaatccgtaagagtcatatggattgtcaattcatatgaatcatacggatcggcgatccgtatgagtcatatggattgccaatccgtatgactcataaggatcggtgatccgtaagaaatctaatggtgtatgtcgatatgcaacttacggattttgagaagggcaaaatcggtattacactgtgcatgttaggtgacctggtactggcccaaggcgctgtatggtccaccttctttgattaatggaaaattgggaagtgacttcaagaccaatttatttattagctgattttgtattttgatactgggcagctagctagctcgttggtagttgtgcaccactttggaagttttcaacgttcatctagttctagaaacttcatttgtctatgctatgaatagggactctattttgattgatagaaggaatcacatgaaaggatacgcatactacttataccagagttaagaggttgtgactgaaactaaagaggagtgtatgaaaatcttagtaataagacaattaataccctgtgagttccaagcttattgatcacacctatctaaccttaaaaactagtaaaatagctgcaatcaaccctgtcaaacctttgaaccccactggcgtgaagctaggtaataaaaactaacatactattttcgttggtattgtatgcaggattgggatactatatggacttttcaccctagactcgataaatgcaacagaaggcatttaacttgaattcaagtataaatttgattttagtagtttattgagaatatcagttgatattacgggtctatatgtcttattttatatgtgcaattggcaattgcataccactaacttattgtccttaattaaggcaaaatacaggtttggttgcctaacattagccaataagaaatcacttgtgttcccagtggagagagtgtaaagtcaagcaccatgcataagcaaaacattcttccattggctacatgcaaccaagcattccctaggtagatagtgtgggtggttttctgccgtgggtcagttcaaatcgaatgcaaccagcagcaatctgaaagttgatagatattataccagtactcagcccaatgcaaccaatttgcccacttcttaggctaccataagcaaaatagtgtgagtaagtctctagtccctagttagtactttagtttgaccatctgttatagggtgatgtgctgagatcatttgaagagcagtaccctttaggcaaaataattcagataagaacttgtttataaaaggtggatccggatctcttactatggaggttgtcactccatggagatgagcaacctccttagcaaacaactaagccaccatttgagccaaaaaggggtgtttcaataagatgaagtgaccacacttggatggccagtccaaaacaattaggattgcatcataccccttagattgaggtagtcttgtgataaaatccatccccacattatcccattatagcctttggtataggtgaggttttgagtagacgtgctggagaatggagatgcggcttgatacttgttctgctagcagatagggtgttccactacaaatttagttactatagccatcgtcctttgccaaaatagttttgcttccaaatgcctatagctcctataagcccctgaatgacccctactgggtttgaatgaaattcaggtagcactgtagcagaactgatgtccattcttagttagctgttataacaattctccccttatagaataggcattcctgatctaaagaataccctggtttctcatttgttttttcctgaaatgaagtgataagtttactcaagtgaggatcaatattcattgcttgttgaattttttctgcatccagcaaaattggccctatgagagctatcaattccccttcctccatttgtgatagtgcatctgtggcccaattctcctgtccaggtctaggccaatagattatgtcaaaatcataacccagtggcttagccagccagttttgctgattttgggttgtttttcttagctgtaatgtgtttcaagagtttctggtaggttaaaactgtaactttcctgcctattagtatggactccaatgctggatggcttacaccaatgccatcaattctttttcataaatgggcttacttagattctacaaaatttaaatattgtatttgtttattgttcatttgatgatttgattgttgttgctctatctttagattgcaaaagttgcttttgttcctctggagttgacaagagacctgagaaggtagaactttccattatctgaaaggctacattgttttttctccttttgcatcagacgttgtgctcaagaatgttgcgttactagagtttgaccttgatgctttttgtctcttgttcgactataatgttctcaagacgacataatcttcagacttgctgttaaagggtgaaatgatcataggacaatgaagtcttccaacggttattgaacatagtctcaggatgatcttcatgatctttcaatcagatggattgccaatttttagtccctgtatgcttagagagaacatgttagcacataatattcttattcatcaatttgctttgtttgttatccattaaaactatagggccagatcatcttttcctcaacaagattcatacatatgccgcctcaaggctccataatgtcgggaaacctttttgcattgggcaacattttttacaattatttcctacttggcttgctttctccatcctctttctttgtcactcttttgtctattttctttttgtagttttctaggtaaaagaccattgttggaataaggttttgatagggaggagagaaaagagagaaagatggttgtgcatatttgtttactgaatgaatataagtttgatagatgtgataaagtactacaacctaatactcctataaacctactaatgattacggcaagtactagtactagtactagtctaagcctacaaacacaaagactaataatcccaatattctaacaacagtattaatattggtgcaaatatatgtttaagttttaattttcattaaggctggtagatgaatttttgcaggtacaaacagtggacagagacaccagggccttagagctcaagctatgagtactgtcactcttggaaattctattgctagcatagggaatttgaagaacgaccctgatcatctccttgttcttgttcatggtatcttggctaggtatgtgatatatttattgagagaataaaaaattgtttgaattattttgtgttaaaatatgagtgatgcttgttttgagctatatgggagtatgggtgaaaagtgaagtttacgtgcttaatgcttttaaagttagctactatattgaagttcagttggaaaggattatgattttcatcctgtttatgattagtgggtacctttccagtttgcctgtcaattataaatctgattcaattcatactctcacaatttagcctatgaatgtgaataaagtaaagtattcgtttcattgtttacacttttacaagttggtttcattgcaaaatttgggcacatggttgtttatcatatgtctcatctgtccgcttctttatgttggtctgtagtttagtctcatacaaagttgtactgatgttttgattgatacagcacaggggactggacttatgcagaagcagagttgaaaaggcgccttggaaaaacctttttaatttatggttagatatttttaactagtggttctctatgttatattgcataatgctcctctaggtctgtaaattgagcttgtttgtaaactgtacaagggtgtatccacccttaaattttagagggttaaagtggttcaaattagtttagtgtgttaagattgtgatgtagttgaaattaaatcaatggtggatgcacccttgtttgtgtattttacatacaagctcactttcgaagagctttttatctaatgtttgattgttgaatcatagtgttcttagtttctttaaattaaatcgttacttttgggatgttcaatgatctatgattctatggaggcaactgactgagataccttaaccagctcaaacataatctgctttacaggtttaagtaaacatgcaaaatttaactcactcttgtgctgaacagccttaactgttcttttcactttctttcaagttaatgctgaaaaaagtctatttgtatcatttggaaagaagtaagcttaagcttcctaagatatatatatatatatatatatataaaatgctgtgaagattttcttgggtattgcatgagtgcctcatccgtgaatgtaaaattatttgtctagctgaagtccttaacaattgtttgttgtttgcagtaagttcatcaaatacttacactaagacattttctgggattgatggagctggaaagcgattagctgatgacctccatttgaaatgtctatatatcagatttgtgttgtcattcttttttaaaacttggaattgtcttggtgctgtatgttgaaattatgagcttagggatagagcgaggaagagagataaaagagaatgaaacactgaattaataatttgatattaagtattaactaagatattacaatgtcttgatgtgtttgatatgtttgtaaaacttgaagctctaactcatatttatactaattaattaatcataatcctggctaattaggtgaacaaatcattgtgagataaagaaatatgttgttaactaaaattaagagataatgaggaaatagggaaactaaaccttgaagataatgcaagatatgacactccctcaagctaaagcttactaagtttgaggctttttttatccatctaatagtttctttgttttcccttctatttttctgagctgagatttgacttgactattctctttcttaaattagtttcttatacatagtcttagtttttacatcgaattatgcatgcttgtatttatattttgagatttttatttttatacaggcatacagccttagaagaaatttttaaatagaaagagtggaaggaggagagaatgccagtaactcttctaatagcagttccgatggaaagaatactagaataggatttgcattatcaccaaacaggtcctaacaaaattttaattttactggagaaatgttatattacaatcatgaaaaaggtgattagaaaataatgctaataaacaggactttttaagtcaaatgaatgaatgcaaaccatccttctgccaacctcctatgtttatatgtcttgttgatgctctttgtgtttctcaacttgaactgaaaatttgccggccataagagttttgactgtttagtgtgcatatatttcagcttccatttctgttgggtgtcccaatcctagaaaagcttgctgcacctatagctcctttttttgttggccagacaggtagtcagttgttccttactgatggcaaacctgacaaaccgcctctcctattgagaatggcttctgattctgatgatgggaagtttttgtaagtgaaggaatctatttgtactagtctttatccctctttttcaattaagtaatctaatacttacacagtttatatttctgtagatctgcacttggagcatttagatgtcgcatcatttatgctaatgtttcatatgatcgtatcctctcagtatgtttttctgttttacaacttgttaggcatatcaatgataaacttatggttcttttctcctcaattttggtaattttttaacttcatatagacatggttggttggcgcacatcctctataaggagggaaactgaactcagtaaggtgaatatgatgatttctccaattggattgtcttattttttgttggttactgatctccaatattcagcatatgtaagtttaatgattaataattaatacttagattatgactaaactaaaatcttgtaggatgcttggaattatgcttaacatcctaactgtgtttatgtcttccatttataatctgttttacttgtcttaactcttagatttatcacttaaatggtaagttgtaatttaaattctacaattgctaataggataactggatatcttctataggtatgaaatattatcaggagttctaatataaattttgttcatgtctcgatgaataatatcaagtaatgaaaataatagaagtataaaagagattgttattattatgattattatttactactttgtgtactagaactgttacagagcatcaaatttccttacccactcccaataataatatgatgtaccctctcccgataataatatgatgatgatgtattagattttatcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttattatttactactttgtgtactagaactgttacagagcatcaaatttccttaccctctcccaagaataatatgatgtaccctctcccgataataatatgatgatgatgtattagattttatcatcatcattgtattaaatttcaacagaaaagggtttaaaagtgaacttgcatctactacatcaaagtttatgtgggacattgtgataaagaaacaaatacgtaaaatttgagagaattaagtctcccatcaaaatgtgactatatttcatttttttaattctttgaaaaatatttgtttactgctgtacttcacttaaagagatataaggttggttggttgggtggttaagaaacaagggaaggaaggaaaggtcgcggttcaatcccttctgctaacaaaaagctacaaactaacaattaatattttgtcgataaaaaaaattgtacttcacttgaagaacttcactagtttgactgttgattgggatcttcagttcttcacattttcagttatcagaatggttttataatttgcactgttaactcagttctttagtagcctaatctctattgtgccttcataattacttaattggaaattcctatgactgcagaatcacagcctttccgcaaaagatgaaagcctgtatcctgaaatggatgtggcagtggttcttagttgtatctgtatcagttgctctacgcagtactgatgttattgaatgtctatattaaatccctttgaaacgaataaagtaaaataaaattgatggatcaattcaattgatactgcaattaaaatgttgtgatttgtgagtggtgttaattctggcatcctagtttgttcgttagcttccgtgttgcaagcgtggaaaagaaactatagatgttgggtaaaggggaaagcgctgcaatccttttttttgggtgcaggttctgttttgaaaagtaggaggagattttgtttaatataagaaaagggaaacgcttgaattgtgaaagttaaagaatgtgaatatgtttatatggtattaacattttctattgtattggcagcctcctcgaaaatctttagatggatacaagcacgtggttgatgtggaatattgtcccccagttccttctgatgggcctaaatttcctccaaaagcagtaaaagcaaaggaggcagcacaaaatgcgccaaatacacagaatactgtagaatatcatgaaattgtagaaggtgattattattgcccagagtaacttattaaaattacgatgtgtatcaattatctgttcagtcactgatattcctctaaagccactaatctttttaacagatgagatgattcggggattacagcagttgggatggaaaaaagttgatgtcaactttcactcagcattctggcctttctttgctcataacaacattcatgtactgcatccatttaatctgtcggatgatgatggtatcactggtacagagtttttaacacgagtgcttgtctgatttcaggtgaaaaatgaatggcttcacaatgctggtgtaggagtaattgctcatgtggccgacagcttaagacagcaagaagcaccatcaattttgtctgctagcttgtaactagtgtactagtatgtaattccactttgcctgggcatgcctaatcctgtgtttgatttagataatgaaaatagaggagatgaagattaaagaattttttttgaagtaaagtgtaaaatgggtgggttccacatggaacccatcaaatttctctcctccctccctaaacctaacacagcctaactacacaatacaatatgagaaaacattcttttattacagtagtcattaatataattacaatattttattattaacatacttaaccttacggtagttcttacttaacagtgattatcatgcagcttttagaaagatacaccatcataccaatggaaacaatatggtttgtgtgtaacatgacttgcaaaacatatttgagcttctacatgttttgactgttatcagaatcatacatttcataatttgaagcttacaatttgataccatttggctacccactgatttatatggtaagataaattttaaatgactttgtatctgatacatgaataaatttatgcaattttgtatcatagataagaattatacgattcaattaaatacatgaatgaaaaaatacataggatttaaattcaaacgatgtaacattgatttgtacatattggtaaagaaaatgcaaaagttatttgaataaaattatttgagtttgatttacttatgaaaattaacatttttgtataaatattggatgtcagtttaatatgagaaccaaaatcctatagtttgaaaaatgagaaatagtacatatataacaactacaataaatcttataataaagagagataaagggaaaaaatgagaagataattttttttgaaatataataaatgatataataaaaagagatagacacataaaatgatgttatataaattattataagaattattttacatgtatcatatctcttataaaatgtagaaaccaaaattaaacaataaaaatattggtactcatatcaactatttgatgatgtcaacatttcaacttcatatcataataacattctaaaaactccataacacttctttaattaaacacaacataatatctttggaataatatcaaactcgaatcacccataaatcatcttatatatatatatatttttttttcttttaaaattaaaacaatataagttttttgaaccttatagagacctgatccaattcattattgattgagttaatatggtttggatttgacctaaaaatgtacaaaattcaaccaaactcatccccaaaatataatggagggattattttttccattttcacgtaaatttgagtgtagcaggctgtacaaattgaaataaatcttgaccattacattatttaaaattttccaacggtcaacaatgaacgtgaccataatgaaccaaattttgtccattccaccatacagtataaatttttaatgtttccgtgtgaacaacaaccccccttattcaaaagacaaaaaaagtgaatttgaaatttcaatgcccaccaaacgccaatcaatttgcctccctttcaatcccacaacgtgaccatcactcactccccactcttcaccaaaagacaaacgcgtggaaaacactctcctcagagcgcgtggcaataccccctctcctccacaacctaacccttctctcaactttcttatacccacaacacaacgcacacagtgacagtacacacaaaaattttctagagcgagaaagtgagaggagagagaaagtagcagatcctccatggcctccaccaaggaacgcgaaaacttcgtctacgtcgccaagctcgccgaacaagccgaacgctatgaaggtataataataataatccattctcttaatttccatgttgagatttcagagtcaccacactgtgctgacctagatgttcaattagataatcatgttccttaatttcggtttagacggttgaattttcgttgttgattttgaattcgaatttcgaggagcacaattgtgagaatttttgagtgtttggtatgctgtgttagaaatggtggaagcaatgaagaatgtggcgaagctaaacgtggaattgacggtggaggagcggaaccttctttcagttgggtacaagaacgtggtgggtgctcgtagggcttcgtggaggattctttcctcgattgaacagaaagaagaagctaaagggaacgatgtgagcgtgaagaggataaaggagtatatgcagaaggtggagtctgagttgtccaatatctgcagtgatatcatgactgttattgatgaataccttattccctctagctcttctggtgaacctactgtctttttctacaaaatgtgagtgctgagttgtcatttttttgttcttcagttggaatttagagtttttgtgtgttgatttaagcctttttttttggttgcaggaagggggactattaccggtacctcgcggagttcaagtccggtgatgagagaaaagaggctgctgatcattccatgaaagcgtatcaggtctgcttgtattttgacctcttgcatctgatgtggttttaatttaaacctggtgattctgattcatggtatctgttgtggagtgtggactatatggttgctttgcatgccaatctaactgaagccagagaagaaaaaatgcttctgttttcactttcctttgttatcagtcacaaatcttgcttattggtatttctttgtgctaaatgaatcctggacgaaagtgcaaagatattggcctgtgtccttttttaatttaccttttaaggtaattggcaagtcaacattctattattgtaattgtaatataaatcatttcattggaaggccttcaacatcaattttaatatatttttaatgttgatgttaacttgtagatgatttgttagccataactcttcactggtgatatgaattttgaaggagtgatttctttatcactaaagttgtgtacttgttaatgaggaaaagattaaccgaggaaaaggggggagtagggatgtagggtagtgcttattcttcaggcataacaacttattatacgttatatatgtcttatgaccacatatgatcagttttacatgtgtggcattgtgacattcatttagatgaaggcatcactgatatgaatttggctgtttagttaccaaagtatttttccgcttgttcatgtttatctgaacaattcataaatatttcagttggcttccactactgccgaggctgagttagcacccacacatcccatccgtttgggcctggctttgaatttctctgtcttttattatgaaattttgaactctcctgaaaggtatgacttttattttattttattaatttttaattgcccacctctttgtgtactatgtgccaaagttggcccctgcttaacaaatttaacacagtactcttcatatctcagggcctgtcaccttgctaagcaggcatttgatgaagcaatctctgagttggatactctgagcgaggagtcttacaaagacagcaccctaattatgcagcttctgagggacaatctcaccctgtggacttctgacatccctgaagatggaggtattcattaatggaaatcaatgaactctgtcaatgtgtttgctggactttgtctgcaatgtaaataaaaatacatgaaaacttttagggttaattacagtattacactcaaatcctctgaggtagtgaggtttaatagaatttcactcgatacccttccctttttagactctacacaaacctctgttaatttgtataaaatgttacaccatgtgcccttccattaatacagatctcccctgatttcttatgtagggaggtcaaagtaatgtgaaaaaagggaggggtaatgggtttaatctcattaaagctcagttgtcagtgtgatttgtctcatttgctattttttatttgtttccgtttgattggtctcataatgagttatattagtggtaaatgtgactcttcttactgggactagatggctgagttttcaagctaatcattgggggtttgcatatgaatttcattcaattaaatttaatttcggagatcgatggtcttcatgaacttgtgcacttagaattgagtttatacaatttttctattgtttaatctttatagttggataacaatttggtcagagttgtttccactctaatatcagtgtgggaactgggaagcattaacatgggtagggttattggacatgacatttgtatgacataggcattcagcattatctttaagattgggacatgggtgccgcaggatatgaaagaaaattgtatgtataaaaaacatttatatttatcattttcataagacataaaaatagcatataaaaacatttggagctaagcagaacttaaaaaattaagagcaataagaggtttagccttgattgatccaatgagtttaaaccagtaaataccaaataatttaaaatgaagggtctccaaccaaaactcaaaccatcaaaggttggttcttgggtggtgaagattgtggctgctgtgttcttgcttgcttgcccatattgggtcagaagcacacaaaacttgaaaatttggctgcctggtgtcagaaaaagtaaaagggtttccaaaatgcaaattgtaaaagcatgcatatcctcccaactggcacacattcaagtattggacattgttagacttacagtggcctgaatgccatacccactgctttagtatttttaggatcaggtgagtttgctgagtattaaaaggtgatgtaatattttgattgtgtcttactgtgtactatacttattttggtgttgttttcgattaggctattgcttctcattttattttagctatttttctttgttctgtggtcctgccaacccaacttcagtatctctgatttccctggttaattaaatatggcctcttttaatagcagaggaacaaaaggtggattctgcccgagctgctggaggtgacgatgcataggtaggttataatacccatttagctgatggtatttgggttttacttttttaccttaaagttacattttgcaatgaagtgaagcaggtattggccaaggaatttgtggagtgcatacgagaaggctagtttctctctggatagtttaccattaggatgttgtaatagaacatggagttggtctctagaaaatcaccatagggctttgtgagccttttatcgtgtgctttctgttaatggagactggagttgagatttgcatggtgtttggctgtaatttagtgaatttcttcatagtgaatttcttcattttgactttctttctaagaggatgctaccttgcattcttttatcagtttacatagataatttttatttaaaattatgcgaatcattgtttcaaaagagaagtgtgaatttacgactttattttcttaatggttgactggacttttactatttacccaatgatatgattgtgattaaataaactatcccaacttcaaattttatttattttttaaagggagcttaatatcacgttcaatctttatgggtacattcacgacaatactgcagacatactgtacgtaaacccgaaaaacaggaacgaaaacacaggcattgcgtaaactaaaaatgccaaattataagatatttagacacccaaatgctttttgacaccttgatagagaaaaatgtaaatatgataaatgatatgatttgatagaaagagaaaaataaaaagataaaaggtccttatgaatcatgaagtgcttaaaatataaagatgttcaaatatcaagcaccctaatatatatatgtgatgattagacaatagaagttatttacaatcatcacccccaatgcataatgaacacaatcctcatcctcttaataaaaataactccatccgaaccaagaatattaggatttaacaatgggcaattctaccttcgtcatagcctcagccctttgttttttgtccttctttggttcggcttctctattgggatttgagggcagagtttactgcgacacatggcacgcccagttcctcaccagggtcagcgagtacatgccaaggtacatgttgcatataagttcttgttaacaatttagcaaaatgaaaaccatacatatccatgcacacttcaattcaccaagaggaggttaagctggtgaagagaatcagcatcagcaacaacaatggcttggtgaaagagcgagcttagacttcttcaagtgaacaacaacaactaacattcaactcatcattggaatccattctaaccattcattaataaccattttgttaaatgtgcatgcataatgtacgtacttatttatatatgggggactttcctagcgtcgtgggcttttttgttgctagctggggtttggatgactggtccaatgtttaatatcgtattggacatgtcatgtgtgtattctcaaccttctagtgtctttcagaccattccaagttggaaagtaaaagaaaagattaccgatagaaccaattatttttagtcttctcattcttcagtcaatgatatttccggagataaccagtttttttttttttttttttttttttnnnnnnnnnnnnnnnnnnnntaaaatttgtaggagatcaaaacatatagtttcattatgttatggaaaagagaaatttttgttgtgaagaatgtctttggcaaaacaatttaactaaataaaatataattatgaaaataatgatattataaaaaaaaccttattaattaacattccattatatatcccttagtggtctttaaatcttatgttttgtattaattattaaagcaccgtactaagttcgacctttatagtatacccgttataattatatgaaactttcctgataaaaaaaaaattacgggtattcattgtgaatttctgagaatcacaattcctttaaatcatgttacatcctttcaaatgaaaatgaaattatcacacaaggatactattacaccaaatgtcgatattaaggctacaaaaatctgatgtaaacatggacgacagcgaaaacaggctgccgtacgtatttcaaaaagttcggcttaatgatttgattatcatcatgctttaatttctgtttcttaaaagcagaaaactctaaccatgttaagtcgatcgaagcatgctatgtctcccatcaaaggcgatggcacaataaaaggagggagggagagtgagctggtttttactattatattatgttgagtgaacttaaaataacaaggtttctttttctgattaaaataacactatttaacactgttttggagtcttaatttgagtacatctagttcccaattaagcttttcgggattaataaatttttgcttataaaaaaaattaacacaaaaaaattataataaatttgtccttacttttagtcattgttaaggactataaggatgaaaaaaaaattgaaagtaaaaaaaaaggttaagagacaaaaaaaataaaattttaaaaaaattaagatctaaaagatagtttaccctaaaaaagatacatggcatattacatttactggagccagtgtgcagcactcttatgttcatttgcaacaacgtcctcccctgttagcacctcttttattagctgataggatgggtgttgttcaccttagattctgatttcgtttttatttatagttactaacatagagtgtaatctatttcaaacggtttaacatgctagtaatattcagacaaaaggaatttaattaacgaaacaagtggaatataaattactgattatcgaggctactctcacaaaattgatgttaattacaacttatccgattaattacatatcattattataataaaacaataaatctgcccacttattattataaaacacgaaattggagtctttattttattttaacttcaaattattttcttatacttaataattgataccgtagattaaacgttttagccggcttctagaaccaagatgtgaacaaaagacggataaatcccctaattttcaaagcagagagaaaataaataattaataaaagtacaatttgctctcaagttttcgtatttacttttataaacttttccctttctttctcattgaccatttcttcagcgtttacgtttacatcaatcaattagtgtagcttttgcggatcacacgtcaaagcaaaggatttaatgtacttgaattaattctatatagattatgtgtgaactagagcatgtatatatatatatatatatatatatatatatatatatatatatgtaggtgagaaataatctgaaccgttcacgtctccaattgtaaaacatgattggttcatttgctgtcttttttcgagcattcacatcttcataatcagataaactttagattgtcactgccttttcaagcctcctttgtttctatctgattcggatgttctgtgatttcgtggatgataacaaattttctttgactttcatgctgagctgcagtaacaagcaattctataagatattttggcccattttatatgtataatatacagaggggatatgtaatgccaaaatattgactatacaaaaaagctagcttattttccaggaacgcaatcaaataattggatcattaattatcactttacttgggtcatgaagttgggaaatttcggagttccatgcacatagaagttttttttttttttaattttctctttttaaataaaaaattacacacacaatgtcctatccatgcttaataataagcaaaatatcaaacaaatgcttggtacacgggaacatatttttcttttgaaataccctatagatgtgtgaattagatgagattattaaaggattacttatttcactcaagttttttgagaatatatatgtgaaaaagaagagactagcaaatagaaggataaaacatagatgcatgtaatatcataaatataaataaatggtgtttttttttttctttcaataaattaaatatacaacacgtgtaacaatgattataagtgttatattttgatcaattatctgttataccttgtgttttattttttttattgagaaacaacaacaaaactatatttaaaatgataattgatacctaagtttttaagaagaattacttaaaaaacctcaaaagggagatatatgttaatacaagaaaaaaggggagagagaaaggaatgaaagaagtgaaggcttaacaaggttgacgttgacaacctgagctcatcctccgtcttttagatggaaaaagctgccggaaatcaccatgagccacggtggcaacatgccattcatccaaagtcagcctctcctccggttcaaactgttgttggacggtggatctgaatccactgtccataaatccaacagggtcatggcacagcggtttgacccttcgcctgccggctcctactggcacgttgcgaagggccccaccagccgtccagtatctctgacagcccttacagaaatgtctgggctgattaacgttgtagttattgaagtagcaaaacttggtttccatgctcttgcatcttgggcatggtatgatcttatcaggtctctttatctcctctgtcccatcttcactattttttttatcttcttttctttctcttccatacaacgtaatcgttgttccaaacagcttaatcccttcactagcttggccactttgtacccgagccattaattttagagagaggaggaaagagagaatattattctgagtgaagaaggtttaggttggggtggaggaggaaaaattgtgaaggtgctttttatatatacaaaggggaataaagctaaaagtgcacaatagttagtacaatcataaaccatgccatgggtctttggcagaaagtccatatgataaacgccaaacgtaggtagaatataaagtgcgttgccaaattacactaaataaaagagaaaaagaagaaaagctaaaaagggtttgggttggggtagtagaaattagaaaaagctatggatgagctttttgtacacatcaggagtctacgtcatgcccatgaagtgctaaaatgtatacatacaagttacaacacaacactggcccaatccaggtagatcgcttacaaagtgtaaaagagaatggagtataatatattgatttatgcaataaatcttataatatacacgagaaagatacgaaggaaaagtactagtactgttggctatttgataagtgatgtgaataaaagaaagagaattatatacaatgagagagaaagtaatttcttgtatttaaattctacttataatctatttaatttcaaatgtaagccagctcatagatattatatatactagccaaaagggatgatctctctatatattccttgttagtttctttaaagaaaaaattcagaaagagaaacaaacgaatattgtacatatattaattcattttctttgagacgactaaatgtcttgacatatgcaaacttgcaattcactcaaagtttggaaaataaggatgtttgctagctgataataacggataattaagtaatgaatggtctagagtctagagtctagagcatgattccttatttgtttagataagtcattgtttgggtgttgctatcctcccacagccaccaagaaatgtaaactattgcccgattggattcttttacactaacacatgttttaataaaaaagattaatactgaaattaatttaagtatatgtcttaattacatttaatgattcaaataattttattacaaatatttaatatttcaaaaataattttattaagattaatttgacctaactttaacaaatccttaatcgggtcagattgactacgtatatataacatttttaaaaaaagtttaacttatttagagaaaattgtaatttgactctttaatccatcctaacattaatatttcataaaattttaattatctaattaatccctcaaaagtttaaatcattaacatattatttcctttaagattttgttaataaataagtcatttaaagattgaaaatgtcatcatatttatccttacacaagactaaaggggaaaataataatctttcaatgatttactgatttcatttactaacggacaagatgtttatgtaatattttttacattaataatataaaaaaaattaaactctataatatatgttaacctctaaatatataatgtcaatatcatcaacagataaaaagcagttgaactagacgtcttaacatgtatattacaatttaaggttcgttatannnnnnnnnnttaatatttcaaaaataattttattaagattaatttgacctaactttaacaaatccttaatcgggtcagattgactacgtatatataacatttttaaaaaaagtttaacttatttagagaaaattgtaatttgactctttaatccatcctaacattaatatttcataaaattttaattatctaattaatccctcaaaagtttaaatcattaacatattatttcctttaagattttgttaataaataagtcatttaaagattgaaaatgtcatcatatttatccttacacaagactaaaggggaaaataataatctttcaatgatttactgatttcatttactaacggacaagatgtttatgtaatattttttacattaataatataaaaaaaattaaactctataatatatgttaacctctaaatatataatgtcaatatcatcaacagataaaaagcagttgaactagacgtcttaacatgtatattacaatttaaggttcgttatagaaaatatttgaagcttggagagttttaatttgttattataatgaataaagaagagtttcataacgaggaaggaaattaaattgaagaaactatctggctctgagaatgagattggatatatattctacacgaacgactcacgaatcaattttaaatatatttcgtgcttttttcttttccgtagacacattgtttcttaaagtggcatgctcctagtggcatttggtagcacttttcacgcaaaaaagccaacttttcatgttccaacagatttttggaaaactttaatgtatttttattttaaaaatactttttacaagcaaccgaacatcacaccaattcaaaaccttactatttaagtttgtgagtattcatcttatattttaattttttatttttatttaatgtaaattttcatattcacacttatatttcaacaacttttgttgattaaaaggaaattttaataaaaaatattatcattgcaaaaaaaaattgaacagaaaaaatcacgtaagataattttaataatattttataaagtggaaagtaagtaatcattttttttaaaaaataaataaattatcatgaaaagttatttttttaaaagaaaaagaaatagacgcaccgtttgtggccttgccaactccttttccatcatataaaatttagttgtgtcaggttcccttttagtacgcatcatttatatgatacttttatgtgccatttttttactaaaggatttttcatattgttaatttggaaagtgatcccatttccaactcattactctgttttataatgaagattaggaagcatcaatttgctttctttatcgatgaaggatacactttttcgtgaggattcttttaaagtcaatcagtacgtatctatttattatttcatcaattttaaaagcaaagttatgtccgagcaaaatatcatagtcatagatttctaattataataagggattaaggggaaaagttggatgttgcatgttgatctaatctagtcacaaaaatcgaactcattcattagtactttttcttttccattttcctttatgcaagaaattaaaaagttcagctatctataaaatattatattcactaatattatgtgcaagttttgccaaatatcatttatttattacaaatgatatcgataataaataagacaagtgccgtaaggctagcgagaaagaagatgcagcaaattgccttcctgaaatgaaatcaaagaggaaaacctaagcaagaatatatgaggtgcagtatggtaggtattttcttagtcaaaatttagatttcatgctgacctttcaaagcaactttcattgtctaagtatagtaaataaaactctaattttaattagagaatattattaaaattaacaactataatactgtaactaaatcttaacctatgtgaaatttaaatttaaactagggagcaatagaagaaaaattcaccaacttccccttggacacaatggtgctgctgcagaagccacaaatcgacgcgatggaacatgaggaacaacctgattgattctttgatgcaagttgaggatcttcaaccttcacataaatatacttctgaaattcagcttgtgcagcaaactcaacccttatctcagaattaagatttgatttaccaatggcactgaggacaggaatttgtgggggtaacctgttaaacaattgccatcatttagggtgcattttgtagagagagaaaaaataaagttgaagaaaataaatgaagaataaagtgaaaagttcatcttatttccagtcttccaaataaaaataaaactaaaaaatttattaattatgtgcagaatataaaatagttttacagtatcatttattattcgtttcaagtacattatatttttactatattaaacctgaaaaacaaatacattcttattttatcatttttaaaagtattgaacaaattatatatatatatatatatatatatatatatatatggtttcatcaaatttctctccatatctcttcttttttttttcctcttatattagctctccatatttgtttgataaaacattactacatcgtaaaccttacaaaggattctgttattttatttttgtaaccaagaggaattttgctttaagcataaaaaaaaagggggggttgtacgcaatctcaaaaattaaggagagtctcaatgtaatttacttaaaagtattttttattccgtggatatcttgaagatacattaatcatgaaatattattttatattactagtgcataagttcttcatactatcaaaaagataaatatggataatatttattaagtatggtattacatttaaaaaaaaagttcatatcatattgaatattctctttttattattttataaaaatatttcttattaaatatgaagaatattttgttttattggtacactctttagattagttgaagatcgtttttttttaccacatttaccacgtattagaggacgtttggtataaaaaaaatacttttatttcctaagtttggtatgtatctaaagaaaaatattttcaagaaattgataatttcctaagaattgtttttacctactttcccgcataaacattctcatataagggtcgagatccaactatggacctatcttgccgttgagagggagataataaattgaaatcaagtcaagtactcggaattatgatttttttttcaggaactttttacaaacaatggcctggatttgtgatctcacaatacatagggtcaacctgatttcctagcccatatattcaaaagcaaaaactaacgaagacattaattcatcatacgataatgaaagaaactgcactacacttaataacagataaacaagatttattcacacgtgtacatacaacaaagcctcaagcaacttcacttcaagaggctaaaaaacataaaggactgctcgtgtatgaaataatttttttttttaaaaaagaaaaacatgtcatgtatcactccagttatcatcatcttcaccatcatcactcgcaacaacctgaaaggttctccattatggatgctaattagatataaacacagttggggaaaagagtaatagataacaaaagaagagtgaccaatacctgacggattgcatttgccttctccaaaattgctgtaactttgacgtttgctgtggaaccagtggtatcatttgactttcctgttactgtgggcctcaggttgaatgcctgaaccaataaatatatggcaagtcaatgcaaaagttgactacaattaacatgatttatttgaatgttgctagtacatgttctggattgatttttgtcatcaatttgtaatttagaggactaattagatctaaaaaataactaagtatttaatgaccatttgacgtatttataatttataatgaaatacgaagttgatgacacttatatctgtggaggaccaaaatgtttagttaaccttaaatagttgagattataacatgactacatacttttgttctgatttgatataggaaatcttctctttcatctgtctcctttcccattctcaactggtttgcttccttctgacccttcaacttctgctgatccagctgcaggaaatgctcaatgagattaatacattgttaaattctaatatctaccatggctgcataaatacaaagttcaagagaaaggtaagaccaaatgttaccttgtccttcaatttatctataatgttgccataagattcatgatcattgtgattaatttgtatttgctcaacctgggtgagcctaggctgctggaggatagtagaatctggaagactgtgatcaccaatatgttcagcatctacagacatacaatactgtgtcccatttgtcatatccaactgtgattttgagactcgccattgcgttggaggaagaggaggaggaggaggtggtggttgtgcaggctctgcatgactatgtgacataacagcattattgcatttggaatgttttttactttctttctcaagtgcaggattaacattatcgtaacttggaaaatcaagtaaaggcctggacagagaatgttccacaccattcatagtacatgtaccatgtccaccttttacattggtatcatcattggacacagattcagttgatgaccttctgcaaggagaatcatgtaccccttggtcactgctttctggatcctcatcagattcccactgatcagagttatagtcagagtgagggcttcgaccatcatctgatatgtatggagatgatctacagaaagtgtcatcatcatcagagtgggaaactgaaccatccagaggaagggaagcttcagggaccagctggaaagaaggaaacatatcctttacgctttcatgatgattactgccatcaggaaatctcagttttaatttggaggtctctagtccactgacaggatggaaggatattttcatatgttcaagtggaggtgaaggaggaagtgactttataggatatccagaaccaactttctctttggaggttgttgtctcaggaagtgattgtcctacaatgccattttgtccactctggtccaatataacagatttcagagaattataatgttcagatttttcatcaaaagaaactttccgctgaaagctatttattagtaatctatgactaagtccaaacacacgcgatgagttttcaccatttccctggttgggttcagtactgtccttcgtgtcaggggtcgatgggagaatacttccaggtgcaattaccctgatttcccctaaactgtccctctcagtctgaccaaatccattactgtgctgagaattaccagtggccttttcagagacacaagcttggtcatcattatggcctgatgttgagaatctagaatttggttcctttagaatctgctcagcaacctcttctgatgatccctgttcctctttataaccattgctcttttgcattgaattatgatgtgaaccaccatctgtttcactttttgtgatcaaaggcccttgacctaaagaagttgacttgttaaagtcaggaggttttgatggctcgagtcctaataatccaccattagtccagaacctaactgaatgatcagccaaagactctctacgagtctcttcagatttgcagatactgttgttgatcttacctgcttcctcatctggtaaattagagtttttggaaccagaaaatgatatatcagtctcaattggtgctgacactgtatcattaacagtagaagaaccaatgtaggtatcagtgcatactgagttatccaaaacagaattttcacttgtgtgaggaacctgcacaccggcaggagtcttggagggatgagaatcagctatattcttggctatttctttgctaacagaaatatctgatggactcacagatgccaaattagatgcatgcggctctaatgttagagcaggagtttcttgcaatgagttgggcaaattcgcaaacatttctttgtttaaggaaatggtatctgtggtcatttcttcacaataaggagaatttgatggattcacaggtcccaaatttgatgtatgtggctctactgtgagaggaggaatttcttgcaagtcgggcaaattcccaaatgtttctttgttgaagcaaacagtatctctggtcatttcttcaccataaggaacatctgatggactcccaagtcccaaattagatgcatgtggctctgatgtgagaggagaaattttttccaatgagtcaggcaaattcccgaacatttctttattgaagcaaatggtgtctctggtcatttcttcactataaggaacatctgatggacttacaggtcccaaattagatgcacgaggctctgatgtgagaggaggaatatcctgcagagagtcaggcaaatccctgaattgttctttgtttaaagaagcagtgtctctggtcatattttctctatcaagatcatcagatggacttacatatcccaaattagatgcatttggctttgataaaagatcaagaacaggattttcttgcagtgagtcggctaaatgcccttgttcttcatttaagggaatagtataatcagtctgggaaatgacatcagataaattattgtccattaaattaggaggagcttcagtaactccattttcaatcattccacaagtgatacgtgaagataactgctgcacctctcgttttgttatataatcaatatcattttcagattctgattcaatggtgttgagagcatccacataattatcaggttcactatcaatatcatcagtttgaaccctattgcggactggtttcaggttgtttgcttcagtaaataggacatgattgtagtcgatgttggttatggtaacaacctcattcacatgcatatttgagtcatgcttttccacaagcctctccggagttttatttctatcacatgtttgactcttagattccactatctcttccttttcatcccaagtaacaccaaatgaactagaggcaacttgcttttccaacgaatcatgtgaaatactatcatctatatgatgagatactgatgacagagtatcatctgtatgatgagatactgatgacagagtatcagctttctgtttcaatcttgtagatgatggttctttataatctggctcatcagattgcatagaattacttggatggaaaacacattcaatgtagccagcaccagattttgaatcaaaagaatttgaataatgttccagatctgatttcattgtcatatctatggtggaagctgtttgtgaggaagaagtttgcccattgatagcagaagaaatagattgcattctgggtagtcaatataatatgtaagtgttgattttgaatgaacaacatacgccaagattaaatagacatatatagatgtaataccttccactagtgctatgcctctgttcaccccttaaaatgtctccattccttcgtgatcttttcttctgtccaacattttttgtgtaagcatcaagaaattgtttgcaaaaaaatcaatgcatgcatatgacaggaaagaaacagggttaaaaataatcttccccttgaaatgctaggatcattattgtaccttgcttttatgagatttccttgctttttcagtttttccagagtaagattcgtctgaatctgcagatactcttttaaagaaggtcggatctgaatatctcctgaaacaagatcctaggccaccagtatcaaatctgatggacacatggaatatttcattaaccagtacaggacacttgatttaagcaggactagttgactgtattcaactctttccaaaccagagagagatgccaaataggacaggtacaagatccagggctaccagtccaaatttgaactagactgtaactttttatcatctagaccttggaaattagtctaagaagtagtacctaactaatcttgctaatctcaaacagaaagacaaaacagggaaggaaatttaacatacttatcaagcaagtgtacacgtggaggatcacggcattcttcatatgaatccataataaagtgaggcaagtcattgtaaatgaaatgatttcgagcagctttcatgtgtggatgccattcacaacctgaaaggaaactgcttttcattaagaactcctataatctttgaacattgaaaccatgatcattaaataatgtagtattgcaaaatgaagtaaaatatacagatatatgctatctaaaaagtgcataaatctagcttaatgccacttgactgcaatcaggttgaatgtaatctgagataaacattactgtcaaaattatatatattatgagtttgctttttagtgtctttcacacatcagcttccatgtcaaacaaatcacaatgtacacacaagatttgatatataatcttcatcatatttacagtaaatcatgaccatatcagcccctatttcatcacaataccttgactcgttgaacatattgaagacatgaatactgaaccaaccacagtacttccagtttcctaaaagttttagaggtctaataacaacataatagcttgcatgctaacaaagatctatctatatattaactatggcacacccaaagacaaatgagatttctcagagcaatttccgtttaacaaatgcaaaagagagagcaaaagcagattaaagtggatatcatgaacaatgaaaagaaatagaaagaaaattcattgaaaacaacctaacttcaatatgatttagctgcctgatcagcacaatactagacaaacaaatgagagcccttcacattacttcattgatacaaattctagtgtgtcaattaatgtttagtgatgattggtatatcaagattctactcaaagaaacaagtttaagaagtttgtgatataatcatatatttaacatgggaataacttctctcaaaagctactgtatttgattcactcggggcataaatatgtttatgtcacaacttgtaaaacggtaatgatttgcattctgtgacattactcaggatgaattaatttaaaaataacacttttttttggtacaaatattatttgaagatatattttggcagggcacatgttcaaatcttagaaatagcctcctgaccccattaggccgccctttatataattttggagaaattctatgtggttttcaaaattcccttcaaataaaatttggtaaagataaaccctcattaagaaaaatacaataactccatctttctgaggcaataacattcagagatgaaattaacatattctgaaaaaaaaaaattaatatttccaataagtccacacatagaatgagataattgcctaaaagaaccataccagctgtgtaagctaaatgtatgtgacttgtttgtgccaatacagccttctccaaggcaggtagtgaagcttcaatgttttgaacctgaaccatcaatctatgactcctggaagctgttgtcattacttgctcttgcagaccatgaaaaacctctgctgcaaaactacaatttcaaaaaagtttcatcattcatgaatatcaacacaaataacaggaaaactagaactacttggattaaattgccttcaccacacaaatattaaacaaggtttcaacaatcatagagtaaatgtcacaattatcagtaactgtgtaattatatttagcctagataacagagcacacataccaaacacacaaacagatagcagaataggttgaaagtacacagtggacattggagagattaaatcgaatccaatacaagaaatcattatttattttaacattaaaattttcatgatttattttaagaaatatgcaaacataatatgggatatttccaaaacaacaaacacacaccataagtaaggctttacatctagcaaaactaacaataattactagctatttaagcgctaattctcacaaaagaacaacttgtccaaatggggttcagcaaggataaggttttgaagaaagaacacacaagatcccacatttgttctactctatcaaaatcaaaatatataatcaaattgcttggagttccaaccttgccaacaagctctataaatacaacaacaacaacaacaacaacaacaccaacaacaaagctctacaagtacaagaacttaaaattttaactcttccgcaaccatagcccaatttcattgtaacttaaatcaaaatataagtttttgaatagtaactcagatcaaaataaggagtaagacagacgggaggaaggtggcatatatcagtaatgacgatccgaaaactagaaaaaatccacaatggcattcaggttagtcgtattccttctacttcggactatatttacagctgtttagctggagcatgacatggaagtattagttaagttaaaagagaaaacctctagaagaaaaatcaggagtcagcacacaaagttagaacaagaaagcatttttagacaaatccattcctcgaaactattgcacctcgtgaaccacccaaactcttagagagaaaatgatttagagtgattatccaaatagcaaccaaggtcgagctgtacacaacttatacgagtctacacaaagctcaaccaaaaacaaaagtcaaagagcattttgtctccttatcaattgaaacttggcccaaaatccgaaaaataaaaaacagacctcaattccaacggctaagtaccattctctctaaacaacaaactcagccatatttggttacaactaaaaccaacattctcagcaacccccaaccttcaaccccattagagcctcgaaactacagaaattaaccaagcccatttccaaaagaactcccataagtataaaaattgcaaattgcacctatttaaacaaacccaaatggaaaaaagaagaagaagaagaagaagaagaagaagaagaagaagaagatgatgatgatgatgatgtcaaagaaaacatactcggcaagatcaccaagttgcctcaagatcccaacaagaccagccacagccacaccatccaacacagctttagggtcctctttgtttgtctccctgtacaactcaggctgccccaaaccgaactcattcctcacctgcaacctcaccagaggcattttcctctcactcaaacagtgaaaacccaaaacaaagttctcttctctgttttttttcctcttttatttacccccttctagctgttaactcttctgctgaaaccaatgaatgtgcgtgtaggacgagaagcattaaatgaacgaattaagaaagagatatcaacaacaacaacaaaaaaatggattttttgtttttttgcgggggggagattttagttttagagagagaaattaggtgggtgtgtggattgaagcagcttaactgccaaagagaagcgacgaagagtgagaaagcaggttaagtgtacggatcggtgaggtaagggagaagaaggacattgccaaccctgcaagccattcttgaaccgaaacgatagtctgagaaaacattggctggaaatttaaaataccaaaaataccctctgtcttttctttaatgccttacgtgtccggaaaaatgttgtgtgataaaatgactggtttgggtctgtgaggtgtgaccaaaccgtggctttctttctatggctccgaaccttcgacgtgggtaccacaaactttttgaggtttggtcaaaatggtaaaacgcaaagggaccctaactctagacatgaatcggaacatgttcaattttgtttctgaaatcctattggggtcaacttatgaaaggaaaaaaataaaatgaaacaaaaattgagaatggcgaagtagtagaattatccgtatgtgaagtggataatgcgagatggtgatgtttatgatcgcaaaaatacggtgcttcgggtgacaattacggatggaatggcttctgatgtttcaatttcagggatttaatgctaagatctacaatgtgttttatgtggtgggatatgtatagcaccatagtcttaattagttcaaggatttaatgctaagatccaaatttgtttttatgtaatgggatgtgtatagctagaatctagaatattaattaattaaaagatattgaaaatgttgtatggaattcttatattgagaaattgatggatttttcaagggtagtagtagtacgtacctagatagccattcataaatgaattataagaaagcagttgaagtcatttacttgagctgctcagtaatggcgactgcatgttacactctgtaatcttttcttgcatggtaattaattagatactaataaggagagagagagggagtaatggcatggcaagggctacataaatctaagtacaaagatggtatttttgtcaaagaaaataagaaaataaagtaaaggaaacgggaaaaggaaagtgatagaaagagatttgtcattaataagagtaaggcgcaaacaaattcatatgtcctttgccatacatcataaatgtagataagggaagttttttcctttcttttttggagttcttaagctatattagccaatggatgaattgtaatccacgtcttttaaaaatttatcgatccagtaattaaatgtaattgtaaatgtattacttgatatagcaaaaaaaaaaaaaaaaaaaannnnnnnnnnnnnnnnnnnnnattaaaagatattgaaaatgttgtatggaattcttatattgagaaattgatggatttttcaagggtagtagtagtacgtacctagatagccattcataaatgaattataagaaagcagttgaagtcatttacttgagctgctcagtaatggcgactgcatgttacactctgtaatcttttcttgcatggtaattaattagatactaataaggagagagagagggagtaatggcatggcaagggctacataaatctaagtacaaagatggtatttttgtcaaagaaaataagaaaataaagtaaaggaaacgggaaaaggaaagtgatagaaagagatttgtcattaataagagtaaggcgcaaacaaattcatatgtcctttgccatacatcataaatgtagataagggaagttttttcctttcttttttggagttcttaagctatattagccaatggatgaattgtaatccacgtcttttaaaaatttatcgatccagtaattaaatgtaattgtaaatgtattacttgatatagcaaaaaaaaaaaaaaaaaaaannnnnnnnnnnnnnnnnnnnnnnnnnnnnnnnnnnnnnnnnnnnnnnnnnnnnnnnnnnnnnnnnnnnnttgtgaggctttaattcgacattatagtcaaacatatgcattctaaaaaatgcacgattcatggagcagttaacagcagtgctaacaaaaacaacaacttagggcattttcaccaaattcttgaggaataaaatatgatcaacagtctctttcgttgagtccgtaagagttgacaaataaatctaaacgtttggtgaaagatttgacttggaacagtcatctagaatctttattggctttcacttcacccaaaacaaatgtcatttgattcgtttgattctaattataatagtactaccaaattgatcattatactactattattcccgagtcattatagtaacacagtaacactctgaaatctttgagagacctacatattcttaatttgtgttttcgaatccttgtttccaccaatacacacaatcacgcataatccctaatcggtaagtagaaagtagaaactcaccatttatttaaatacattttttttttatattgcgtgctatacatgttgtaccaacattaaatatatttttattgaattaagtcatttaaataatatcatatagcttttaaagtttaaatataataaatatttacatcaaacaattattttttaacttttttttcatcattgatacataataaaaaaaaacacctttaataaattaaacaataactattctggtagccaatatttatttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatttacatcaaacaattattttttaacttttttttcatcattgatacataataaaaaaaacacctttaataaattaaacaataactattctggtagccaatatttatttttacatataattgaattctatttttaatgttttttaaactctcacttcttttaaaaatatttctatttatttgcgttattttaaaattttaatataatcttattcaattttaccctcattttagaggtaaaaataacattaattacttttaaaaaattaaaaacagatataattatagaaaaatatataaaaaataaaaatatattagaaaatttgaaaagacttttaacttatgattatattctcaatccaagtataaaatctttaaatgatataataataataataataataataataataataataataatagcatacttatatttatcatgagctattaaattcatatgaatggatgaaaacataaaataaaaaattcacattgatgatttatttgaatcaatttcatcatttaaatacaaaaatgaaaaaaaaatacatgaatacgacaagaaaaagaagaataaatcatattttcattcagtatcgaatatttatttcgaacatgagcatttgaaacaaatttaaaatggtgatactcatgttgtggtgaactatggcttgtattttgtgtataaataactatgatttgtatatgagccaactattataaagtagtactataattccaacaaagtgccacaacggctctctgcttgccaaatccaatgctgccattaattagctgcgtagtggaaaattcacgctgttgcgtcacagtaatcaatgaagacaggcagtgcccataattagtccttcaatttgtataggtttcacaatattcaaaaggatagaattgaacttatattttaattactttgttaatttatcgtatataaattaaatgattcaagttattggattgtgaaagcaaatatagtataataatgcgtggcaggctagataagtaaagcaaggtgttaacatgtatttaggcatctttggccataattaactgctcattgcaattaattatatattcatccaaaatgaactactcctttctctatgtatgaatgaattaaatagttggatgacttcaattttccattccttttcttcctggtctttcttctttatcttttctttgcggccttttattttatgtgtcattaatttgttgtttactttcgttaaaatatggtacatagaaagtaagatgattgtgctgtcccatttctttacagggtatacgtatcccaaacaagaatgatatttattaattcatacggccagttcaatgggttagttacttggttcctttttcatatgccaatattaaaataagtcaaggtgtaaatacttacttgtgcttaactcttcagtgaaaaaaaaggtatgcttaactctcacttaacacgggtagaaaaaattaaaagaaaaacggtaaatctatcaaatctactcaatttatactttcatgagtagtatattatattgatgtaaacatgttttttaatctcaattatcactagtaaaaaaatttcaagaacacctaaagttataagtataatatctcttcaaccacgctcacaaactttggaaatccctttgcaatagaattttataaatgttgaaaataacttgtttgtattatccgtacgtaggtatcattgtatcaagaaatcatataacgtatcattagtaaaagaaggtgagacatttcatttcttgattttgtttgttagtttgtgtcttcaaataggatttgaagtcaagtctcttaaaagttccaatttttttttttaataaatgaaagattaaataaaaggggcagacagagataacagtttcacatgatatccacgtgagctacgtacacatcccgcaaatatagacaagggcaatcaggtgatgggatcatggtacctgtgctcaccatttctctatatttatattactaaagctacacagatcattcatgcaatgaaataaatcaatatgtatggaggtttcgaaagatatataaatttctaattatgtcttgataaaattaatcagctactaagagttacatcacaaaccatttatttaaagagtttggttagcttccaagatatggtagattcaaattaacacaaaggaaagaggattttctgctaattaacttattcctccaaattcttttcattcgtttccatcaaaccctccatcatcgattgcccagtacgttaccaacgggagacactggaattcattctttcaagagcacagtaaatcgagttatttcaaaatttcttaggtgtttcacaattaaaatttctttaagttgatttttttttttatgtaagttttctttaagttgatgtacatataagaatagacgaaattagcggatgaagcaaataacaagttctataattaattaattaatgttacaagttatatccaatattatcgggaagaaaagcgatgcaagataaatctcttacgacttaggcttattcttcaatttttggttgagatattaattagttaacatgataaactaattatatacaataaatagaatactcatcaaacttttagataccatgtcctttcatatttcaacatgagacggtcacaccaccatcacaaactaaatacatgcgcagttatagctcagtttatggttctggttcatgtgcaggatgtcacatttaatgcatgaatctatattcttctcattgtgattctttccatcgttttctgttactatctcctctaaaattatggcaaataagagttattctaattttctcaccaatccatcaaaccctcttttcttccatgcaagtgaaagtccatctcaagtgcttgttttttctccattaaatggtagaaactatcattcatgggatagaacaataaaactggctcttttggccacaagaacaaattgaagaatgtctatggactatggtagtattcctgttccatactttcattgatgtcaaattcgatccatgcagtttggactatggtagtaagatgtgatggttcttgcatggattcattgtttgatttaggacttgatgttgcaatccatctatggatagatcgaatttgcaaaggggacattctcaaaatctttgatctgctagagaacatctatcctatatgcatcaagatacactaaatgtcactgagtatttcagtgaattagaattcttatatatatgggatgaattggataatttcaagcctgttcctagttaaatgtttgattccttgtagctgtgcttctatacagttgttttaggcaaagtgtttggttttggagacgaaagtcattataattttatggggtgttcggttttttagatttacatgtgggggaagggtataattgtgtggtagcatgctttcaatgctcatgttataaataaaatgttagtaattattaatttgttaatttttgttaactgaatatttgaaattcacaatttctttttcctcatcttttattgttaagtcaatcttatattttcagttcatatattacttatataccctgtgtttttttctaagttttattatcattaaatttcacttgactttaaaaaaacagttacattgtttcagacatgttaaacgtgtgatgcatatttttcctttgaaaagaaacatctaaattaagataaaaaaaaaaaaagactgcttgaaatacgattcaaaccaaacaacagacgtgactgccacagaagacgctgaaatacaagtcgagagataatatgtttggaataaatttatggaggaaaaaattacttgatttttgatagtgaaaataaaataataaatagttacttttattttttattgatattactattactatgattttgtaggatagaatgaattacatgttatccaaatacactagtactagtagctagtgatggccgtggtcaagagtctgaaaactggtgccagggtgaaggatctgggtttgtttgatgcgcttgcaaatatgtctgtattttgcaaaggtttggataagttttctgtcacattttggtaggcccgttataccgagtggtccaacccacacaattagcaattggcagagtattatctgacatgaatggtccaagaggccatgtagcattaattcccaaaagctctcatacattttcatcgcttgggatcatcagatcattctaaacacaataggcaataggcaataggcaataggcaataggcaataggctcaaaactcaaaaagaaagtgttttttttttttttttattagaacgtacaattaaggtaccgaattttaggattcatccaattatggaagggatatatgtaccatagcacctaaccattccatgcttcgaataaaataaaaatatatagcgaactaataaagttgttttcgtgttattaccatgttgattaatggatagtcttagatcgaaaggtaaaattcaaaactttttaagcaatttgtccctgcaaagtagctcaagtggtagttatcaggacacgggttggaatctccctataacacaaatcattgcgtttgatcttccatcaggaaaatgttttgctccttaagtgcagttgattgggtaacatagccaccaacaccccaaaacatcataccatataacataaatataattaataagcacactcgcttgcttatcttgcctcaacctctatcacacatagtttactggttcttgtgaattcactttcataatcgaataaaaggcccacactgtcaccaatatgctttggaattttgtctggacctgattctcttgagaagttggcaaacactatgtccaatagcttttggtcacttcttaggctaaataggtctagccacactaccaaccccatacgatccaattatggtcattccggaagccagaagtacataaagaaaaaaaaaaaaaaaaaactccaattatgttagcttatggattggtcagtacctacataattgtgccgaaatttgagatccttaagtcgacccacataggctgaagtagtagccgggtatggttgtcttcttagagctttaccatatggaactgtatcaaatttcccattatctttcttttcaaccattgctttgcctgagccatcttggctttattgcttagccacaatggattcaaacatgatctgacaagcagtgggaacacccaaaatttggtgtttagcttgttagcataattgaatcagtcttaaaaatttgttcctcaccccgttggggaatattattgataattgatatgattagcctgttatttggcttatagtttatgggcttatagtatggattgttaccattagactagcccaaatgcccaataatgagctataattagattatgcggaaattattacctcttaactcatttttttaaatagttttatcaattttaggataaattttaaaattaagcgaatgtttcgttaaattcaggctaaaccagctattgtacacattgtagctcgaacaaccagttatcattttgggctttgctgagaattcctctcactctttcagcatttccctggtgtctttgaagagaattttgtgagtgagattttagctagtttcatgtataaacaaaaagacaaaaatatataaagaacatttagcctcaactaagtaaatttctgcttaagatattcttatttgctcctgtaatcttattgttgtttcttttagatacgtacatatatacttagggtgccttagttctctgataagatggttctagagagacaaataaaaaaagaagaaagtcaagtgtcttaaaaattctatagagtggtcatagaatattaagatataatttataatgttatttagtttttattttaatttcctaaagtcaggtgtaggattataattatttaattgttggcatttgttaggttagatacataatttcctaaagtcaagtcaaatattaattttttgtcataaaatttgatgttaattgctaatgtactcatactaaaaaacaatgagtgcattagtaatccatatatatatatatatatatatattaggttatttacaatatagtagatagttattaattagttctctaacactcatagatgggttgcatttgtcatggtgtgatcacaattcacaagaacacatcttctcaatttttacattgactgatctgacaagaatatccttttacttgacgccttattcattattatgagggcgttcttccttagttgtcttccaaattctttctcaaatcaacctagaaaacaccaatcattataattttggatcctaataattaacggagacttaagatagtttatccacccctaaagtaatatcgatacatacaaaaatagtttagttctctaataggatttcaatatatccttacagaattttatctttttggttaaatatgaggctaatttttttaaagattttagttctttatcttttttctcaagaatgtattttgtaaaaatgaaacctgtgtcaatttcttacaagttgaacctatgttttttattttttaatttttttttgaatgaatataattgattttcttactctacttaaagaatgtacttttcaaatcaataatcaataaaaaaaataaaaaccttaatgagtgatctcaaattcaaaatctagatattcagttagttaaatactcgatggaatttcattaatgataccaagttgcaaccttaatgatatcctgaacactaagcaaatcaaaataaccaaatcaataaataaaatttcattatgaaccactcgcaaatgataccactaaacgagctgtactcaagcagaaaaagatggttacataatgcatatcatttagttccatgactactaatgacaatatttcttctaaataatcccctttttattggcaatatatctaagagaagttggcatgagcaggtaagaaccttttgagggacaaggcatttccagaaactttagaaaatatcaaaatcggtaattagagattactaattccgaaggaatctgtacacagatccaacttaattagaaaacatttgagctgcctaacttccagacccatgcatctgccctttccttaaatagggagattgaatttaatggggacataattacataaacacctttaataattagtgtatgtttttcctagaccaaaaaactcctccacctcaatttacaagcccaaaagtcatttcattttttcaccactctcccgtatctacaagatacacatttttatcttttgaaatttgaaataatctagacaaggaatgtttcagagtaatattagccaattatcatgccaggacaatttccaaccttctctacaccctgttttggaaccaattcagagtaatattagcacaaactcaatattccctccgtatctcgatcagtttttgactgagattaattattaataaaattaatgaatatgataattcaaaacttttgaagagggaagttaataacaactgtacacggtatggttcatttaaaactgcggaggattcacatctatttatataacttttggggaaggggagtgtaataacacgagactgatagaacttgacttgtatcaagggttaaaagaaggatttactctacaaattactatattaacttgattagtatagaagacacatgaaaatgcaaaatccattacatctttgggggttcaattatttgtcagagttcatattagagtactaagcgcatttcaatagattcaagaattcatatataataccccaagaaaattcttcctttatataatactctaccataacaacacaaacttaacctttttgagaaacaagattttttttttatcaaatgttaatttattaattttattaaaaaatgtaaaggattcaaactactacctctcgtttctctctttttccttcaccatttctccggactaagctatatctcttttttaagtaagaagataaattgtagatacttcgaaagtctgcataaaaaaaatcatctgtcatcactccctgttccctatcctatccctccaattagatcttttgacatataaattaaattttctaggcaggttatcacctgaattggacgtcgtcctacctttaaatcacgtcaatccccatgtaaaacctggaacgttcgtgtcttccaatttgtttttcatactatcaaattgctctcttcctctatgttgattatgttttgttccaacaccgacacctcaagccaattccataagcctcatcattactaacaagaacttgggacaactctaatttcggatttgattgattttgattattttggttcgttttataataattaaaaattgtttaatttggttttaaacacctttaataaaaaaatattttaatcattacacaatgaaaatgttttaaattcaatcataaatcatcaaagttatataaatttcatattaaatattatgagatacacattaattcatcaacaacgctatgtacagtccacagataactaagtttttgaacatattattaagaatttgattcctaaccatgtaaagtgttgggactcctgaagactattacttggatggctgatctaggattaactcctcatttttaatctgattacaaattaattgtagataaaattaacaattttgaccaaaatgcttgtgcgttaggatacattattcttcaatgtaaaaatttgcacaaaacccaaactataggattcagtttgataggaggcaagcgaacattaaagcccacttgtaaaagtacgtggccacaattcatgttagactcaaagtttatcaacatattttatcttccaatttattatgaatgaaatttcatgatataagttttgtaaaaaaaaattaaaaatattttaattgagaaagataaaattcatttaactgatttctacccctcgaaagaaattaatatctgattatccattaaaagtattcttttttataggggtgattaaaaaatatattattggtgtacacaatatatattattgaatgagacagagaccttttaggttcaatcttaataattatcgatgcaaaagtgaggcgccgcttgcatctatgattgcatttttctgtattttttcgattccttacattctgcaccacaaagagcacaaaagagaggaggaaaaaaatattttttcagcttttcattttgattatttaattataagaatccacccaatcttagtggtcgccctctttgaaaaagttgccaaatccttaagagctcttcttttgttatcccgtatcctgcattcttcccagctattggagaaaagagggaataagaaagacacatagtgaagtgatgtgaaatttatttgaaaaatggatgttttcatattcaaattttacgtgataggtttatgtttattttctttctataggacatttaatgagtaggacttgatataaaaattaatgtagagaaaaatagatataaaatttgtacttgacttactacgtaatgaaattaggaatgtagttagttatcttgatcttaatgggatcatggctgctaaattttcatattttcttcgttttcgtaaatgtatcttttttttgtgcgtaagagacaataaattttgattttagtttgtgtttagttcataccaccattaaatttagtacaactgttaaatctgaccatggatgcatagtgtaaagcaaaatcaagtttaacttaactagtttgagttacgaagaaacaaaactccatggtgtgatcgatctccttagttggtgggagtatttattaaaaaaatgatttatagattattagtggcatgataccggaaattgttctatgaacatgttttatttcattcattactcacaagatgtgtgacaagattagaaattagtctttatcttgattatgacataaaagaagtcctatagtctgagtttttaaagcacacactatacgctctttataagaataaaaaaaagcacacaatatacgcttgtctttctcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaataaaaataaaaaaactaaaaaataagcaaaaatatttagaagaactaaaaatgctgacagttaattaataaaagactaaaaattacataattttttttgaataacaaaaaattaaaatctaaaaaaaattaaaaaactagaaacttaattaagcctaacggatcagagcattgtcattatttagttgtttccatgtcaatttatttctatataagaaaaagcacgacaactgccagataaataattctagtaataaattctctggtttggaacaagaaaatgcttattttcacccgatccacaatgataacacttacgtttcatgagacaaacatgaaaaattcttttagtggatcaaagatttaattgtcgcacaccgttttccagtactatataataacaataactaagaaagtttatattattaatctgcacattaacttactactctacataacttttgtaatctacacactaactactttgtctacattttattggccactgatggtggaacattcaagtaaaaaaaaaaaaaaaacataaatgctcttggataagaaaaggagaatcagaaccagaaataaactagaatagagctttgctcaaggctcacgccatcctgcaaatcccaaaggtcaaactctattgtgttaatacctttgcatgatgccactgccactaaccaaaccatttcccaatcataaccatacccaaaagaataagatgcttaaactaaagccatatcccgctcatttatgcaaacttagcataacattaatgcattattagaatataatgggaaagcaatgtgggaactttcaattctttttaccacaaatttatctctttggccttttcttcatccaacctcacctttccctttacttcttttttttccccctcacttgtttgtagtggggtgaagttcaacatggctttgcactgcatagattagacactgatgaatgaatctgtcctcccccatttgggggtccaaaagaatttcttcttttttcccacttcagaaaaaaggaggagaagttatcaacttgaattaattctattataatcacagctcagtactgtatagaaagtgattgtagcattatgtcaccttctctccttaaaggatgactgacactgacgaactactgtgtcattttcataagtgaatcaatagaaataatggtaaataaaaaaactcaagtgctggcaaaagcataaataatatctatcatgtcgcaatcaccttccattatgatccaatacagaattacacatattacagtgacacagtagtaggatcgttctatctgcatctcaatcatagcttatctttgtaccgtgtactattctaaattccgagtttcaacaattaaaggcaaaaaaaattgaaacccattacaaacttcttcgcttgtttcacctcttccagaaaattacaaatttataacaccgtctgatcaatttcatgccccactaattgtagctcgaccataaaaactccaaaaaaaaaaaaaaaagaattgctatcaaaaaccaaggttttaaattaccgttacagttttgttgcgatctttaatattacagaaaatttcagataaatgtagccgatacagaaaattttactaccacagaaaccataaaaccttgacgtgttgtgttgcagaccgttttataaaaccttgatgcatatgaaaacatactcaattatggtctaatataacttaaactctccaactggttaattacaaacctcatattatatggacaaccctatgtacacagcaacctttgcagaagcagagtaaaacattaaaaaaaaaagaagaggaattatttattttctctctatatattttgaaaaaatggggttggaagcctaaaatatgaggattataatataaactatatggacatgacatgacccttaggcaaaggttgtgatttgtgaaggaagaagaagaagaattgttacatatcagaaggtgactcagaaatgctctccaagtgaggcctccacacagcaacacgccctcttcttctgtctctttgcgttgacaccttctctgagagtatatcattcaagtagcgatcagaggcaagcaagctagtcatagacatagtcatggacacgttggtgttgttccttgttctctctctgtgttccttcttcttcttcttcctctgctggttcttctcttgtggaggagaaggagggagtggcatgaggaagtaaatcttcccacgttggagctctgcgtcgggtggcaccaccacgatcttggggaccccaccgccgacgccgccttcggcggcatctgctgcggaggagcacggcttcttgaggacatgtttggggtgtgccttcataacatcactggccttgatggtgccactgatttcttctactctgccattggagtgcactatgcggatcacgtcgagagccccacatgggaggatgcaagagatgcagcaccttatgcagtttctcatggctttttcttccctccctttttttgaattggtgtctcgaggaggagtaaataatatactgtgggggaggaaacggatttgactatttcttttagacttgagattatctttgctcctttctctggttttgctaatctttaattagagaggtgcgaaattcggtcgtgtaaatgaattgcgcatcaaaatgatccatcttttaaaggaaaaatataagttgttaacccctggaatcatgatgtttttttactactaaatgaatgtataaataaataacaaatatgtgtatacatatttagggtgcttataaaaatttcattgaattaagtcttgccgtctcaccaaagtgaggctagaccttacgattccaaaaatacttataaggatatctataaactatatttataatgaaattctcctattgacaaatgaattcaaactcatgaaggcatgagatatgaattttatttgtatctttatagcctactagaagagaatgtttatgattaaacaaagataatttaaataaaaattaatagaaaataataaatgtgcagattatgttttagataagaatatggttaataaactcacagaaataaaaatattctaatataataaataagaattatatatatatatatatatatatatatatataagatttcgccttatttttgaaatttgttattttttggtttgctgcttttgagtaggtgggaggaatattttcggtgctaggttgggagaaaattcatggcgtgaataattgtataacaccctgtagtttggcttttgatacataatttggggaccctaccctcatacctcgagttaatactctcttccctttattaagttcaataatattaggttgggaggactgaaagattgggataccaatggtatattaaacgatgggacttctcagcaatcaaaaacttaggaccccttttgaatgtgtcatgaaaagacatacgtgtctcaataaaaaagttgacacttgtagacccctgaatgaacaatattaattattaattatttaacgctaaagtttggttgagaagggtggtgaagtagggtcagtcaatgagagaaagagaacgtgttttggtttggagtgaaatgggagtatgagcgctgggaaatggggtacagcgtagaggaggtaggagagttcgtgatcgttcaatatccccaagcaagagcatgtggattgtggttttcattggaaagtaaagtgtaatggcttttaggtttgtgaagtgctttgactatggccaatgtgtttgtctactagccacatctccaagagcaacccttccaaaatgcttttatccgtttcgttttctttcttttcatacatggaatttcaccattttgccatctatcatacattatacattgaattaaagtcaagtacacctacttttctattctgtccattagtaccattaccatatagatattgatgaggtaatgatggtaaggcataaacattatctgtacagtagtgcaaaactctctttggggcgccgaagcttcaccagtaatcactttcttagataggtaatgagataatgattattaggtattgtctacacagattgtcactctataatgactcatatgggatccatgcaaaatttaatgacacagctcaaatcaaaattatggcagtaccacctgtgtacctcagaaagatacctaatatctatactagtagactactatacgacaagagatgttgctctcctttcctaactgttcaaattttataaattataagcgttaagatttcaacttcaaatatcatagttctcttttaaatagactcaactgaaactgaatgacacagacaaactcacaaacacgttatttttgtcatgaatgtcgccaaattgacattggatggtgtatgttttattccttgttatgtaaagaatggtagctcaaacttcaaagaggctttaagtaaaaaaaaaaaaaaaagaagttaaattcataagataatgacatccaagaaagtgatttgtcctaatctattagggaaagctaggaagtttagaggtgattgatgatatgatttagtatatgcatgtcttgttgcgttatggaactttttaattaatagccattagccaagccttgcgagaatttgccaaaagaagagatgcagttaaaagtatttaattacctgttaatttgagttatgtcacatccataatgtggcccgctctttaaataagttctgatgtagatgttagtgggcatcatgtgaggcactgagggagggtccaaagctgggctttgatattctatttgctctgatcatccaaatttggatgccaagttaacttcgttttattatgcgataagactgacttaagagattaacattttccttcatgagttgagacgagttctattcccccacgcggcactcgcattctttttttttttgttaaaaaaaaatgttatacttatagtcttatactgtacggtttaggagctcagacaggtcgacaaagtaaggacccaccacgtccttagtggagatccctgagtgacggttgaatggagtagttatctagttggtaaccttcttcgtcttatatgtaaggaaaaacgataaanaggagctgagacaggtcgacaatgtaaggacccaccacgtccttagtggagatcctgagtgacggttgaatggagtagttatctagttggtaaccttcttcgtcttatatgtaaggaaaaacgataaatgttattatcaacttgagtgtggaaattctattctaacataaggactaacatgacttgtgttggagtctcattgtaggtattataaatattcttagcacatgacggagtcttaattctgttccttaatcagtgttggagtgaacatattatatcttaggagacttgtatatcacgtagataaattaattcttcgattaatgaaatgaaaaacaaaatatatagtctctcaaagtgtagtctgtcattcaattaagttaatctgtccattaagtcttctacgataactttgaagagtttaaagtctatatatgtatacaaagactattttgaagagtttaaggttaaatatgaaaacttgcaagtcctttaatttatattagtcactaaatttattgtcatattaacctttgaatttgacatctactctactctcatacgaaattaaaaaacattccttgaaattcacaactaatattcacagtctaatataacgctgctataatttggttcatactagtctacatacactgatgaatgaattgcagaaatttgttaaaacaagcaaacaaagaatccagaggtattataaactgctaacctatgtcacaaagagtctcctccattatgtcaatgtgccaggataactaaaaagcagtacacatttacacaccgcaatttttttgtgcaaaaaaattgcagtgttgctctctgtttgcaatgagtttacaataagctgaagagattaaaggaaaaaggaagacgagaataaattattccttttttttttattaactatgtttttcttttggacttttgcgttatctcattcctatgattttctttttgggtccaacttttgtgtttgttattgatggactggattttaatttatcccattgatcgggtttgggctttaagataattatttcagtttggattttttttataacgggccacgtgtttcttttgaatgaattctattcagcaagataatttgttttttaaattcattttaatcgtgttaaacttattagatactagagtaaatggtgtctaataagttctaattatactttatctactattgaatttaaactaatgacttccgccgtatgaaagcaatgttcttaatcacttagttaaatagattattcttcaaccattggatgtagttcaatnnnnnnnnnnnnnnnnnnnnnnnnnnnnnnnnnnnnnnnnnnnnnnnnnnnnnnnnnnnnnnnaaaataaaataaaagtgcaaatgagaacaaaaaggatgaattttctatattgcattattgttatattaaagaaaagttttgtttttttaaagaaaaaagagaaaaaatattttttctattgtttgatcataaataaacgaaagtaataagaaaacttcttattaaataacatttatatcatttttaatatgatgatgaattttttgttttaatgaaaacttctttctccttcattttctctctcaaattactttttttttttaagttccattttttcccgttccccattgtttccttttcagtatcagagagagcatctttggtttgaagttgaaaaagattaattgaatttaaatacattttcatatatttaatttcacgctaaagaagaattaaaaattaattatgaggtcaaaattgatttaggattgaaataattttaaataacatttgcattgaatccaaaattttatactaaattttactnnnnnnnnnnnnnnnnnnnnnnnnnnnnnnnnnnnnntacaatccaaaatttgtatgtcattttccttctttgcatttattttatttccattcactttaatgtcaaccaaccaaagcatagtgcattttttttatttatttacgccaatgtaaacggagaattttatgttgtcatttttactgttggcataagcatcgcacaaataaatacatgaacaaaaacattctatgaaaaaatataatctttctaacagcatcgttcttttaaagaatgtgatatgtttctacattttcttagcatcaaattgatctttgtttggtaggttgtaacctgtgttaacttatgtaagaaagataagtattgttttagccttttaggtgcagagtatattttgtacgttatgctatttgtggaacggagatagtcgatcatcgctttatcttggccaatgacaaatcaaatttggcatgaaatgtatgtttgtattgattatacaggcatttacctaataattaacatctcttatctatacatctattttaattcacttttgagaagagaaaatttatcttatgttggtcatcttttttggtaagccataagtctatttaaattgtgtgaaacaaaaatttattccagtgatcaatatatatttatttttctgattgctttttagatcctgtaacttgtttctatttttcttttttatttgacttggttatatacaaattaaaatactccttgaactatgtttttttagttaattcaatgcgctatatatatatacacactactataaagaaaaatacaatgatgaagcatgcatgttgaagaaaacgcttgaagcaaagaaaaaaccatctgcgaatattttaaatcacatgcaacagaggcatggttccattttctaccttcacattatttgaagaaaaacttgttctgtgttttatttttgcctttcacattagtacaacgtggaagactatggtcacacagaatcatatcatacatacgtccgatgcttgtctctaagaaaacaagcactcgttgattgaaccttaacggctcaaagaggagagtgatccactcttctatgagctttgttaacgccagcagacactagtgtttctggtgtttctgatttctccttagttgggtatgaagcgaaataattcatcccacacactcctaataaattacccgtgtttctttggatccaaatgtaaccatcttttccccaatcttccccccatgaatttttcgctatccagtaatctacaccatcagctgaaccatatcccacaagtaaaacaaagtgattaatcccatacggacttgtacagtttcctccatcataaattccctgtacaaatcaataacaataatagtataataatgatataatattttcccaaatagtaagatattgtatatattactgctagtaattagtagctttgttctagaacctgtgacatttgaggaaaaatatttgtcccataagtattatatttaacttttcaatataattttaattatttttattaatatttctcataaatatcactttaatttttaatataatactaatattattttttcatttatttaataaagttaattttacaaaattattattattttttattaatttatgagtttttttttgtctgacttaagacaacacagaatatatattacttaccccagtgtagagatgaaaatcttttgcatctatggagacactaattggttgctcaaggatggcgcataagaacgctttctctgtctctgattctgtactctcatctgacattattagagtttcatatccgtcaattgtaaccttgtcttgtatctactcccagaaagaaaaagaaaagtgcacaaaacaaagagatgaagggttaaattaattaaaaggaattgcatgcatgcatattcagttaggtattcacagaccttattggctttgcatctaccctctttagctctgtaaggataatcagcatcagtggcaatcccaccatgttctaaaacccattcgaaagattgatagtgccatccattgtaacaaccttcgctttcttccacacaatctacgagttcttgttcagaaaggctaacaaggtctcctgttgctattgcatgtgctgcttcaatggctcccgtggcagaaaatgcccacccactccctatcaaaatggtttcacactccacaagtcattttcaaagagagaaaaaaatattagtgttaataattagtattagtaattacgtactaaaaacaatggtttcatgcacataccacacgagccttggtacttgacatcagtgatgacaccctttttgctccaatcccagtattcaggtgcatcctcacaagaaagttgttctttcttcaattccttgttggccatgttgatgtgtcgtggcacatccttgggagcttgcaagtactttttgctgaactcttgaggagtgatgtcagcaaacttgttcaaccccaaacgatgagagtggggtgattttctgtttgcattcacgtccctgatatagttcaagttattcttgaaaatctcaagtctcgttgcctcttcttcttggttatggtagacccgtccgtgtgcactcttccatagttggaacagtgaagacacctgtttctgtgtggtgaacttagctaggtcaaggtccaatatggaacgatgagatatgctggaactagaagagagacctaagagggagaaaagaaccagcacaaggaaacccataacttggtggaaagtttttatggcttgaaattaagatatggtcacttcacttgtaccatctcgtatatatagtgattagtgagctagctagtaatgactgaagaagttcccacgtagttatgtatttggtttaaattaatttctgatacgtaattgaattgtgatttggaaaaatatatttaatttggacacccaaatgcttagtgagagaaaagagaaaattaaaagagaaaaaatataagtataataagtaatataatgtgatagaaaataaatatgaagaaaaataaaaatataaatggggtgtctagagtagaggaatgtctaaataataacactcttatgatttggcttacaaacatgcaggagtggagtgacagttcccaactttttttatttttaaactagaactttcgtattattttgatatgaattttcattatgcagcaggcacagttccaaagccagtctagccagatatcttttgattattttggattataaaattggatataattctctttctttatttaaaatttatctctttctgtaagttttgtgctaacacaaaatgatttttcattatatataaattaaacttgtatatacccattttaaaaaattcaattgacgttaaacgtgtattctatctgatttcgacttttagggcttgaatcacgatgttttttatttatttagttataattaatttgatgtgaatgtgaagtagggcatttttcaaattgtagcctcactataaccatacttgtttcggtttgttaaaatttaatcaagtgaaattgcagcttactgcacccagttgggtttcaagcgtatttttatcagcttaattaattatttcaaagttgaagaagttttagagtttttgattatttttttttctcaaaaataatctatatatttatttatatgtccgacggcaatgtgtgtctgaagtttaggtatttggccgcatttgattgttatttgtctcaggtttagatcatatgagtctttccttcatttggttcatatgcaatagttacactcatttaggttacttaattagcagggccaaaaaaatatagcataaagcaataataacgcatgtatatagtgatatatatatatatatatatatattaaaaaaatagggcatatataaattgaaaggaatattagtatccttaatttacttgcatgcacttttgtctcactcacacgtgcaaaatcgaaaaatcattcaatattgcaggccttgcactcaaatgtggtccataatggacactgcattcaagatgatgtgtgatataattctggcttttgtttacagaaaagtctgcactgttaaaattattgttctataatcaactgaagttttgtccattttttaaagtgcgtacacgtcttggggaacgatgaatcgttgataagcagcgagcctcataagctagaggcacatcaccttcatcagcgttagtgttgtttgcacctgcatgtgctatttgttattttagttggagttttagtaataagacaatgggacctgctacaactcaatgtattttgagaggtttttttaattagcttttaaattatatcaacattttcagttttagaaaaaaaaaattagtctaattaaccaaattagtgaagggagaaggaaacgtgcaagaaatctcttaagtaaaataccatgtttaaatctttttagatgaaaaataatgattaacagaaaaaaaatcttattaaaaatagttagttaagtttacagataaataatagtcttaattaagtaaaattattggatagtctccactgttatcatgataaccttaaaactggaaaaaagaaaaccttggcgtccttcttcccctgaacctaaaatgacaatcaaaatcatgtccacagacgaagacattttatcctttcttttctcctaaacatagatagaatcacgcccaactcagtaaaaggtacataacgagttcaatttcaagagaatcaaggcgaatgtgtgcgtcctgaataaatcataattgtgttatatgagagttttccattataattgtacgtcatgttattatgaggattgagggttgttcattcggccaaggccgatcttgactggccttgtattgatccattacgcattaaaaaaaagaaaaatatttataggcatctttggattgtgaatttgatctgctggtgagaaaagagagaatgttagttttttattattcatagtaatcaaactcaaccattatgaggtttataacaatcacaaatattactcaaccaactaaccattggttaaatatatttaaagcttaaaatgacagattgcactattaaagataattagttaaatatactttctggtaacttaaaagcgtgaaatattgattagttagaaatatattttataatttaaggcaacattcttaattattattttattttaaaaaatcttaattagcgtagttaaaacatttaattattttaaattagaaaatatacttgttctaattaccttaatttctacatttatataatttatgaattaaaaaatagaaaaaagaataaatattttcgtgctcaattgcattacttttattataataaaaatgtattaatagtttggattttgctgttactctatcaaagttacatgtcatttgatctctcccttcaggactaagcttgactcttgaagcttttatgtgtagttgtgatattattgggtgtcgtctttaaaaaacaaatcaacctttcgacgatatacagctagcaaacgggaaaaactaaacagggcattatacacacacatattgaaacacatgcaacagtagcagtgttctattttatttatgaattatgagaaaatatagttgtgttttattacacagaatcatatacaaatatacgatgcttgtctctaacaaaacaagccctcgttatatataattaattggaccttcacggttcaaagaggagagtaatccactctttgatcagctttaacgcgagcagacaccagtgttgcagctgatttctctttggttggccaagaagcaaaaaagttcatcccacatactcctgctttatggcccgtatttctttggatatatccaaatgtaaccatccattccccatgaattttttgctatccaataatctacaccatccactgaaccataacccacaattaaaacaaagtggttaatcccataatgacttgaacagtttcctccatcatatatgccctacacaaatcaatgaattaataaaattattattttttatatataacaataataaactcccaaatatatactaagatattacagttataattacttactccagtgtaggaaaaatatcttctcagtccaaggccacactaattggttgctcaacagtggcgcacaacagtgctttttctgtctctgatggtgtagtatgatttgatagtattagaccatcaaaaccgtcaattgtaaccttgtttggtgctaattccagaaaaaaggtgcgcaaaacacagagataaagcggtaaattagtaagttagttaatgagttatattgtcaaaaggtaattaaatgaaagagggaatggattatggaatcgtacatattcaattcacagaccttattggctttgcaagtaccatttttagctggataaggataatcaacttcagtggcaatcccaccattttctataacccattcgtatgcataaaagtgatatccaccgtaacaaccgcggctcttattgacacaacctacgatttcttgttcagaaaggctaaaaaaaggtttcctgtcactattgcatatttaaaaaatgcattttttgcttcaatggctcccgtggcagaaaatgcccaaccacttcctatcaaaatggtttcacatgtacactccacaagtcatttccaaataaataaaaagttgaaccaatgttattgttaattagattatcttcttacttttgtaaaaactctcaaatatatttagtagacaaacaaatattaaaaatgcaaaactgttttaagcaaagccttagtatagttctaatgcaattgtttatattggttcttaaaagttaaaattaagagacctgagaatgctattagaacaaattaatgaattctttaaagtgcttacataagttgcttggataaataactgcaaacaaggttgcttaatcattggaaaaataattttcccaagtcaaaatttgaattgttgtgtatgtgaaaagataaaatgagactgatcaataaaaataagttaaaaattcaagttgaattctatcatttgaatgaaaattattgaatatttttaaatcttgtataagaataagaggcttattaaaaagaatgataatattcgtacactacaaaatgagatggatttggtggaaataattagagagagatggaaagaaagaaaaatgtagatagagaaagtaatggatgcaatatataaaaaataaatagagatagacaaaaaaatatggtgaaaaagggatggaagaaaaagtagatgaataataagtattttcctgctaaaaatgagaattaagaagctaaattaatttttttcaacagaaggcttcttaataaaaacacatgccacattgtccttggtactttacttcggcgatgacacccattttgctccaatcccaggatgcaggtgcatggtcgcaagaatattgttccttcttctttatttccttgttggccatgcatgttgatgggcagtgacacatccttgggatcttgcaagtatattttgctgaactcttcaggtgtgatgtcagcaaactagttcaaccccaaacgatgggagtgggcaatggcggatctaggttgataattgggggggggcaatgccccccccttaaatatggagcagagagaataatgttggtggctagtggaaaaaaaaaggcataataatggcagaaagaacaatgccaaagagaaaaggaactgcaatggtagaagtagaggagataagaatttgggtctaatttacttttcgtattcacattttttctttttacagtttcatattacattttcaaaataagcttttgaattttaatttagataattgctatttatagtctttttattattaatacactttacttgtattatcaaatttaattgttattttgtatttttagtatagaattatagataaattttcttaattaaataattttagttatatatataatataattttaaacgaattcataactttatacataaaatgttgatttaaattttttttacaaaaatttttttcgggggcaacctcaccactaaatatgcagacataaaaaaattttcttaaaggtttgagtgcccctccttaatttattttctggatccgcccctaggagtggggtcattttctgtttgcattcacgtccctatatagttcaaattgttttggaaaatgtcaagtctctttgcctcttcttcttggttctggtagacccgtccatgctccttcttccatagttggaacagtattgacacatgttcctgtgtggtaaacttggctaggtcaaggtcgaatatgtaacggtcacttgggatgttggaactagaagaagaagaagaagaagaagagagacataagaggggaggaaagaagcaacaaaaggaaagccatgatgattagagggtaacgactgatgaagttcctacgttgttaggatacaataatgattattatcctaattacatatgtggtggatatgtttttggtttgcatttgcggtatttaattgtgattaggcctacaatctagctatagctatagggagtgtcacacaccaaaataacaagaattaatttttaaattaagcttttgattgttgtgggttatcaaattgaagatagatctctttctttctttaagatttatcactttcagtaatttttgtgctaatacacagtggattttccatagaatataatcaacttgcccgtagccattttaaaaacattcaattgatgttaaacgtgtaatattctatctgtttgtaacatttaattagtgcgcttgaatatcattttaagataaaataaaatagtatagacaatgacttatgactctagctctctctctctctctctctctctctctctctctctctctatatatatatatatatatatatatatatatatatataacaccttttgtttacataaaagtacatactgcactttttattatcaggcaaataagatatataacaatataagtacagaagggtaccaaaacccatatagaagagatagcccttccaaggttaaacggtatttatatgcacatgaaaatataaatacaatctaaccaggaagaagcccaaataataacatcagctatccaacctaataccctacaaatgatcccctctaatgttcacagaataacacgttgcacccaaccaggcttcccaaaataaatggcatttatttataatgcctaacgccctctgataggacttgaatagtttaaggttggcacaaaatgagcaaataacaaaaaattttaaattagaagttaatttttttattattgtgggttataaaattgaagataattttctttctttaattaacatctgtctctttctgtaagtttcgtactaatacgaaaggaaatttctataaaattatcaacttgtatgtactcttttcaaaaacattcaattgatattaaacgtatctgttttctagatttattgaccaaataacaatatttttctaattaaaactttgtattcttttgattattgtgagttacaaatttgtagtttgctttctttctttaagatttgtttctttctgtaaggctagtgtgaaatgaaatttctgtaaattatcaacttgtattatattaccccttttaaaaacattcaattgaagttaaacgtgtattcttatctgttttatacaattaatgcttgtataatttgaaatgtttatttctttagttaatttgatgtcccgcaaatcctatgtttaaagccagatggatggacaagaagtttcaagcttgaaagcaagtttcgtacgcacaacagccaaactattagatttcgttcccctgcccggtgacatctttcctccttaagccccacaactagaaaaggagaaaagcaaaagactagtccactaagaatagccctagttaggatctctgtccccttcttaaactatggcatgccacctcttctactgcaggggattctcgaacaatgaaaagcccgtatttttgtcctaccttcatagaagaagtcctatgtcgtctgtggaacattccatacaaaatattttttcaaattttagcctcagtatacaaccataattatgtttatttgaataagcttccataaagaaaaaaaaataagagagagaaaaaaaaggtaatacactaaaattagcttatatagatgcataaattacaaatattttttttagagaagttatataaaaaacttttataaattcagttatgcagaagttaattactctcctctttttatttaaatttataatttttatggatggatcatccatgaaataatttttaatgaatgaattagataaatttttgttaaatggattggattgaaacaaaaatttaaataaatttttaatagatcaaaatgaattaataaattattttgatctgattcattttatcatccctatatataactatatttaaattaaacagtaattcacacactatgtagtcgagtgtttttattatattaataataaataaaaactcttttagtactttaatattttgaaatatttattgtcatagatgtgaagtatacttttcgaagaaaaatgattattaaacactctttggaaataaagttattaattcgattcatgatataataaaatagaaagagagatgagaaaaaatagaagtatattaataaatatttgtaatttgtgagtgttaaatcacgatcaaaaccactaaactcatgacanaggatctataaacaaggataaattaaaaggcctccaaattaaaagagtaaaggtttccttcattaaatatctacgagattatatttattaataaatataagtgcaaaatttcatcaccaataacatgtcttgttgacattaatagagaccatattgtgatcgagaatcacctatttctttttaatttctcttaaattaaatatttttatttgtattttatttatcacattttcatttattattttcatcgactcagtcacctatttcttttcttccttaaaaaaaggtcgtacagtaaatatgtttaattacctaaacttcatacacacatagttgccgtcgaacatatatattaatcttgactcattggtgtcttgatgcttttatatgtgtagttgtgtagttgtgatattattaattgggtacgtgccatctttcaaacaaataaaccccttcgactctacccagtggagaaaaaaaaacggtaatattcctttcacgtagtcgagtaaaaggaaatacactggagaacctatgaacgatgaaacatatatggtaaagagaaaggcatgaagcccagaggatatctcaaaacacatgcaacagtggcagtgttctattattgactttcacattatttgaagaaaaattagttgcgtattttatttttgtcttctcacattaatacagcatggaagactcgtgatcacacgcagaatcatacatgcgatgcttgtctctaagaaaacaagcactagctacttaattaattggaccaccttcacggttcaaagagaagagtaatccactctttgatcagctttaacgcgagcagacaccagtgtttctgatttctctttgatgggccaagaaacgaaaaaattaatcgcacatactccaattgggttactgatatttctttgaatccaaatgtatccatccattccccaatcttttccaaatgaattttttactatccaataatccacaccatctattgaaccataacccacaattaaaacaaagtggttaatcccatacgtacttgaacagtttcctccatcataaattccctgcacaaatcaatgaataaaaataacaacaacaacaacaacaacaacaacaacaacaacaacaataataataataataatccccaactatttaagatataatatagtaattacttacaccagtgtagaaatgaaaatctcttgcgtccatggccacactaataggttgctcaagggtggcgcgcaacagtgcattgtctgtctctggttgtgtactatgatttgatattattagacctccaaaattgtcaattgtgactttgttttgtgtctacttccagaaaaggtgtgcacaaattaaacaaaaagatgaaaggcaagagtaattaatgggttatatatacacaagctaagttgtcaaaagaaggtaacagataccttattggctttgcatgtaccatgatcttcagctgtgtaaggataatcaacttcagtggcaatcccaccattttctataacccattcaaatgcatgaaagtggtatccaccgttacaactgttggctttatagacacaatctgtgatttcttgttcagaaaggctaacaaggtttcctgtcactattgcattttttgcttcaatggctcccgtggcagaaaatgcccaaccatttcctatgtatcaaaatcgtgtcacactccacaagtcatttccaaataaaaaagaagttgattagtattgaaaataagcatagatcccacgattccttatataagtcaaccttttgaacagtttctataggctttactagctaattattactaacataataacatgcatcacataccgtatagtttgtgagttcaatcttctttaacaaaactaacattctaataaattaatattaatcaataaaaaaaatagtaacatgcatcacataccacagtccccttggtactttacttctgtgatgacacccttttccctccaatcccaggaagcaggcggatggtcacaagaatgctgtttcttcttcattttcgtgttggccatgttgatttgctgcgacacatccttggtgtcttgcaagtactttttgctgaactcttgaggagtgatgtcagcaaacttgttcaaccccaaacgatgagagtggggtgattttctgtttgcattcacgtccctgatatagttcaagttattcttgaaaatctcaagtctctttgcctcttcttcttggttatggtagacccgtccgtgctcactcttccatagttggaacagtgaagtcacctgtttctgtgtggtgaacttagttaggtcaaggtccaatatggaacgatgagttgatattctggaactagaagagaaacctaagagggagaagagaagaaacacaaggaaagccataactcggtgaaagtttttacgatatgtttgcttgttaagaaggtctttgcacaattcatatatatagtggttacagcttgtttgaaaaccatttcaaagagacatttaatttgacgtaaaaatcacatcttgactgaagccggcaattattgcttccacatttttttttacgagaaataatacataatttattctttattttaaatctattatcaatattattatttttatctatctctatctattttatcataaatcataattctatcatatttaattatttttttacttttttttaaatgtgtagtctatctgtctaatgtatacaatgtttacaatgtgtctggtaacaagaaaaaaattaggtgacaaataaaatgaataaactagatgagagaaatagaatgaaattaaataaagacattcgattgaagataagaaaaagaaataaggaaaacagaagtaaaacatttttttaaaattttaaagttaaataatcaattatgaaacactgataaattattatgaaaaaattgataattgattatgaaaccattcgtaatcaactagcaacggagaacaaatgatttcatgtataaaaaaatgttcattatcaattctgaatcattgataatcactgaaaacaggtttattgcacaatttttgcgccaatttgcagagaccacgtttttatttctttcattctttaatttcactctactaagcacactatcttttttatcaatcatttattttctttccctcttctcttttttttctctatgtcactcctacaaacaaccgtaattgaggagaggcttcggttatttgaaacttgaaagtgcaaatgattgttggttatagcaaattcagtttaggtccgtttatttaagcttatttaaaaaaaagctttattgataaaataagaaataattttctttttatgtgttacttaaattgtttttaataaaaatatttttaaaaaacaaattttatctacttaaacttttaaacaaattattctaaaactgttaaaatacgatttcttctcttgtaaaaaatataattctgcagcggtcctgcccggtctactacatcagaaacggtaccatactatagctacctatatataactatatttaatcaatccacgcgttatgcgagtgtcttttttttcatattaaaaaaaaataatgataatgacttttagtactagaatattttgaaatgtttatttgttttgtccaataatttgatgtgaattaggggctaaaagaattcaaataatacaatattaataaaaaaaatattaatttgagactgtttgtaaattatttacgaatttggaatagtaggtcgcgctcaaaattgggtgtgaccagtcccgcttgaatctgggtgtgaccggtcacgtccaattttgagcgcgacccactagatagcaacacgtgtcatgacaaatggagtaatgcgtatataaactttgaacgatcataacttttgactggaatgttcgattgaggtgtagtttgtgtcaaaatgcttgaaattgagaggagaacccctgagcaagttcctaaaggtgacttgttcaaaaatgttctccaaaagaggcctctaagtgcctcaaaattgcgattcaatcttcgaagtcccaaaaaatttcttgtttttctaattttttaattattttgttagttaattgcatgctattttttattttttttattgtctctcttaatttcgatcaaatgacctatcgtacacctcgatcagacattttcatcaaatgctctacgatatgtccgatcgaggtgtcaatgtccgattgaggtgtacgatatgtcaaaatgctcgaaattaagagagacaataaaaaagtaaaaaatagcaggcaattaactgacaaaataattaaaaaattataaacaaaattttttttggaacttcgaagattaaatcgcaattttgagacacttagaggcctcttttggggaaaatttttgaccaagtttagggacttgcccaggacttctctcaatttcgagcgttttgacacaaactacgtctcaattggacattccaatcaaaagttatgaccgttcgaagtttatatatgtatcgctccatatgtcatgacatatatcgccatctggtgggtcgcgtccaaaattgggcgtgaccggtccagattcgtacatagtttggaaacaatctcatattgataaataatttataaataattttaaattgataattttttattaaaattgtattattttggttcgtgaaataggatatttttcaaattaggaacatcgcctcatcagcgtaacgtgttttgttgataagctttgcacctgcatctgctatttgttattttagttggaggtttgggaaaagacgcaatgggacctgcaaggctgcaacaacttaaaatgcaatttttctttctttcaatgtatattagcattttaattttacaaaatcttcactctaatagtttgatttgatgaactacccacatgcatatccaatacgtaagacttatcaagtaaatgtcataaataaaataagaaataaaaaaattgcagcaggtaacaacaaataaagaacgtgtaccttgtggtatggaaatgtggtaggtaggaaccaaacgagtaagaaataaaacaaaataaaacaaatattttgttcagataatatttaagaaaacacaacaactttttttcataaattaaaatcaatttatacatatataaaaattaaaatataaaaattaatttttaataaaaaataattcattttatctctaattttcttctaatgtttgtatgaggtttatttacacatgtccgaaaagaactaattaagctccttttcttcaattaattttctattccgaatttggaaatatcacaatcaaatgagatcagagagtttctcgtagtcttctccttgaagcttctcatatcacaaaagcacattgctcggataaggttgcattaataaagttatgtgtttctttctttggtttttgcttcagctttgcaagtatttttataaaaaaaaataaaaaggaaaaaatgtgaagaatttttttataaataaaaataaattttttattaattaatttttaaaaatttactaatataatttctctaaaatataagatgacatttataaatgaattaatgaaaaatttattttaatttatagaaaactttatttcattttttcttaattttttcttcaaaaaatatttttagaggaactgtgagtgtattacttttatcctatactttcatttcatgtcatgttcatcgtaccctccaaagcttttcgttacaccattgtcttagccaacactgcctctgctctcctctctgtctatttaaaataaacaaatatttttaatatataaatttatatataattaaaatttatgataaataaatattttaaatgtataaattatattttaaatttataataatcataattttaatcgcaatgtaaaattatttttaattattaatattttgataaaaaattatcgaaactaagtttagaaacagttatatatgagtgtgttggatatgtcagtctagtaacttataagttacttcaatcaaaatactatagaaataggtgaagttgttcgactggaatttatagcttaatttatattaagccaacattagattagggttttttacaaaataaatttagccaaaaagaaaattaaattatttaatcaaataggaaagttaaattttgtcattaaaaaaaaattaagtctaactaacnnnnnnnnnnnnnnnnnnnnnnnnnnnnnnnnnnnnnnnnnnnnnnnnnnnnnnnnnnnnnnnnnnnnnnagcttaatttatattaagccaacattagattagggttttttacaaaataaatttagccaaaatgaaaattaatcttatttaatcaattaggaaagttaaattttatgtcattaaaaaaaattaagtctaactaaccaacttctttaagtaaatataaaagccatcagaatgtaaaacaacccaaaaatgtttctttacttgtgacttgtgagaactaggccaatagcaacttaacacaatcaataccgataccaacagttttaataaagagtataaaattaagtaaggaaacaccaattttttagggctcatttgtttaaaattttaaagaatcacttcttttttaaaaaaaaacactgtatttgttacaaattttcaaaacaagttaaaaggaattagaaatattattataatcataaactattttaaacatatgttggaagagattaaatctttaaatggatttcaatatctaaggagattagttattgtctttcaatcaagaaataccttagttcacccaaaaattacttcttttataatctgaaacaaaccgatccttaatgagaaattttttcttgtgagataacaaaaactatgacatcaaatttagcaaatttctgagtataaaataatgggaacatgactacatcaacaaaatcaccgaatgaacactaacaaaaatgattttttttaatgaaacaaaatgaaaatttaacacaataaaatgcgccacgaaggtaatttggctagaaaaagaaaagaaaaatgaaacacaaaattaaataaaacatatcataataaaactcttaataaccagtaactgaaacagaacatgcttactttatcaacatctactcaaagacactaataatcccttcatcttctgacactaataatcccttcatcttcttttcactggactgcgtatcttctaaatattcttctgacgaagagtttgtattttgtttatgtatcatggccccatggggcacctctcctctccccctccatttaaatgatattatccttttaaatgggcctttcggcccaacaaaacaatatatcataatttttagggcgttgcttcctacaccccgtatggcagtccaaattcattcgttgctaccacacccaaaaacatcaattttggtttgtctctctttacgttgtgagttgtgagttattgggttgaagtcgttatgagacagtgaggtttggagcactaatgacggtgaaagagttcaagtagttttcggaggcactttggagaggaaaaggaggcacatgggcacatggccatgaagaatgatgatgattccactttaaattaagggaccccataataatcctgaaaaccataaataatatttatctcgtactcgtacaatctaagcccttgttgttcatcaccaaaataatctaaccccttgtttaataaataatagataaatgattgttacttattagtttattgggtaaatagtttaatttgtaaatatgtaaaaataaataaaataattaaaatgatttatatattaaacaaatttacctaatttataaatttgtataattcgaaaaaaataataataatgtttacaatatgaaacaacgaaagcaagtttcctactgatttagtgtttaattttcttctcgatttagaaacggaagatcaaaattatggatggaacattgcaaggacaaagaaaatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcagccaggaaagaatccatactttatgaataattttatctttttatatcgacaaaatttgagtttcatttctatatattggtaacaatgtaatgaatttttaaactattaacaagtaaagaatcataataaatatgttttttttttcttttatataaaaagtaacctttatagttacacttattttatagtaagtttatagaagtcaataaacttactctaatgataacttttttgactaattgacaatatcaaaattcgtttatagttaaatttatttattaaagtattaatgtttacnnnnnnnnnnataacataacaaattaatataaaaaagtttcataccgatattatattaaaattaaattgaaaattattattattattttaaataaattgaaatatatttttattagcatgattaaattctattaataaaatactatagtggggacattttcttgaaccactaatcattagcgaatcttataaatttaatgccacaaaatttaaataattaaattccgctggttgttttcccaactcaacaatacattatcattacattctattatcgtggacctaaatttaaaattaaaactctttattcaataaaacatttactacatcagcaatatagaattattcataagtaatattttgtagtaccatatatgtacttagaagcagacaatacattgttataattaaacacaagtgaaatggtaaggcacggttggtggtgtcctctaaacgtaataatttatttactcataaaaacaaagaaaagaaaaagtactaagaaacatccgctgcacctgcactgtgtccgttgccagagtcaatgattaagtaactacgtcacaaacaaataatcagcacacctaccaaaaataacaaatactaaaatagatggaaaatcatttattttttctacaaatagcaaaaatcttctgcataaaaataatcatttcgaataagaaaataattattcactacctaaattgctaattgtgttataaaaaaatctataatgttaatttaaacttaataaaagagataaaagataaataaaaaaacttaattacattaaatttttaatgttaatttaaagaaaaaataatataaattaaatggttcatttcattacattaaatttttaaaatttattttgattttatatatttttaaaatttttaatttgattcttttttttccattaaaaacatcaagataatatcctgttaatatttaaattttaacgaaatactaaatataagtataataattaatttaaaataatcatgattaaaatgattaattattttaatatttaaaatgattaattattttaaaatttaaataattaatcatttcagtaaaaaaaaaatccacactttcaatagtaaatccatgaatatgaatgaattattttatttactttaattttcctacacacaatacaacagtatcatcaaatgaaacaatttaataatagaaaccacacccaccaattccatagcttcagaactccaatgaagctccatcaccactagcgaacacttccattgtttttatctcacaggatcaatcgatatcaccagcaccaccatggaagaggtggcgccgccgccgaagaaggaaaacccgaaccttctcctggggcggttcgagctcgggaagctcctcgggcacggaaccttcgcgaaggtccaccacgcgcgcaacatcaaaaccggagaaggagtcgccatcaagatcatcaacaaggagaaaatcctaaaggggggtttggtctcccacataaagcgcgagatctccattctccggcgcgtgcgccaccccaacatcgtgcaactcttcgaagtgatggccaccaagaccaagatctacttcgtcatggagtacgtgcgtggcggcgaactcttcaacaaggtcgcaaagggaagattaaaagaagaagttgcgagaaagtactttcagcagttagtttccgcggtggagttttgccacgcgcgcggcgtgttccaccgggacctgaagcccgagaacctgttgctggacgaggatgggaaccttaaagtctccgactttggtctcagtgccgtgtcggatcagataaggcaggacgggctgttccacacgttttgtgggacacctgcgtatgttgctcctgaggtcttggcgcggaaaggctacgatggtgcaaaggttgatatttggtcttgtggggttgttttgtttgttctgatggccggctatttgcccttccatgaccgtaacgttatggctatgtataagaagatttacaagggtgagtttcggtgtcccaggtggttttcttctgaacttacaagacttctctctaggcttcttgatactaaccctcagacaagaatttctattcctgaagtcatggagaatcgctggttcaagaagggtttcaagcagattaagttttatgtggaagatgatagagtttgtagttttgatgagaaacagttacttcatcatgatgatgatttggcaacctcggattctgaggttgagattaggaggaagaatattaatagtaatagtagtaatgcatggtgcgctgccgaggcctgcgagtttgaatgcgtttgacatcatatcgttttctcagggctttgatctatcagggttgtttgaggaaaagggtgatgaggcgaggtttgtgtcatctgctccggtgtcgaagattatatcgaaattggaggaggttgctcagttggttagtttcactgtgaggaagaaagattgcagggtgagcttggaggggtgtagagaaggtgtgaaggggcctttgactattgctgctgaggtttttgagttgacaccttccttggtagtggtggaggtcaagaaaaagggaggggataaggccgagtatgacaagttttgtaactctgagttgagacccgcgttggagaatttggggatggaggaatctgcttcttcttcttcttgtcatcaatctacacacattcaatctgaactccaacaacatcgaacactttctgactctgcacttaacagacattcagataatgaatgtttatacgaaccagagttgggtctagcagacgagactagtatctcgcaacatggtgaatcaaagttagaatgtcaacaggaaaatatggccatgtttactatctgatcatgtcttgggctctataattgtttccaaagaacgaaacatatcggaaaccaaaaaagacaatgaatgcttgcattaattaaggtagcaggagaatgacagaagatgatagcatactaattctctcttgttattttaggctgtgtgtaagttaaattttactttctttttccctcaagaattttccggcattgttaggtttgctccttgactggagcattagatgctactgtctttgtatgtccaaatgttgtatttctgtaaggctaatttaatttaaatatagtgaatgaagtgtacatgttcacagttcacagttttcatgtcttggtaaattgctctgtaactgtatttattttctttctttattgcaagtaatgagaaaataataatgcaactttcttgtgattccgtgaggtattgcactggatttgggtgtctagtgcttcatattaactccatatattcatcaccttaatttggaatgagattgtgggaattcactctaatgctatatttggtaagaaggaaagaaaacaaagtgaaaggaaaacacgaacaatataatttcttttatttgaatgaagagaaaataaataaaaaaagaaaaaaaattgatttataaaaataaaaatttaaaattttcttttttttattttttttttaattcaaattttaatttttttttcctttccactctctttctcctataccaaacataggctaaagagaggaatcagaatgtcataacaacaacaacccgtcctagtatatgtaaccaaatcaggtcaagatttcatatcggtgtaaagggaaatgaaagccttatggcttatactattaaataaagaagatttccttcactgtttctcgtttaaaataagtgatctattttcccctgaatcatgctgatttccagcgcatttcttgttgatattatattttaaacaatggaacaaagtgaaaagcaaatactcatatgccagagtagagaaaatgggagaaatatgccggatttatcaacatagatgagattcactcaattctgaaagcattgtagagcattgatcaaatgaatgataaatgccctgaaaatccctcctatatccaaaaaataagcttgttgctttcacaccgggcctacacatacaagtggtgcctattatttgacccaaaatgcttcagcaaaacagacaccataagtttgattgtagcgtggccctacacacttacaagtggtgcctaaggaaccgtcgtatttactaaacatagcaatgcataggtgttatgtctacaaattataaattataaactcttaagaaacttagttattatttcatgaagagactttttaagtgaaaattgacttgttagaaaatacacacatgttttacgttatgtacatgccatcactaatctatggtttctggatcatttggtactttgtgctgatgcaatgaagcctggtgttgaactagattgagcgcttgtctacttgtcttctaactcatccttcaccaattccaatgcttgtttctttctgtggtccaaaaacagagagccagtggtttcaaataattcaaattgtaggggcccttgtggctaatggaaccgactgttggaacctatttggctgttcaaaaactttttcatgtccacctttctgctgtagctgctgattttatatattcaaaaccaacctgggaagtggaaggctgaaaaagatgcatgataggagtgttttgtatttttaaattgatttccctaggaaataatatcaaacacattttttacttattagtgcggatttgaatcacagatagtattttctttttaaataaaagttatatttgaataaagaatattgattagtaatataatgtgatatgattggtatataattttatcttttatatatgattataggtttataaacatatattaaatgagatcaattccttaaataaattttaatatcttaaaggattaattcttaacttttgtagaggataccgaattaaaaaaaatatatttgatttcacttttttagatatccattacttcataacacacatagctagtgtttgctgtgaagaggaaatggattaataagacatctataattggttggactacttacaaatgtccaatgtccagtcctacaaatagatgcaagttgaacataaacaacatgcccggactcattttaagattttcaattctatatttgaagttgtcatttaaattagaagagacaaaatatgttacttgctcgatgtaggtggcagattataatggttggataaaaaaatattatttttagttttaaaagtgaagcacaaatttgattttctcaagttttttttttataaaaaaactaagcttagatccggtcatcattaggttaagctaaaagaatctatatacaattcatattcaaaactcaagtcttatattttattagacgagtttgaaccaccctactaatccttcttattttactcctctaatttaagccttgctatttttaatttttttttcatcatgttaagtttttatattaagagatattatcttgtctctactacaataagttctttccagttttgtcactaaaatgcaagtggacactattgtatcgtgcacgatacgatttcacaaggtattttttttcttcttaaacgaacttaaaaaaattgtaacaaacaaaatagaaaataattttaaaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattattaattattttgttgagcataactgaagctactaaaaaaaaattatgtacctaatagtaaaaaaaattaattaataaaaataactaaaaaataactaaaataacttgacgatatgaccttaattaaatatttatttcctaaactttcattatatatgtgcattcaggaaaaaaaattcattatatgtgagtttatgttataaatttgattataatttttttgaaataagattaaaaaacttatttagatatgttttagcaaagaattataaaaataaactaaaaaacgtttgacaaatcataatccatttctgtttaagtttaaataaattgcatggatgtttttctaaaagcttccgtaatagtgaatacagaggttctataatatttgggcttatttagttatttattagactgaccattttttatttattagttaaaagaggtgtttaggaaattttttaggtttatgattatttgataaatttgcggattttgttttatttttattttttttaccattttctttattctgatttgtggttatttcataatgaacgagtttgcgttttaatagttcaaattttttcccatcatgtgccttgagttgaaagacttttcgaggccacatgattacgtgagggtagcatctgacttaggtgattgtaaagtgtggggaaaacaacattggagagattaccaaaatgaactaatgaaattggagagatcatatgaggagataaattaacgtacatcatcaaatccgcgtcctcgcatgatttgctgactcacaattaatctctaaagcgtcatcactatttttgtgcataccttaatcaaaatcataaatgaaaatgttttgttaatagaatctagcttaattgattaaatagaatatataaattattataaatttattgacatttctgttttgatttttacatataaaaaataataaaaacatcctccacactaatcagaagcacttggcggcaacccaatcttgtgctcgtatacattttccctctagagtgaactaactatggttattgaatgggaaatcagcagctaaagtatacagattttgaatatgtggcacaaatatgaaaaaggtaaacgtatgtagccaaaagttaaaaaagaaatgtgtcacattaagaaataaagtttcgacatcaaagatatatcgattgcatccattgcaaataagataaggggtgaaatggcagtctgacaagtgacaatactaaatatctttaaagatatttaaagtaacttacaaatgttgtttgtttttgtttttcctacctgtaccaaaaaatatatcttttaaagtaataaagtgaaatgaatggtctatatactgccaagggtgtgcaaaatatctctataaaccgaactaaatatttgaacataagccaagttgcactgtaagtggtgaaactgatagttcaataagtgtttgtcatactaaatgtggtttttgttgactattaaacaatttagtcaattaaatgcatatagctggtgcagccgaataatctaatcacgtagtttgatgcatattacttaattgtggaatcaaataaagctcagttgtcgttgtttatgttgtgttttttcaactattctgcctcccttttgaaaaatgcctacctgtttgttctggaattggtagactatcttaatcggggaacagtcacaacttaaaagtttcattaataataattgaatagacccgtatagaagttgcatgttcattgggactgaaataccaattaatttgtcaagacttttttacatcccaatattcatcaacaaaagtacaatttacaacaccccacttgcaaaattacataacacgcttccactgggacaataatagctatggtattttgattatatggacttacgaaagaacaaatagaattaaagaatttgagtagcaaataccatatagcattatcagaaagctgtactcttccagcacggtaaaggttagagagagacttgacttagaatacacagaagagagttagatagaactttttaagtggcctccactgataagatctccagttcagcccaccagagtggagagagtcttgggacagcttgctcgggtgatatatgaagcacttccctcaatctgggagttatgtccttcattgtaggtcttaaccttggatcagattgaagacaatctttgatcacctcacagatgacatcaagttcttcatctttgaaggactgcagcgtgggatcgatcagatagccgatgcttcgcttatcattcaagtgctcagcagcctaggaagttgatcaggatttttttgttaagtgacatagaacaatggagttgcacttgaaagtacaaggaagggtactttcaaaggaaagaaaaacaaagtaacgggcacaaatttcaaacttacccagttggaaaggtgaccttgttcttcagagtaaggtagtttcccagaaatgatttcaagcaacaatactccaaagttatagacatcagtttcaggatcagcctggggtggcaactcagaagatttctgtgattcatctccagttgtgttggtttttgcatgcttgccgaaagagatctctgatatctgagagcaatagaatggagatatgttacttgttacctaacacacattaaaaacaaaaaatagaaaggtgtataccttagcagcatagtcatctgttaataatatagcaattgaattgaggttggaatgagctactggtggatttagatcatggtgcatatactgaagacaataagccacgcccataataaccctcatccttgcgctccagtcaagaggttcaacttccttaactgaaaagagagcaaatatacacaaattcagcacgttgttttttacgaagagaacttaaccctttaatcggatttgctatgcacaaggtaataacttgagcctttagatagagatggaagttgttaccatgcagatgctcgaataagtttccattcggagcatactcaaacaccatcatccttgtgaatggttcttcttcgtcacagtacccaataagattggtaaaattcttatggttaacacgggacaatgcagcaatctgaagcatacaaggaacacaattagcaacaggtaattaagaatcgacagtccctctcaattgaattgggacttctaattcaactttttcctttccattgacttgaaaaggagaaaacctttttgcgataggctgtctccatgttctttgaccaatcatgggcagaagtaacaatagttgaatcaacagcaatctcgactccactggatagtgttcctttgtatatggtgcactcatcaaaactattaataatattgctgaaatcttcacaggctgtttccagctctccctgattcaacttggggacccctacattacatacaaggacaaaacaccgcaggaattttggattgagctaataacttaaggaagagagctcagacaaaattgtttcataggttgacactttagatagtatatatattgcctaacaagaagagaatccattttcttgcaattagctgaccataaaataatgaaatacgttcataaaattgttgttattcaaattagaaagatgatgcttgaacaagttgaacaggagactctccaaaccttaaaaaaaggtaatggacttattgtaacttacataaacaaatgaaaataatcaatcaaattactatagactaaagaacatatatgagggaagtcagtatgaggcgtttaaaatttggtaaacaaacattatttatgttaaagagtcattttcaatatcaataatttattcatttactgaaataatacctgttataaatgctttctgcaactgtccacttattcctgtcttccaaggctttattacttttgctgctcgtttacgccaaatgcaaagcatgatcacaaaaacaatgaccaagacagcaacacctgcgattataataatatacttccatgattttccagatgcaccattaggtgaattttgttgacttgcttgattcacaggtggagaattagaagatgaaggcaatggtgcaggtgactgattttgtttcttattgctgtctggcacagctgggaaagctccactgctctgggtaattggaatagaactgatctccatagtaggcccaccactgaaaggtgcagcagcaaggttactggactgatcaagcaacttacgtcgtgctgaattgattagatttggtacattctggccaaactctgactcatcagagcctacatgatggaaggtgtgttttgaaagtcagttaagagcataagtatcaatttctcacaggccataaaccaatcaaggttctccacttactagtcagattgtcacagtatttctcttcataggcatggggagtagcctttcctagcttgaaccttcaaataagagcagactatgttagtaagctaaacatgatgaaagaagaaaatatatgtacatattaagattgatatggggaagaaagttatctacacacagtggcagtgccacagcaatgacagctttgaggtaatttttgagtgttcctttaagtggaataacaaatgaatcttccatgttccattgcttgaaatttttatggcatatatttttttcaccatgttgttcttgttgttgtatacttttcacacgatgcatcgaaaggtcaaaaaatcagaaactcaaccattcttgttaaccataaaggatgcagcatattaagataagtatacaatctcaagaggatggtactactaaaagtttgctactgctaaatctaatcttaccaccttagcacagctataagacaacacaaaaatttcagttcctcatataacaacaaaaaaataactatggtgatcagataaaagaaaatcaaatggaaaaacaaacactgaacaaacgaaattctgcgagtctcttttgagtttatatggttgaagtacaccacaaactttcaatgaacataatgaaatgatcaacagtttggattttcaccagtcattgggctatcaaatgacaaatgatgaacagattgcttttaataattgttatttaggtaacttttaatcttcgcagcacatatgcaattagacaagagccaatcatagataaatagagtgtgagttctactgctataaatgtgtaaccaaagacaaactgggttttaaggagttaaaacaattaactaaaaactgaaaacagaaacaaatttcaatttatctttacctccatagacctccagttaagaaagaataaacattgcattggtgttgatgcagaaaaggttaaacagatcaacaagtgccatcagaaattcagaatgaagatttgtatctatttaagacaatatacagaaaccccatgtaaacagaaaattaagtatttcatttatgacaatatgagatctcagattgattaatagaacatcttaaaccaattaaataatgacatcattatgtataggcacatgaagagtgcagttgactacatggaatatatttgacttgatgcctgaccttgtggaaataattttccagtgattgtccaaaagacttcattgtttgcaaaaagaataaaatttgtgacaacagtagttcttatgactaattaacttgccactacataagtaaaggtaaaggaaggaaagcataaggtcactaggtcaggaaaaaaatgaagatacacttacaggtgtgcaaactttctattcttgccacgagataaagttgccaaaggagttaaatgattgttattagagggaaatctgagctcttgagaatcactgccttcaaatttattgtcacaaaccaacctaggaaaaaattaaatttgattgtaggtaacccagaaatataactaaatatatgaagaagaaaaaaaaaagaaaaagagttaacttacaaatgttttgacaacaacaccctgacaatttctgctgggatacatccagtcaagtcattcccccttaaatccaataactccagcttgtctagacctccaagttctttgggaatggtaccagaaaaactgttcttgtatagtacactatttcaaagtaacaaagggagcaaatctgaattagagatgtatttgaatataaattactatatgaagtcaactgaactattggattttaaaacttcctagcccatatttagtctttcattaaagacatatattaacaaaccgtataacattgagttatagtataacaagaactaaaataaccaaacagaagggctcatgataatctgtccaacagagacaaggaaccctcatggacactaacatgatataataatccagctgagagcaaactaactgtaattctttggagttgagtacttgagaatatagctacttttagagtttttgatggggagagaactgctatattgcaggaaggcaggcttacaaattaacattgcatagacgggagaagaaaagaaaagaaatgttgaaaaggtaaagaaagaattataaaaatcataacacacaaacaaaggcatcattttttttgtttggttacacagacattatttactgctattggtctcctgagttcatggctacattccagacagaagggaatgcggcatagtgtgattaaggaatgtgaaactgatacaactgtaacaaggtacatgttagtatgagcagttcatttttcaagcatatcatgattatttactaaatttaagaatgacatctatgtgacaaatgctgagctcttagatttaagttacattattataagatcaagtttaatcagagctttcaccagcataacatgtgttttacttttgacataatggtaaaaaaaggggggaggataggcggacacatgaatcaagaacccttacagggattttagatgacgaagtttcccaagctcaggagccaatgtcccttccaaagatagatcaggtaggaccctacaagaaggcacaaaattctataagcacataaaatttagaactgcattcacatcaaccaaaatggaagctttctttaagcatcaaggacaactatatgtattactgtttggtaaaaaaaaatactatctcgataaaaaatttaaaaagaggaaatcaaagggagttacttacagcgtttgcacttgactatcaacacaacgtacacccagccatttgcaagggttgcaatcgtttggattccaatttgccagagcagcaaaaggatcagaagttattcttccccgaaattccaacaaggttaatcctgctatgtccattccaaatgcaacagcaaaaatcaaacatcaagatacaataaatgcattacatgattcactgtaaattagggagactaaaaggacaatccatgcaaatcaccttcatcgttcagagaccaacactgtcgagttccccacagagaaatcaatccaacataaattcggagccataatccaaatggcccccatatgctttccattggcatgagaaggcaatgtcactttggtagcgacaatatctatatctctttaaagtcaggaagctatatgatatgtcatatcaaatttacaaaattggaaggttttctctgtacatagaaacccttccacctatttggatgaagcagcagaaaatttactaactatgcaaaacttacactttacaatggaaagcaaaaacaattgaagctcttggtttcagggtccctcattttgtgtatcaatctcttccttacaaccttttgctcaacaaaagcatacccagctcaattcgtcctctcaatgatgattccaaacaatgtgggctggggctgtaagaaattacattacatccagagaaaaaaaaaataaacaaatgtttttattccaacaaataaaaaaaataaaaatgaaaatgataaagttgacagcaaatcaaaaccataacaaaagaagaaacaaggaataaccgcatgagcaagcaaactttcttggtcccatcaatgttaaaacaaaaaacaaaagggggtaaaaagggaattgaattaccatgcgaatgggagaaaagggtgcaggaaaagaagccctttttgcgttgaaactgaaggatcaacaatgtttgatttgatgatgcgatgcaatgcaatgagttggtggtgacaggttgggtggggggtggattaaactgagacaaggaaggagtgagaagaagaaaaaaaaggcagcaaattaaaagattgaaatgaatataatgttgttacgttaaattgctgcctttgtgaagaggaggatctcagagaaacctttctccgaccaccttcataatcttacaatgttggggttcttttgtctctcttgtctcttgtctcagtttctctctcatcaccccccaccacccacacacacaattcccccttctcatattttttttttcttcctaaaattcgttgtaggccccattggccaccacttccgaattactcgcacgcgcttttttttttgttactgctcgctcactattattatttcatttgtgtacaaaaatggattgggatagtgtaattaataaagttcttacattttcatttaattaaaggtgcatgtaaaatgttactaatatttttacgatatcatcataattaatttggaatggaattctttcaaaacaaaaaaataacttggaatggaatctcttgttaattcccccatttaatagtaataatatgactaatgtagtctattattagataatagattctactatggagcaaatcagtacccattctgacccaaagactatttcaaattaaaatggctaaggaattgcttgtcacgatctaaagtaaagacaaatcaacaaaaatatactaatatacggcatgacaattaaatgcactcgtagtttagtgtctgactatgtaaaattgaccacctaaccaggaagatacatatttcaactttacttgtattgttcaacttaatcatcaattccttctccatatttcaaatcataaatgtcgttgctattggttgcattttgatcatgctattcctgttgaggcttgtctctaaactttaaacaaaatttatatttaaaatttaattaatattttttttcttatctattgtaaaattatttcttacaatcttcttattaattatttttaatatctcaaataagatttgcaaaattttaattttaaatcattaatttcaacaatgacaatggttgcaagcattatcaataatattttagaaataattcatgtatttgaagaatatatttgtttggtatactttcatagttttaatgggatgtgaaatacctttaattttcttttatttaattttcatatgatatctcatttttaaaataaatcaagatcttagtatgatgatactcagtataatttaaaatcttttcaagattaataaaatatcatttcaactcattcatttccaaagttttcatacttttagaattcatataaaaaataaaacgtatattatgaaaattattcaaattgacttttaataaataaaaaataatctgatacgaaaaagaaactttagttaaatgtgtaactaacattttctcccaaatctgttttttcatcaatcatacatctattcataaaatttaaattctataataattttaatatatatagtgttttctcaaaaaggaaaaggaaagtggagtttaaaatagatgtaaaacgattttcttaacttgtttctactttctaatatataaaaaacacacaactcttttacttcaataaagtagagtttaaaagagatataaaactattttcttaacttgtttttaataaaaacaactctccttttacttttattttaagttgaatttcaagacaaaattgtagaaaagttggtttaacgataggctcaactgaaaactaaaacaagatacttcttcagttttactttgtgaacatacttttgggccatctgaaaaaaaaaaaaatgcaccttgtatttaccacgccatgctcttgagatgaatagtgaactgaacagcaaaacagagacggttttgcgaatctatagcgtgaattacagaaacacggtaaggaataaggatcctgtcaatgcaattgagcacggtttaggtccttttttccaaaaactaccaaaagctgtctttatgaagctctataggaatgacgaatatactttgccctgaaattgtcattcccaaaagatgaaaattcttttaatagcattgacgacctaaccatttgattgaaagaactgtgtaagattaaagtgaagagtccgatctgaagttactgcctccatggaatcatgcacagaggggattttattcactgttggtgatgttagtttgttgccgtgaaacgaggaagaagcttctacagtttttctgtattctgtttcttttatgtgtttctattctgttatgattagttttttggtgctgtcaaatgattcgttgtaatccttttatgtagtaatgtagtatgtataatgcgaaaggaaaagtcatactattcagttttcaaaaggaataaccttaaacgtgtatcctatttgcattggcgtggggtggggtggttacaaaaatatgagaaagtgatataaagaaataaaaaaaatgttaatacacatttttaatgtatttctattatttattttttagagattctatttattgttaaatgtatttaactcacaattctattatttttaaaaagttttaattaataataaagaatatttcaaaaaaatatatattgatcttttttttacaataacaaccatgaaattcaaacttcaaatttcatgctaactttcaaatcctctaccactatgtcaaccttagtggttaaaaagaacattaattgtcaagaaaaatgcatatacaattataattatccttttccaaaagattttccccttaggtagtcctgttttgagttcaagaattgatcaagagtgtgcttttcttttctttttttttttttttcgagcaaaggagaaacccgaaacaaaaactacactattacagggtaaggtcaccaccccagagcaaagaaatgcaaggatacggaggttgaaggctccaatgagctcccaactccctgttatgagtctctccagctagccaatccgctnggtaaggtcaccaccccagagcaaagaaatgcaaggatacggaggttgaaggctccaatgagctcccaactccctgttatgagtctctccagctagccaatccgctccatattaacttctctaaactggtgggaaaaatacacctgcctaaggagtgcgcgatttaaaaatcactcagataacttataaacttatacagtatttgactagaaccaaaagcttatttagtaagctttattttagtagtaagttgctagcttatttttatgttttttttttcatgttaaattgattcattttaagataaagtaatatttttaattataatttcatgatcaagttaggaatcgaaattcattccttgttattttcataagttacttaaacaaacttttagctcaaactgctaacttttttttatcctcactaatttactttaattttgtctttatttttattttttttaaatttggaaactctttcctaccttgtcactctcaattatgtcatacatttgattttcacatcttttattctcacactcacaaagccacaacatgcatcttaaacaatatgtatccttaactcatcaatataaataatcaaatcttcattttttttataatgtgatattttaaaattattttcctcatatatatatatatatataatcaaataacaaaatatattatgttatgtcattttatattcatcaattaatttcatcaaataaatatttttaattaaataagctaatttgtaacttttccttccaactcctagtagtaatttataaacattcaactaacttataaatttcaaagtatatattaactgattttactaaacacaacctaaataaattatcggggacagtgcaataactcaaattcaatttgcctttagctggcttagtattatctaactctagtctgttagttaccatcacttctcatcaatggtggtaccaatggcgagattaattagcgcgcagcatcattgccattgatgatctctatagttttcttttatatatggtatttattagtagatgtggcataaagtgatttgattacactatacaaacgtggaggtggtgcagaaataaaataaaaatatatcaattgaatatataaaataaaaataattcctttaattttgttttgaagaattctcctaaaggttgtaccgccctcgaattcaagtactaaccttgtccatcaatgacgaaataaattattggggacactgcaatacccaccgctcaaattcaaattgcctttagctggcttagttttatctaaccctagctagtcagtaagtcaccatcacttctcatcaatggctaccaaaatggcaaggttagcaacatcatagccattcatgatctctgtattttatttttctttaaagtgtggtatttattagtggacatcgcataaagtgacttgagtgcatcatacaaacgtggagttggtgcaaaaacaaataatatttgaactgaaaataaatccttaaatttcattttcgtcaagtatgttgatatttgattttgctgcattttgtttgatagagataattgttaaggatgtatttaatttgataaaataaattatatactaggcgatgtaattataattatttatgtttgatttttataaataaaaaaacataggtaacacaacttaaatatagataaataacaataaaaacttatttttatttatttaataaatcatgagacaacttttatctcagaaagacaaaaagtaccaacatgttaaataatattttttatgaatacactacatttcttcgtaattgtcaccgttatgcatttctattgagctagctgaaaatgtgagatcctaattactaattagttagtagccgacatttaaccaatttaacttgttctcgggccaaacaattagtacaaccttagactgaattttttttaatatcattaccttagactatgtattatatatcagagtctccacgtattacataccctgaccataagtgccatattactatcttacttcgagaagatagttagactttgatactaaatgttataaataaaaaaggaggaaaaaatttcttaatacatttcttgtttcctttgaaataaactctcatacataagattgcctcttttacgtacaaccaaaatggacatgttaagatattacaaactaagaagaaatttatacttcttaatttaggtaaaagtccttattatcatacatcctaaattggaatgaattaggattaaaagaatagagaaatgaaaagaaaaaagagagaaaataatatatgtgataaataataggatgaaaaaatgagacacaacaaaaatgagttaaaaataagatacaagagaaattgatcagtgaattattataaattttcttttggtaaatgctcaaataccagtagcgtttatataaaacttcgtttgttaagcaaaataaatttgaattgtcgtacaatgtttttcaaatcataaaaacaaagtgagtatttggttaagcgttgagtgaaacgtgttcgtaaacactgctaaagtctttaaattcttagcatgcattgtaggaaatcaaacactcacattctgcaattaattaagctgactggaaagagcatataactgacattaattaatttttagtaccacccagagctcttcaataactctccttcttcttctgtcagtttgctgctagttatttaaaggccagagccagatacagatgcatgtttttaactatattaagctggccagacaataacctacgtatatgatagaataataaatagtattactgtattagactattaggtggtaccatctaaagaaattatggacatatatatactgctttgtatatatagaaattaacgttgcatatatatatatatatatatatatatttattggtaaataatatattaataccctttgcctttgggagttagcctctttgacacgtatgcattgtcactgcacatattttttgtttgttgagtatgtttcatattgtacctttaatatatataaatgggctaagtttatataatttcttgtaatctgaatataattatacgacttcatgagagagtataatgaaaagttggatttaactcacattgaatgaaccaggaatatatattatttttgtttttccttttctcttttctcaattattatgtgattgttcggtactcaatattgtgtttggactttggaaactcttgtgggacaactctatcggctttcttgaatcatggttatctgtcaaacggtaattacaattagttgatatagaagtgaatgaagctgaagatataaggttggtttaagaatgaatgaaatcttcaaaaatcaagcggtttctaattgttaagacatacctagtggttcttatgctttttgatcagtaggaaaatgggaccactgagctggtacatatttgtctttttcacaacgatttcctactaagcagtaagcaccccattaccaatatgttctgttaatatgggaccgctactgtttacttatttcacattttcattattatccttactctgtctgttcctactaaacacccccattacaataattttgtcaacattggaccactgatcggattattaagagtgggaacgagtgagacatgtgtaaatttattattcatatacaattacaatgcataagaggtgtaattggataggtcatttataccacatgtgtaatgtatcttctttttttatttatttattattgcagtggtgaaatttatcttaaagtttcttcatacctaaaaatttatttattttgtgataagatatatttaaatatagactacaaccttgttctaattagattaatagacaccagctgacaaaaaaaaaagttcagaattgttgtcaaataacgggctcttttaagggacttttttttactggaaaaattaagggagttaaacctttagaaaaactaatttatatatatatatatatataataagtatgaaatatttattgattttgttaataattaatttctattaaaaatatgaataatcagttttagtaggatcctctatcctaattatatttttctatccaattcacttaatttaagtaattcaaacttaattttacttgaactaacataataatattggtactacttaaatagcggtaattaatgacatacacctactcagagaggtcaagcctaattaactgtttagtaatttaaaatttgaccttttaattcaatagaatttttctgcaccaaaaataatatatcgaatttttaaaataacttaatttaattagtaataaattttacgaaatggtgaaactttccatattaattatgctttacttaaaatttaaattacatgagagtttccataagaaagatattactagcaagtttcgttattaattattattttaaaaatttacttatataacttgtaagttcctatcaggaaattaaactaaattattccgtgttctattataaaataatacaatattcaaattattaaaatatttaatgataggtacaaaaattaatgtttctggaacatttagtattgatttatataaaaataaataaatataaaaattaaaagtaataaattcatgaatattttttatatttcaagtaaaactataagaaaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaatatttaatgttaaaaatataaattgataacaggtataaaaatataaattaaatataaagaattaataatcaacaaaactagtaaaaaactgaaaataagaagaagaaaaattgtaaggtctaaaaaatagcataataattcatttatattatttcattttgatttaaaaaatatttttatttcatttcatttaataagtatattttaaattgataaaaaaatgtaaaaaaaaaactattatcctaatttctaatatgagaagttatttaaagtaaattaaaatgttaaaagtgatcattattttaaaacatatatagttataaaatgacaattaattaaatatatttttatattttttaaccctgaccagctagttcaactaatttaatttggccaaattataacatgttaatttaatcaattagtttatttacttttaatttccatatttaaatttttagctacctatttcaattagctcatcgacaaagtaggtatagcaaaaacacccaaattaaagtctcaagtaggataacaatttgtccctgaatatgaggatcttggtgggaattgccaggaccccaaggttggagattttttttttccacccttgttgggatggagtaaaataccacctaggcaaatttaaaaatggggatgagaatcacactccctgtctcgcgggttcatttatatccaagaaagtactgaaataaataaccttatttaatatttacatttcaaacatttttttcttaagttgattttaccggtaaaaccgttcgatattggtttttgagagaatactggatcaactaaatgtaattttattttattttcctttattctatctcttcttcaacttcttcttacttattactccatctaatcttaaatataagatagaaaaaaatacattatactaattaagaaagttaattaattacatttaattacatcaattttaataaaaatatttttttcaacttatcatttattagaactttgtatcaagaataaaaaaagtcattaaaactaacatctcaattaaatgaaggatattttagaaataataacattaaataagataataagataaagttagttaaaaaaatatatatttaaaaggaaaaaaatattcttatatttaagagcataagtaacattgtaacattttatgagtacttggattaatactataaataatttgttatactgttgcagtaaatgacgggaaatttaaatcgtctactagtaatatctttcgtttcgtgttttgaacacaattccaattaatttcttctttaaccactgtttcgtaacagttcacgccacgcataaatttcttatttaagtcaaattgtttgttctttaatatgttatggagcaatcaaaactcgtttaattaatcatacactagtttcttcctctatcaagaaagataaacagctacattgggcaatgttaattaattattctttgaaaaatttagtcaaggagttggtcgaacacacgtcatcactaaaaaagtttaaattcatgcatgatattcaattattgttgccagcactctctctttaattggtgaatgtaagcgtatccatgtaaattcttaatatagatttatgcctctcagggagttgtgtcgatcttattctaataatgttttaaaaaccattaaactaataccaatatgataccatatataagctaggttatggtcttttttttggtgaaaaacttagttatggtctaattgctgatgataaaaaagttatggtctaatttgttcgatctcatttttaaaacactagtcttttttcagctaattttcgtatcatggcacggactccagtggttaagtatgggaatttgtgtagggtacacaattttttttttactattgaattaatctttgataaattggacttcccatagtgtatcattcctccttcaggtctctttcatgtaccccaatgctatcttgcacgttgtcatcagaagcgatttttgacggttcctccattgtgaccacagccagtcaccacccgccaccgtcatttccctccaatcacaacgactattgccacaagcaccaccatcacccaccaagcctcctccattcattctcccttttttcaccaaaccccttatgcatttcaacgaataagaaatttgaacaatatatcaagaaattcaaatctggattatcgcacaacatagtaaaaacccatatttgaaacacaagctcaacatagaaaaaatccaaatcatgaattcgaatatgacgaaaaatgacatacaacataacaaaaacccagatttgaattaacatacaacataaaaaatgctccaaacatttggatcttaatcaaactttttaataattgaaatgctctaggcgagtgcgacggtgacgacctcggtgatatgcgtggtgttgtcgactttgctcgcaaacctcagagtgccacacacaggtgtgatcttgttgaagtgaatcagggaggagttgaatcgcaaaacggggagggaacaagcacactggatctctgtgcggtagagcttgcggaggggaagcgaaaaaggcagcagaatcaacttaggcttttgtacacaatgacttaatgcaaaaccctcaaattggtgtcgttcgtgtgcttcggattgatgaacacgatctccactttcccaaatgatggaattgaggaaggcattagtgcagtgtgggaagagtgatgacataaactcgaagttcagagaagaagagtgatggtcggaagggtttgtatgaagggtgatggaattggggaaatgttgttgcagtaggcattaatgagggcgaagggaggtggtgagtggagagggacagcggcggagggatcagaaggaggggagatcgagaagaatatggaagaggacgagggaatgagaaagagatgagatggtatatttgtgcgggaaatgcaccataataatttgagtaagattaatttaagggttaaaaaaaattgtacatcatatacaacttctcgtacttgaccattgtaacataacatgtgccttgtatcataaaaaattaagaataattatctttcaaaattttacttcaatgttattcgaaaaaaaaaaaactgttttaaataatttataagataaaatatgttttaactttttagtccctcaattttcaatcaaagtaatctttgttcctacttcccatactttaaaaataacgattgtgattttcgtaattttttataattggtggatttcacttgtctttatgaaacttaggatacttggttgaaggatataaaactcacaagttatataaaaaaaaacattgtttttaaagtaatttttttagtaatcagtataattagcatctctaattacgatcctaagatttttctatataggaaagaaaataggatgggtccaaaaatgttttgcctctacataggtgttacaaattcaagctatacaaaattaggagttgtaattaagtgagaaaaataacataacagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcaactttatttctaattggtattttgaaaataactggtttattctgaagactagtgattgttgtttataactttcccttttccaaaaattgatgatctagattttcaaaaacttgtttgttaatgcaaatcagaaagatggaaatagatatttgggtaaatggttacttttgatctaaaaatgtaaagtgataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagttgtaattaagtgagaaaaataacataacagatttgaattgtgctttttaaaattttatttctatctacaaacctttttgagtccactctggtgctcagaatgctctaatgtcttagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttacttttgatctaaaaatgtaaagtgataattaataaattagtctataaaagaataaaattaagttctgatttagttctttgaatatataaaaattgtaacacttatattttatcatataatttaatattaaattagtctttgaactttacaatttaatgacaaataaatttttaacaattacaacttaatatccaatagttattaaatattatgacttaataactaaatggtcccataaaacttaatgatagaacataattatcatactttttatacatttatgaattaaattaatttttttctttcagaaattaaattattatcaccttacactttttagaatgaaattgaccatttatcataaatattttatcctagttcgcccataatttggacagnattataaaagtaaaaaaaaatttatatataataatttataattaaataattgtgtaaaaaaacctttagattgttaatatgtatattacttataaatgcaaaatagagaagtaattaagcctctctatttataaatgcctatataattcatgcgttttcagaaataacaatatataattaacaatttattcatgcaaaatatatagagaggctaattaagcgaatgaattccaaagattaaaaaaaatgagatgcacatgcttgaacatcagtaaactcttcaccattttattttataagatgtttttgtgatatatgatttaaaaataataaattccaccacaataatattaataatctttaggcatattctttatatggaccttgtgcaccttaaatccaactattttttagtaaaaaataatatgcacattttctttagaaaataggcgaattttggggtggagaagttatcaagtgatccatgggtgaaacactaatattggcccttagatttattattaaaatactgcaatggtttagattaaaaataaatattcttttaataaataaaaagaaaaaagaaaatgataattttatttttatcttctttatgtcatcccaaccccaacatcggggaagctcccaccgaaaattggcaagtgttatttgataattttttttgcttatgataccatgtgggtcctgtagatcgttaattttattcaccctctccatcagtcttcttttcttgacacagcctttgaaaagctatcaaggagaaaattctatttcaattaaatgcttgagatccaatgacgagtcattgcaccccattctgtttttgtaacaatttcatcataatcaaacctgcaaccaagagtttctgaaagccccaacttgaagtgcctcaatcagaatcccttcctcccttggttaatgaacgtttgcacgagctatacgaacgaacatggaggggtcgtgatctcaaagtggaggacgtgagtcacgtacgttaaagcatacctcacttttattgatggcttcctttaaataatgattatatatttagataaaaaagagatgagactgagtactttacgtaaatatataatagattacgttgataaaaattcgtgtatattaatttcttcctattttttcctttgacatgtgcttgaaataccgagggacgccatagttgtagttacttgcctgcagctcctacttacaattatagcaactctatagttggatctattgaaacacatacgcttttaaggagaaaaaaactggccaatgtaaattaatgtaacattaatggagttcttttttatatttttctgaaatatataatttcgcctaatatttaataataataaaaaaatatataatatctaaaaaatatctggtactttcttcatttatttattaatttcaaatattattaatcagaaagactaatctaattaatcatttgatttagaattaatacaaaggattgtctaacaagtttttttatggatactggctaaaaattaaaaattaaaaaataaataaaattattgaaggaattgatattttttaattaactttttaattagtgccatataactacacttgttaattaaaaaaaaaacttttattcaaaatacgtatagttactgtgtgtaatgtgctttaaccaatcttatggtttccaaattgatcagcagttgatcatttgtaaactataaatttagcactataataatgatattgcttaggccgtacatttatccctcgttcaatgatggattctcaatttcaattaaatactaacagcaacatgcaacatcctacgtgagtcccaagagtaaaaaattaaactaatccgtggtgataatgatttctcactcattatattcataataattattacgcaacagtacgcttgaaaatttttctttaaattttttgtcaagaccaacaaaaatatagataagtaaggtttaccaaatcacgaaaggacaagggcacaagaggggataatataccttggcacattattaattattgatataaaactcttttccggtgcttgttataagacatgattctcctttatgggtcaatcaagaaatgcttaatatcttgtaatattttatagttgtagatcgctgaggtatgtccgtataataatgtaatgctaggttggacgtcgtcatccatgaaataatataaaaatacgcctaattctttgaaaagattcttatgcagtttaattaatatatcttgaaatgtcaactctcatgcaaacgtgaggacaaaaccaactctattctcttaaatttcttaatctctattgatataggctctcctattttcccttcctctccacgtaatcttgtctctgccaaacccttttctttaattcttcgaatatctgtcatcactgtatgtttctctctctctatcacactctcactgtgatcgagcactgggcttgaaatgtacatatatatatatatatatatatatatatatatatatatgcacatgccacgcaaaacgagctttggagtttggcgccatctagcaaaacctaatttctcggctgattccaacgttgtcccaatctacaggtcctctttgtccttttgggacaaaaacaacccaaagtgggaaaatgaccaaaatttgtgcccttatgatcagcacatcttatgggagagacatgttttctttgtttggtttcggattttagaccctgccatccctcattttttttcatgtaccaaacttcagacctgcctccctcgattacttgtgcattgaatttggtgagtaattaatagtataatgtatttttcttagttttttttatctcactttattaccgaagattaatttttttgaaatgtagaggttattgaaatgactttaattgtaactctcattacaaaatatataacattttttatatatgataccaagaatcaaacatttatcgataatatgtttgaggacctcacttatctgtcaactatatgttaaactttgttgccttacaaaacgtaacaacatattttttaaaataatttttctattaattgaaatttattgaaaaatatatatgaagagtgtctcagttaaaatgatttttctattaatataacaacatactttctaatgaattttacttgtgatttctatacttttattaataaatctcagttaataataaagagtgtctcaagaaaataatgtatgtatgtataaaaaatggagcacgtgatatataataggagcaatcaatacaacattgaaacaattacttgatcgggtccaaatatactgacaaatagtatttgcactttttttaaaaaaataatatatatattctttttatttttaattataagattcttttaactaattcatgtgtcttaagaaaaatttttaatttagttaattacattaaacctatcaattatttgtattatcatttcaaaattattattttcttatatgtctatctaattaattatttctcatcaatgtttggagaaaaaataattaaataaaaatatgtaaaaaataataattaatacaactaaaaattagaaaaaaagatcttataaaaatggataaataatttttttaaaaatcttataattaattaaggacagtatatattataagtgtataataagataattaatatgacgaaaaagaaaagaaaaaatataatgttataaaaaaggttaacatagcatactctctttatttttgtgtgtatgcctcatgtgtgtatatatgtacgtattatatattattaattacttgtcagaggatagataaaccagaattcgcaatgtcactttttagtttttgagttgtacgtgatgacgggttgtgatcacctgaaagttagagcaattttcatcatttaacaaaaaacctggattaggaaaattggtgttaatagtaataatatctggggttgacaaagacatgactaagttaaaccgcatatatggttgcggtattcaacaaattaaaagagttgggtgcattagaagtcaataaagttgatataaatttcaacgtcccctcccagcttctagattcctttagaagaaagcccgattgtcaaatattttgctaacaaatcctctttttcctacagattctcttaacagaagtaaattactatattggttaaaaagtgagatcttaatggttaaaatactcggctattgctatgttcagttacagtattaatttattttgattataatataatgcttggactttggactttaatttggacttccttatttcaatattgagtaaattgagaaatacctatattgtcttttcctctccatttccatgaatggaagtcttcaaagttagagtcaagattccagtcatatagctcatgcatgcacttaattagaaaagtaaattacaattgtctattatgaaatcatgaaatgcatatttagccaccagttaccgttgaaaatgcctcaaaaactaaattatacatgtcgtttatttatatttttgcacatttcccaccaaaattgactatatatttttaaaaccacacacccctattatattacagccttatattaattaaggttgtccaatccctaatattctacaaagcataccaaaaataagacgtcactgttaaacatacagatcaaagaagtcagtggaaacatatggtatattattaaaagaagagatattttaaaaatatagtatatgagagaagcgactgagaaaatgcacacattattacgacagaaaaacagtggtattgaaatgggaacaaagtcttagtttaggtgggaagaaaatgaaaggttgattatagaatggggtccacaacatacatgcacctatattaagaatatggagctagcatggtcaattaaaacgaacagtattaatattattcatatatcacattttctaaactcatattttacaattttgtacacgtgaaaaaagagataaataaacattcccctcctttctattttttttttcactcataaaagtgaggtataaaataaaattacaaaaaataaagagcaaatatcataattaacatcaaagtgcatgagtccctagcacaggtcaaacaattaagataatcacgagctagctagttagagagtagagacagacagagaggtagattgatttttacaactgtcaagaggggacgaagagaaaaaagggttagaggagaaaagggtaggaattaagtacaaaagggaccagcaacatctgtatccattatgtaggtttattacaatttaaggagaacaagtagcctgtccgaatattgttgattctcaattttttttttctttctttctttcttttcctttcgtaccataaaagcctctctaatatcttaaacttatgactctaattcttctgctgaatgatatgccaaagacatcccaaaactaagaccatatatcctctctctctctctctctctctctctctctctctttccccttccaagcatatcaaagaacacagcatcatccaagactaaatccagcacaatctgtccatgagttatgttctttaaagttttataacaataaggccacgaaggttctccataggtgactaagtgaagagagatatggttggatatatatatgcagtgttgcatctatgatcaataggcttggaaaagaaagaaaagaggcacatcatcgtgaataggctcattggaagagaaagaatagaggaacacatcatcagcgtgaatggttggtactttagggaaaaaggtgaaacactcaaaatcaaagtattttttctttatttttttaattttgttgatttcttggacaaatcatcaacgataccagttcaaacaattcaccgttttcatgggttttgtccccgtctcctttttgtggtgtgtactttggatcatgaatactattcttttctctttgatttcttatgattacatataaaatgatttctcttcgatattacttcccgaaaacacttgaaatttattcatacacaacctattgaggattaatttcttaatcaattcctaagttttctcatccaaagaaaaattttaagcaccggatacgttcttctgaaccgcatttccctacccgagatgtgttatgttcatggtaatgaactgactttgttttttaatatatctttcataggtttgcggccggcaaagcaattaaccctttttcttcatcatacatctttttctaatatcaagagaaagaaccataattaaaattgagatacaagtgtgtaagcgcaccttgttcttgtcctgaaagcccattttacacaagatatcataaagcatttgtacagataaaatgacaagaaaattgattataaaatgttagttaacgctgaatgaaaattttctctctctctctctctctctctctctccatctctctcttccgctatatcctagttttcttgcttattcactacctacgatttacacatgaatatatatgcgtgtgagttcaagaacatgatcatgtgagtgtgtttattttgtaaatctcccgaaccctttacaagccttttgaaatttattatttcagtgattaaattgaaacaatatatttcttgttatatttccggagtaggaaatggcatgacctaaactaaagtaaagcgtttgttcatacaatttccatctttttagtagtaatgaatttcctcgtctaccacttgagttaattcctttccacttaaatacatagatctgagtacttaacacatccctcacaaattttattcacatcttctcggtagagaagttggttgcacttttatactataattcttcaatttgacctactactgctctttgtgccataacttctcactattcattgcttagtaattttctttggtacaatttcttgtaatctagctagtgactattactttaccattgaattttaaagcttcgtaattgttgtagagaaacgacagcctgttctcacaaattcttctttaaataactattcccttatattgtttattttgccaactttgatctgcacatttaaatttatattaatgtcgtgtttgtttcagacatgaaatgccatttataatttgtacacattgataaagaattgaagttggaggtgatcctgatcgagcaacaacaaataaatatgtcagatgaatataagaggaatgaacatgctgatgatgactcttcaatgggatcatcccagaaatgctcatcctttgatttgaatgaagaagctagtagtgaagataacaatgacaacgatgatgagggatgcgaggaagcaaaggaagaaggtacttcaactaataaaagtagcagcataacaaaggaaggaagtaatgaacggagaggtggcgtgagacaatatgttagatcaaagatgcctcggcttcggtggacacctgaacttcatctatcctttgtgcatgctgttgaaaggcttggaggtcaagaaagtaagtgagacatggattaaagaaatacttactatatacaatgagaaaatatgctatgcactcatttcttcataaattatcatgtataataaatttattaatttttataataattatgatatcaataataattttatagaatattaatataaaattattttatgtatgtctattaaattcatataatattggtaatgggctcaaggtcaagaccagtagagttcattgttttttattttattttattgatgtattgatcataaagtttgtctttatttagccttttaatatgatattactagagttttgtgttccatttacagtacccttgtattctctcttaagaaattttagttagtaaaaaaagcctattatttgccctaaaatgtttggctgaaatctttgcatctattggtgcaggagcaacacccaaattggtgcttcagctaatgaatgtgagaggcctcagcattgctcatgtcaagagtcacttgcaggtagcaacaaaattgcgggtttgatattgtattttttccccttgaaacttaaatattgatgttttattgcaataaataaattcattgttatgcaattttccttcagatgtatcgaagcaagaaactcgacgaggctgggcaaggtgagaactattttaaatcttgcaaagcgttctaaagcaaatgaatccttttttgtgtacaataagataggaatacaacttaattagtatgatcctttgatatatatcttatatattttgtaagatatagtttcctctcctataatgccggatgcaaagttcacaactcacattgaagatgttataataacacccaagatatagagaaaggaaggttgattagcttagaataacaataagaatgacaagtgttatacttaaagaggcaagtaattaacttcttttcattaatatctagctttttttcataatataatttaattataagaaacaatgttttttaaaaatgctttttttactgcttttaagaagtttaataaaactattcaaaggaaaccaatcaaatggagtgattttaagtaatgtttggccaacttatttttgggtctctcttttttcttaaaaagagaagttgaatcaaacaaaattttaagaaaaaaaatagctttttaatgaagaaaaatataaataataagtaactttcatgcttgaaaattcatataattattaaacatttttttcttcaaattaaaaaatttatttttaacttcaactttaaagtaactttaaactctagagataatccatcaatggtgtcttagtattgtgctttcatctaatagcattgatcattgtaatgtaaccagttgagagaggaaagaaaaattaagctggacggttgctggtttagtatttcgtggtttaaccataatgattgttactctagaacattatttaattaagattaatcatggtcattttgattttgtttctataacagactggattaaaatttggtcctagtcttggtcttgagtctctgccaagagggggtcatggctgtcttttttctcatttcatttcagttatttgtatatagatccatagaatgttttgtattgttaatcttagtcacgttgtagttataggtcttatcactatgggttcggtatcttttgtactcagctcgttctcaatcaagtcttattataaaaaaaaataggaggtaattaaacggtaagactccagcggggcgtttggtatgcatgagaattactagaatcatgaattctgaatctcatactttctgattataaataaaatttgtttgattaattattaaaaattattagataatttttttaagaattaaagaagttattttaattatttatcatattatataatttaatgaagaataatatgatatttttattttaataaaaaaaattaaacccaaaaaaaaacaagattttcacctttcacatgaaaagttttagtggataactgattataaaacatttctagaaaacattcttttccaagaatgttatttttttaaaaaatacatactaaaaatgataaactaaaatttctaacctatgattcccagcaaattagaagcttttcttctaagagaaggacataattaaggttgggattacttgattttacctgtcatttttactatatattcatccatattcactttgcagtattaggtcaaacatacaaatcaacccatgaacttggtcgtatttctcatgtagcccatcaatccatgaatcctagtcaacattttaagatgggaaatggaggaattattctagcaagtgattacaacgaccacagttatttgcagggtctcatgcatccctcctccctatcacattcacattcaaaagccatcgattcaaggtaaccatgcatgcacattttaattgattttattccctatattttccatggttttgcaatctaattaatacatatttgcaaaatatatacctatctatcattaggcaccaacaatggtacttcaataatcatcaaccttttagaagaccaagttactttagcaacgaagttatctcctcaacagccttacaaacgcaaggaagatcaatatcttcaaacaaaattaaactaaaggatgccaccagcattgcacccatgagaccaagccagtttcttgaagagaaaaagtggcctcccttagatattatgaacaaccatcactggaagaaaaggttacctgccaatattacttctaatgctgtgtcacaacctgttgtacatcaatttggcaccactgcagcatctctgcttagaccaggtgagttaaactttggaaacaacacaagaatcaaggagcatctatcaaactccgacgagcatcgcaactattccaacagtttaaagctagaatttgagcctccatttcggattaaggtaattaagacttaagaaactaaaatatttgtatgttctttttttttggcttaaatatattttggtgcttgaaaatatgccattttttcatataaattagatttatttttagtctttatatttaataaaatgaaactattacattttcaatccttttcaagaattaaaagcatattttttttatactttttaaaataaaaaaataaataaaaactagacacttagaaaaattaaaattactgagagaataatttatgtgtaatttaaaaaaatccatcactaacatataataaaaaagaaatttttcattactaaatttgatcactaattcattgatttttagtagtgagatatattaaaaaaccttcatattcgcatgagtactattaatgtattgaacttttttttttttttttacctttttcactattaatagaatttttatttattttttaatcaaatgcagtcgaatcaagaaaaattgcagaaagagaagcaatgggtgcctgatttgcgactgagtttaagtcagagagatggcaacaatgatggcaagactgatcattgcagagaaacccaagaaatcaacacgaaactttcactttcatagaatttataaccatgtcaatgtataatgcaaataccacaacccaaccattcatatagtctgagtaaagatatatagatactaaaacaaattaagttacacaattatatgtcgctacaacgctaaattatgggcttgccagtacatagggtttatcctcacaccaaaaataataataataattaaatcggatttgaatgtaaaatgaatgtggtggtcgtgattacgagtgagttttcaacagagagattttgtgtgtgctagtatttggtttgataaggcacaaagtaaaataaaagagagcgaaggaaaataacacatatttcatcatgttctggcgctaaccttttgtgtaagtacatccaatggatacgtagttcagcaacactgagagtatggctatcaggccttactgcaagagctccattagtacttctgcacctacagagaagatttatgttggaaaatgcatggatttagtagctatgtgttagaaaagaaattgagttgcacacacaagttgagttttatgatgagcgtggattttttacttactagtgattgtgtttttggtttgttgaatatcactagttgtgtagttaaagttaagttttgaagcagctatataaaagagtacttgaattgtttattctctctgtcacactctctataccaaagtatagaagaacaagtgaatgtgaatccctctctcactttctattccaaaatcgatcatccaagaattcagttgaattttgtttaagaactgtatctgctgatcaggatgcgcggtgctccccccccccaaaaaaaaatgttttagaatttatatgtatatttatttcgtttttaaaataatactcaatattttggtagataaaaaatattttttcttagttataaattctatagcacagtaactgttcatgcaacagagaaacctagggaatcttttaattcagatagagattgaagaaacctcaacgaattttattgactcttttaacaaaatgggttaattcacaaaattaattactaaagtaggtgttttattaaactatttatctgttatggatgatttttgctatataagatgcaagaggtgttgtcctgatatgtatcaagattataattagtttttagttttccttttatttctagaaacgtttttcttattgttttattcttttctgttataatctcacacagctaatggtgtgatgcagtagtgtgcttggttaatgagagtttgtcacatatgcttttttatttcctgctctctctctggtatatatgaggagcatttcttgttttcttcaagggtgatgaatatacaaaagcatttcagctaatatggtatcagagcccaaacgtggcactgaaatggaagtgccattagggagattaacaaagaaaccaacaattggagatgaagagagaaagcaattgagatcacaacaaacatgatgtgtggcacctgtatctaatatccacgaggaggaagaaaatgcagatgactcaccggacacatgtgctacagaggagacagaagcacaatcaactggggatgactcaatggaaggacaagaagagcgaaacgtggcagttggatgtattgaggttgtactttggacaggagaaacaggattggagtgatgaagtaatgccaacagctgtgaaacctgatctgggctgaggttggagtttgggccaattggggcagtatggggaaaatgcccatcagataaaactgagcccgtcgaattttggcccagtttggggctactgcctcctactttcccttttgcgcgtcccttgaagccaggtgggtatccatggaggcggaagcatttgtcaacagtgtgaccagtcattgagcaatgagtacaaaacggacgacgaccctttcctggcaactgagcagcattcacaatcgggagagaatggacacccaaatgcatgtttctttgacgttcttcctggagcacaagagagaaaacttttccaagggatggcaaaggatccatgagcaagatctgtgcccgggttgaagaaaaggaatcgttaagtcccatcaaaaacaggatggagcgctcttgctcacgaaagaggttccagtctttcagtccaccacaacggcaggaaggcagtggctcaaattccttcaactcatcccaaagtatcttcaatcgtgtataatatgagttgacatctagagcaccttgagtgagtgtggtaatttgagatttcaattgaaaaatccgaggaccatttccttgttgaaatcactctttgagatcaacccaaatccctgctgcagtgggtatgtagaggagactatcagcgatttcgcgtgagatggaattgagcaaccaggaagtcaccatgttgttgcatcgaatccaaaaagaatggagtaagtcttcggaatctggggaaggaagggaaccatcaacgaactgcaatttgttctttgcagtgagagccgtggacatagctctattccaggtgtggtaatttgttccagtaagatggtgagtaacaagcacaatatagtacccaggtgtgtttcttggttatccacctgggtacaaagcttataaaattctagatgtcacaacaaataaggttttcatttcaagggatgttgtttttcatgaaaatgagtttcccttcaaacatctgcctccacatactaatgagatatttgctgattctgttttacctactcaagtcccttcttcaaatcccttagttgataaggattccagtttcccctcccagccacttgaaattcgaagagtgtctgatagggttgtcaaaccacctacatatttgaaggactatcattgttatactgtgaattcttctacacagcatcctctagagcatattctctgcaattctaagctatcctcttcatatgctgcttttattggctcggttaatttacatcctaaaccttcttccttctatgaagctgtcaaagttccttcctggcagcaggcaatgcaattagaaattgatgctttagaaacaaatgggacatggtctctggttccccttccctctggcaaacgagccattggttctaaatggatctacaaggttaagttgcatgctgatggtaccttagaacgttataaggctcgtctcgtggctcaaggttttaatcaacaagaaggcattgatttctttgatacattctcaacagtagctaaaataacttcagtgcgtttactacttgctttagcctccttgaatggctggtctcttactcacattgacataaacaatgcttttcttcatggtgagttggatgaagaagtcttcatggttccacctctcggttatctccatcagggggagcctcttccacccaacatagtttgtaaattgcacaagtccttatgtggtctcaaacaagcttcgagacaatggtttcacaagttttcacaagttttgattgctggtggccttgaacaatctgtagcagattcttccttttttgtaaaaaggaaaagagactgttttctggccattttagtatatgtggatgatattatagtggctggaaataatgatactgaagtgcaacaactaaaaggttacttgaacaatcattttaagttgaaggatctaggtaatttgaagtactttcttggtatagaaatagcacgctctcttaaagggatttccatttgtcaaagaggatatgcattgcagattttgaaggatgctagtttaactggatgcaaagcaaaaactactccaatggaggtcaacataaagctgtcacaagaagaaggtgaattattagatgatcctctaccctatagaaggttgattggacgcctactttatttaactattacaagaccagatttatcatatgcagtgaataggctcagccaatttttagctcatcccagaaaacctcatttaaatgttgtccacaggcttctgcaatatgtaaaaggaacggttgggcaaggcattttttatcctagtactgggcaattaaaattgaaagcatattcagattcagattggggagcatgtaaggatactagaagatctattactggtttttgcatcttcctaggggattcattgataagttggaagtcaaagaagcaaccaacagtagccagatcttcagccgaagcagagtatagagcaatggctaatgttacatgtgagctcatttggttaaggtctctctcgattaattttggcatattacatcaggaagcagcattgattttttgtgacaataaagcagctttacacattgcggaaaattcagttttccatgagaggacaaagcacatagagatagattgccatctagttagagaaaaggtgttgaaaggagaagtgaaggtgttgcatgtttcttctcaaatgcaattggcagacttattaaccaagccattgtttcctggccagtttacaacattgctcaacaagatgggagtgttaaatatacactctccatcttgagggggagtatcaagattataattagtttttagtttttcttttatttctagaaacgtttttcttattgttttattcttttctgttataacctcacacagctaatggtgtgatgcagtagtgtgcttggttagtgagagtttgttacatatgcctttttctttcctgctctctctctggtatatatgaggagcatttcttgttttcttcgagggtgatgaatatacaaaagcatttcagctaataatatgcaccatctttgttaggtatttagtgttgctcgagtgaatgttaaattactaattttaataactaattctcttgtcacatttttacttaattttctcattcaaattgacactaaatacggatgactaacacttattaaggtggtgctttttaacacaagacaaacaaaatatataagatatatacttgacaaaacatgacaggtaattagttgtgtaaaacacctacaaaataactcattttgatgattaaaaaaaaagtcaattttattacacatgacttgacatgcatgtgtagtgggtatcacgtctatctatgctacatgtcatcttgccttttgcaaagggaagtggtacatatgggttagtcttctcttctactagagatttccaataactgaagaggatttctacttgtgtgtatgatgttgctctaacgtgtgtagatgggatggtgcttttatttttgttatcatgttatagatacaaattatttattgattatgttgatgattgttaaaaaaatttattggccacttttaattttttctaataattaatttttgctagaaaattgttggaagtagaaacaaaaagaaagttacttcgtgaaaaatgataaacataagaaaagggggcaaaactatttataggaaattagggtattaattagaggaattttaaaataatattgaattatcatgattgttgcacaaaaccttgaggcagttacaataactccctcgaagattgaaaaattaaaagcccactcagagttcactacatgttttattgaagatgaaaaaaatgaagatagtaaacttcgaatgagaatgtgaaaaaaatgatgtcacataatgttcaatatacatagtcacttagatggaattattattaacttgagcgccaaaatacattttaagcatctactaatttttcgtatcatcttagtcacatcaaaacattgacaaatcccaacaaaacttgattcttggtctatcaagcacatcagagtcaacacttttcaaagtcttattctaagtcaacaatccatgtcgaagacatcaactggccacctcaaaccattccccacatccatctcgagtttggttccttttaaagttttcggcaagagagagaaagactcaaagattttgtgtgctcttaccagaaatttccagtattgaagaggattttattcatccatctaagacaaatggacatacttaagaagttgcagtcaatgtatttgtcagagaaaacttgaaaattgtgtgcttcagttttcatagcatttaaataatgtagaacaagtattttggataaggtattattaatcagtgtgtttaaaatattgatcaaaaaataaaataaaataatatttattgtgtaaatcataaaagaactaaaaaatcataaacaaaataattttcaatctttttgattaataagccgtcaagactgtgatcaatgagatgtactttgccctgttcacgtgctaggtttactagaaggatcatgaagagctcatatgaagcttatttttttaaccttagaaaagttagttatgacatttctatagtattttttttttctttttgtaacttattataataatcaagcttatgaataaattcccattgaataagtgctattgcaccctaaatcggaaattagtttgattttcatacttggactgttggacataaatttatgaaagtgaaagaaaaagacagacaaaaatctcaagaataatttatgtctgtaataatgtatataaaaagaagaaacaattatgcatgaataacagtaattactaatgtcgtttatatatacattcatatgtataaaatgtcgatacttaaagattagctgcatatgatgaaacagaaggttcctttcccttgattagcaagctgtcaggaagtaccaacaaggtgaaaaggcaaacaatagtagtgcatatgcacttctctgggggtagcttctgtaattttcaatccaccgaaagtaccactagtccaaagaagcttcattgtttttattgatcaccaaaaattatattgattcctctctgtaaaatactgatatgatgtcaagaatcattgaatcaagattaagaagtcaacaaatggaaacaaaatccaatagaaaataataacataagatatgagggtgtataaaaaaacaaaaatctaacctatgctgtcatgccaaaaaccaatagaaggagaactaaatcccataagcctgaaaaaaaataaaggacatgaaaagcttggaccataacatgatatacacgccagaattctatctctatgatttcatatgctgagatttatacacgagtagttcctgtagagaaaagttaaatgtgagtttttatcggttttgtgacttaaccattgggggaagactaaaaataaaaaatgaaaggctaaagggattaataaggttaccttagaacaggttatatgatcatgattcaaattcgaagatttcacttttgtttcccacttagtatagcttgatgctctactaaaaccctgccttttagcctgggaatgtgtaccttgatttgaacgtgggaatgaattcttagaagaaactagaggcagggcacgacaaagccaggattcagaaggtgactttggcaatggtggtggggcaagaggatgcagaacatattcattgccaacttttcctgaatcatcaaccactacaatttgctgcttgttgatctctgcatctttgtcaaatgaacttggcacaagttgcaaggacatcgacttttgattaatttcttgatcggctgccaatctttcagctttatcttctttggccatgagatgtaacatgctagacaaagttggagaattggcatccacaggattcaacacttgggaatccaaattctcctccaaagcttctaggtgcttcatatctcgaaaataatctagtagggaatttctgtcttttcctaccactgttgtgttacctaaagaacgcgaactagagcatgatgattttattgtacttgcagtatctatgtacaatgtcttttcaatagtaaggctcccgaagctatagcttttttttgcttcttgtgatagcacctcttgaatacttgaatgccctctactcgggaatttcaatttgccagaatgattattatcatcttgtttggaatcaccaagcaactttgctccaggaaagggaggttgaggtttacttcgaaaaggagacacgccagcagaaacagctcttgaacgacgaaagggagagagcctacctagctgcttcaattcacctgagtaggtatacctgcttgattcactagtccattttttaattacatcctgcttgtctggtgatgcagctctagagcttgattttctcttattaataacatcccaagcctgcagcaaaaattcatgactctggtaaaaatgagttcaagtcatgattggtgaaagtgttaatatacagaaggagggtaagggtgggaaatgggaatggatcttccaatgttgaattttattgtacttataatgtgacattgtgtcaatctctcttcatggggggtattaaatagagaaatagatacaaattttgtgaatattaatgaagagagaaataggtacaaaattttcacatagaaatgtcatgaagggtacaattgactatagaagggtgcaatgcaagaatagaaagtaagagttatgtagttgttaccttctttatagatggagctggtctatgcgagcgactatgagaacttttatcaggttttccaacctcataggcagaatacaagggaaactgattccccattttcgtcccaggcattgaatttaataagcacaatgaatttctaacacataagcggggaaataatccgcaaactttagctgaattatttgcataatcattagtttcatcgtcactttcctcctcttcttcttcctcctctcgacattgaccagtatatggtacaatgtcagcgatatgtctactaacaaatgacttcttttgttcaggaaccaatttgataaattccctaggttgttctgtcagaacagtttgctttctagaagaagcatattgaggaggctgtatagtcatagcctttgctgcagttaaaaacctgctcatcatgaaatcatgagcttgtttatcagtagaagaggctccacacatatccgcatccacattatctaagccactcacaccactcacactacagttcatagacaatggctctgtaggtgacagtgtttcaagtgcatcagaataaacatcaccatcatcatcatagtcatcattctcttccaccttttttattttctcatctttacgttctttgtcacaatctattttctcacttaaagaatttgatatgcttgggggcctaaagttatttgcaacattaggttccttttccaatgattgtttggcaacatttgtggattttccaggggggggagttggggtaattgaagcctttgtaggaggttgaggttctgatccatcataatcctttgaccttccagggatatgctcccaattgaaagacactgcgacaggttctgttacctgatccaaaatggaatctgatttgtagtgtggaagtgtttgtggcttctctaatatctttctatttgcttcagttaaggatggtgatgtaccaaaagagcgcctcaccgacataagaggagcatcaatgttcaatttcctttcattcatcatgttccacaccaactcaactgaactcttctatgttgcactctcaataataagttcaagaatcaagggaatatcatatgctactaatttcagcacaaaaaggatgtggtataagaatccttctattcaatcaagaaaatctgaaaagagggtgcaggaaccagatcattacattttaaattacaatttaaacagcagattctctgtttcaaatttcaattcaaccgacttgaaccaagatcagagaagtacaataatgcaaccagagagcaaaattttaaaccaaaatgaactcatgataacaggatattgatgactgaaataactttccgttttctccaccattaaccaaagaaaaagagaaattctgtaatggtctattgagattgtggaacgggaaaaaaaggtatgcactttagttataaaagttttgacatttgttgcttaggaaaccaaatattcaagcctgggatgatcggattcctataaaaacctattttcctcttctcaataagccaattatacaaatatttaaccatttcaagtcttgctatcaaaaaaacaacaacagaggtaactacgtacaattaataaattaaacagataaagcaagagaactttcatgaatcatcatatatagcagctaacaagcttaacttaaggtcccactagagtcaacatcaacatcaatggtaatgaggaaaaagatcaaacaaacctatttaataacaggatgaaacatgggacgtggtcatcccaggcatttgcagttcaagccaaattgaatagtgtctggggtaggtgtgtttttttttttttttttcatggtcatgtagcattaagaatgcgaattggccagataaaactcaaaaaatgggatagaatagaatcatcaaataagtagtgagtgaacatcactgggtgagagagttcagtcccatgagagatgaatgaaacacgtcacaaggaagtggttggtaagttgcaaaatggaatgaatgagtaagaataaaggaaagcaaagatagagacagaaaggttcggtatttcgtcttcttttgctttatgcctactttcggattttacatgtgtctgacgaagacaacaggatggactaaatattccactccaatgctattagtcggtacactttttttcactgtgatgaggtgccgttgcaaccacgcgcttgctttttctactgatctactatttaatttttattttgtattagtgaggagaaagagagtgaaaaaagatagaagagagaaataaacattaaggagaagaatcccggccctttaagcaaattggattttcttttctgccacaatgagagaaaacaaatatgattaatttggagttggatcaaaaataaataaaatttcatcaaaaattattttcctcaaatgaattcgaatattagtcaaacaattcaaccttaattttaacatattaattactgtttacaattatttagttaaataaaattattttaaaaattaatgagtatatatgtatgtagataattttaaatttcaaatatatcttaaatttaatttattagcatttttaaatattttgctgtttttcttcatctttatttaccaatttgaattgtaaaaattaagtttattatgtattttaattatgtatatactatctcacttcaaaaaaatgaatttataataacaaattccagcacaattgacatataattgagtcctctaaaaaaattgtcaaattgactttgttaaatatgtttattagagtttgaatcttggttttatacataaaactagaattcattaggtaatgatataaagattattattgagtaattactgtttaacataaattatgaatatacaactacattaaaatatttaaaataatttttttattcataataatcatatctaattcaatcatgatcacttataaaataatattgatagttttagtcgataaaagtaaaatacttttcaattgtaaatgatataaatttttaaaattttacacttaaaattattttcccaataaaaggataaaaatatttgtaatttctttaaaaatttattattttaataattaattcaaaatattacactattttgatgaaaaaagccaacttctcattcactggtttggcagaggtaatgcacgtcctcagtcctgcggagaaacgccagtattacatctttctcgtctttttctgcactataatttgcaaaagaacacccatggaccatggacaatgtcaataactattaaatttcagtataaattgttatgaattaccgttaacgtacgcttaagtttttagctaaaagtttataaataattttatattaacgcattctttcgaaatttacttcttatttaaaatagagaattcaaacttgaattcacttaatagtaaaaattcaatacaataactagatatataaaaaaattaactctgcgaaattcaaatttttacttaaatgttcataagtactgtaaatttatatgggacaattatcaccattacaaaaatatcgttttttttttatcattttggtataaaaaaaatagcgttgggggacctctcgagtgggaagatggcatgagactcgtgcgaataaaattacatataaataaattctagtggtatatgacaagaatgaataacacgtacttactccactcacaaatttggattggaccacctaaaaacaaaaaattaaattataattttacttttttataatttttaatatgtaatttggttctcctgatttttatcatgatttttgtctctctattttaaaatttttaaaatttaatccaattctcaattttccaaatatttttttcttttactttggtccaattaaaccctattaatctaaaatattcacttaatatatcatttaaaataatttaattaattaaaatataaaatgaaagaaataaatgtatgcataattaaagattgaacgaaaattgtaatttttttaaaatagaaaaaacaaaatcacatagaaaaacaggaaaatcaaaactacagattaaaattataaaagaatcaaaactaaaatttaaccaaagaaaaatgagatatattatgaacacattctttagcgttagtgttgggacacattttctttaattaatcaaaatttattgaaactatgaaataaaaatcagagaatggttaaataacatgtgatttattttacaaacttttgtaatttttaataaaatatgtctaaaagaatgtgtgtcggagtatatttttaacattttcgcaagagaaacaaaaaaaaggcataaaaaataggaaacgaattaaacgtgagtattcgatcaatactagttcacctaacagctaggtggcaggtgaagcaacttcatcacggactcaatatatatgtcacgcagcttcacaagaacggcataaccattaaccaggttactgatttctgtgaatgatgactttccaaatgaccaagttatttattgttttcttgctccttgtttccttcacatgtagtctctcccttgctatgtccagtgaccagttggagaagttttcttgggaggatgaagaagtgtttcaagtgtggcagaaggagcataagcgtgaatatggcaacccagaggagaaggcaaagaggttccagatattccaaaggaatttgaggtatatcaatgagatgaatgcgaagaggaagtcaccgacgcagcatcgcttgggtctgaacaagtttgctgatatgagtcctgaggagtttgcggaaacctacttgaaagaaatagagataccctcctccaacttggagagtaggacgaagaagctgcagaagcgtgatgatgatgatgactgtgataatcttcctgattctgtagattggaggaacaagggagctgtcactcaagttagagaccaaggaaaatgccgtaagattttattttattttccatatacgtgcatctcaacaataaactttttgatgtctcaaatttgtgttaaaaaaataatctctttattttcaagtaagtgacaaaatgagttgtgttgttcactgtagccggctacatatgatatgattttctaacttagaattaaaaaacatttttcaaaaaacatataattttttattctcaaaattaattaattcatacactataaatattttgcgaaacaactaaaagcaaagtcattggtttacatagatttttgttttttttttttacttcttcaaaaagatgcgaatagtaaaatagtttcattatacaacattaacgaaatatacatatatatatatatatgcacgaattttttggactgatttaacatgttattttgttagaaagccattgggctttcagtgtcaccggggccatcgaaggaataaacaaaatagttactgggaatcttatcaccctatctgtacaacaactcgtggattgtgaccctgctagcaatggctgtgctggaggcttttacttcaatgcatttggttacgtacgttatagataatggtggcattgacacagaagctcattatccttacatagcccaaaacggtacttgcaaggtctgggttaacacttttttcctagcttagtttttgtattttcaaattttaaaaaataaataaataaattggaacaataaatttagacattgtttttgtcttcttaatttaaggttttctttttctttttcttgaaggcaaatgcaaacaaggttgttagtatcgataaccttctagttgtggttggaccagaagaagctctcttgtgccgtgttagcaaacagcctgttagtgtgagcatagatgcaactggccttcaattttacgcgggtgtaagtatctttatttattgacaagtggttaattgaatatgaataatgcctagagattaaaggttattcaaaattgaaaactttgggtatgttccatgtgtatgctaattgtgtaaattattgatttctcataatcacagggagtctatggtggtgagaactgctcaaagaattcaacaaaagcaactcttgtttgtttaatcgtgggttatggttcggcgggtggcgaagactattggattgtgaagaactcgtggggaaaagactggggagaggaaggttacctcttaataaaaaggaatgttagcgatgagtggccttatggtgtatgtgccatcaatgctgcgcctggttttccaatcaaagaggttgcctcatctttggctttatagtgaattagactatggagtactatccatccttttgaaacctataggtttctctaagcacaccaacattgtagtcttgtcttggatctgggcatattactacttaagtacttgtcctttctccaaaaatgataagtttatgaactactagtgcgttttttaattcgggttaaggtgctttaatataataatggatggtggtagttctaccagttggctttggttaatttatttcttggagcatattcataactggtttatgacttgtaagcaaatatttcgttagtaaaaatgttaagcacaaggtatatatgtacaactcaaaacgtcaatatatataatttgtatattgtaacacgctaagaaaattgaaacaaaatatgcatgtctttgttaaaggaaaaaaaacccaacctaaaacatatgccttctcaaattctgttatttcctattctattctattttgatcaccaaataagtcctgcaagttatcattgacaatataagtaggtggagcaacaatagtgggaaaaaaccgaatactaagtggttcatggaattcaagtaaggtgaaaatttgttttatgtaactggaatatgcattcctattaatggcgaataccttaggataagcattgctattaactgaaaaatatctaatgatttaagttaatataaattgttcataataaatagcttaggataagaatcttctattacatcaatcattgggttgttgcagaattataagacctcactttattcacatgattgagaatgatttatttaataaaagaatcaatatatatttgaatcttattgtatacaaaattttattggatcaatgacaattacatgttacaaatgagattagtctctaatccaataaattaaggggcacccatggtatctaatctaagaaaaaaatatatgttagtctcatagattgtattctaatataattgaatagataaaaaaattgtacaattcattcaaaatactggtaaattcaattcgttaaagtgcatagttttgaacaaaataaaattatttaaaaaaatctccgttataatttcattcttttattgctacaattcccaaacatcttctatccattccatgaaaaggaaataggctcaaccctaagagtgtgatttggtttttatacgtactaatcttcgtctcctctcaggaattaagatggaagaaaaaatgtaagaagggcttgatgttcttgaagttgttactttctgtcttgatgaaaccaggtttagaggttgctctatgaacaaaaataataataagcttaacattgttaaagagtgatattcatagttacgtttaagttttacgaattgtctcgttgaacattttattctccttttatattatatatcatactcttctttttttgtcttgatcttatttatataaatttattcttctacatgtagtcctattacgagataaatttgttcaaacacttgtctccactgagtctattatattgttcagccctttttaatttccatgttacattggggatttatgcgtagatttgtccttttgagcgtgtcagcagtgcactattgcttctgatttatttgaatgatatttttttcaaaattcaaattcatctgtttgatttagtctgtgatttgtgtttttaaaattgaactaaattatacacttatattactttagggttagtgttatgtattttatgttgtgtcacttgaatttcatagtattttgtaagtgttatatatataaattttttataatgtttatcgttttctttttttgaatatatttaatctaaaatggatgaaagtttggtaaatttttattatagaaagtttgacatattaataagtttcatagattgttattagtaaatttttaatgtaaattaatttaaaagatgaaaataaagtatataaattttaatgaaataatattttaataaaaattacaaaaattaaatcaaatcataaaatattgatttggtttgattataattttattttaaataaaaattgaatcaaactaaatcatgtatgttttataagtctggatgactttttgatgaataagtgaaccaaattgactcacaaatgtccctacttttgtcacaagccagctgcaaggtcgatctcctttatcatcagattatatagtggccttttctttgttgagtaagaagaaatttagctggttgtgaaaaaaattataattcttgcaatttatttagtttgttttaatatttttttattgtaggctcaaaacgcttgagggaaggacgattggatccttgagctagggaccaatcatattttaatagagtgccttcctttgataaccttaggtcgtggggaaatgatctattaaggttttctaaggacttcttagtatgttagacttagaggttcaagttctaacgccaattgtttggaaagatccaaatatgatggacggagcagacagctcaggcagcgacaatggctgttcctagtgaatttatgagacttgtattcaccggtgcaaacatttcaatgtcaaagtcaaatcgtgtaatatgtgaattgaataatgaggttcaaatgtatatctgacatgaaatgtcttacatagtgatagatggagagaaaattggttaagtggttactcttgaccatgggtcgtcatagtcattttttattattattatggaaagattgaaaaacaactaaaaacacggataaagtactttaaaaatacaacaaccaacaaatcagccaacaacaaaaggaaaatctctaaaaaaatgtttggatgtgaacactttttaaaatattcaattagactatttatgtaaacgtagtttccttgttaccaacacaaggtcgagggattaattaggaatgaggagttaaaaatgtactatattgcttacatcacctaacgaccacgaatatttaaatacagggtgctttcttctatatttgaagaatgagcagcatttctgccttttatgtatgctacattaattcaacgagtgatttcggtcccccaattccacagaaaattaaatgaaattccgttatctgaagatgtttgtcaatttaagactaatgcatagtgggaatgggattagtggtcgtgacttgtgagcattcatatcaactagcaaaggccactgccagcacctggtttcaactttcaaatctcaatcaagccaacagctgcaaacgaaatacacatatcccctcttatcagtaagtcagtgtttagatgaatattgataaaattaattttgaatgaaattgattttaaaatcatgtgatttatgtttgtatgttttattatagaataaaattaacagtaaaattcaagtataaatttttaattcaataaaaaattattcaaaattatttgaaccctaaatcaattctaaccaaatatattaaaatatatccaaaattaattataaacttataatcaattcttaatcaaaccaaacacacaggtcccgcttgccgcaaagtaactacgagtttcatacatctacgtagaatatatactacattcactaaagtactacaatcaattaaaaattcaaaacttttaagttttaatgaagactttatcatttcttaattattattttaaaatttaactaagtttttaatctctaattttttttaaaattatgtatttagtttctaaatttttacttaattgatcaaggtcttttcactattttttattaaagttattagtctctaaattattatttgactgataaatgtctttcaaattttttcattaatatttttaatccttacacttttaaaaaaaattaatttttaatccttaaaatctcattaactaaataagaataatagattcgaactttaattaatttttttaatttattatagttaatatattctcgtcctaaaatcactctattgacgactttacttgttgattatctctggttcacgatatgaatccgctaaggaaccattcgtcaatcaacatgcacctggaattgattcttggcttctactaatattcatttgttaatgcaaataccagtttatcagaaccacgtgagcaagaaatagtaggctaaagcctaaaggggaatatgttctttaatttgttattttctacccttaatacatggtttgtgttcctttttactaacactaaaatcatagctaatcacgtacaactgacaattttcacgtgatagaagaaaaattatggttacaagagttccatcttataaaaaaaacagtattttatcaactaattgtgccatgagcacaactttaatcattcttctatttctttattaattgactaaataatgttgtcagatatcacatggtttcggtgctctagaactgtttttttttaatacgaggcacacttccgatttgttaataaaagagtactcctacatcttatcttttgattgttccaactaatatggtaaaatattctcgagaactgagcaaatcatttttagtagtaggcttacttttctcttcatgaaattctattttgtttgcttaatagatttaatatttgttcaatttagagtttgatataagtataactattttgatatagttgaatttaagttactgaatgtgattgaaatatatctaaattaataaatatatttggtaaatcaggctttccagactcgtcaggagagagtgttaaattgttgaattgggctaaatttttttcttgctgcaaatttttattgttcaaacttagtcttatgttaggctaacgggttaactacaaataaacaaaaaataagattaaataattttataaaatcttaaaatatatatagatttaaaaaaattaaaatggttaattgaatgattgggtaaattaaactcaacttttccggtctaaattttaggagctaagcctatcccaataggccaattgagccaggatagatagacttaatttttttaagcgttttttttttttttgtgctgattaaaggggcaaacgcccgaaaaacaataaaaacggaacagttacaccaagcattgaaactcagcttggatagtagatactacaaacaagggtacctccacaaaggaaactaaaccatgatttaaggacagaccatacttagcaaaatggtcagccaccttaatacaatctctaaacacatgaacaaattgaacactcataagaggcacaatgcttgccttaatcgcatccacaatacacttatcactaacatgaagatcctgcctttaaccatacgaatagcatcttctgaatttgagtggatttccaaggatcaaaatctttttaaacctacttcttcttgtttttattataagcaataaaaccatttatttattttttctcaaatataagcaaaacttaactaatcttgcattatttaataagattatctttaaaatgttattcatttaatagagtcaaagacatttgttatgtttgatattaagttttaaggaaaggttgtttagaaaaaaaatatttttgttttagaattaatataatttaatgaaatttaataattcttaataagtgtgaaataaattttttaacttatcaagagggagtaaattttatcttaattaagtattgtttagatcaatcataaactcgatctcatattaccaattaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattataagcaataaaaccatttatttattttttctcaaatataagcaaaacttaactaattttgtattatttaacaagattatctttaaaatgttattcatttaatagggtcaaagacatttgttatgtttgatattaagttttaaggaaaggtagtttagaaagaaaaaaaatatttttgttttagaattaatataaattaatgaaattaaccaattcttaataagtgtgaaataaatttttttacttatcgagagagtaaattttatcttaattaagtattgtttaaatcaatcataaactcgatctcatattaccaattagatgacaatctaaattttgtttatactattaatatatttttatactaattttgatattttatgaatttactcaatataagactaaacaatagacaaaaattacttatgtacatgtgttctactattctaaaatgtaaacatatatttcattaaaaaaatagacatcttcatttttttgttaaaaaacagtaaataagttattcattaagagtgaaaaatgtatttttatacttatatcaaatcataaattgtggtatataggaaatttattgatttttatattaattaattagttatagtaacattatattttaattgttatataggtcacatttttatagaatttgactgtcaaaacgcaaaatgaggaatctttaatacaagatgtttaagcacttctcgtattccttcagtttaaactggcctttttttagataactggcattaaattataattaatattataaattgataaataaattcttttgatttgttagtagttatccttttgtttaattttgttaacgttagttttcacagttaattttatcataaaaaatattattacattgaaaatgtaaaagtataacatttctatttttttctattttaattattaaaatcaatcttaaaaattactatgacttttttttgactgaaaaattacaaagacgtaatgtttaaataataataataataatgatcataataatgtattggcatagatttggtaatgtaattatggagaaagcatgctactttataattgcacttgtcacacttgtgcttaagtgtttttcaataatttttttttgccttttgctgttaaataatagtaataataataaaattaagtattattttcaatattttctaaacttatgagtgattgtgtgtatgtttggttttcattgaaaaaataatatcatggtaaaaataattttatcaaagtgcattaaaacatgtagtaaaagtaaaagggtttaaggaaaaagcatggaataaagacaaaatcctcaatttcttatcctttgcttaacacactaatccattccatcaaatgattcaaatgcactcaatctcttttttcaattttcataccattttcccagttactttccttacctaaccctgctactccttttcatacatataaataatcacaattttgtccattcttccaactacacccacaaccaggggcaaagtccagagcttttaaggcgctgtgcttggattcaaacatgcccagtttcatttttttattctaaaatctaatgtttgaggtaaatcctcctctttgtgtctgattcgggtgaaacatcctattggtggtaatccaagtttcattttttacctttttgtttgcgtgtgtttatgtttttgtaacaatatctgaaggttatgtctcaaaacatgaaaaggggttgttgaaagatatgtattttccgccttttatttgatcgcattgttcatcctctgcaaataacagaaggttttttgtttttttttgttgggtttatcactgtgggaggaatgcgttatgtattgtcaggagtttcttttccaaatttcttcaggttttgaaatactgagtggaagaatttgatattggggttatggatcaggcaaagagcaaaggcagtgttgagattttggattatgtcgatgaaagggtggatgaggatttgaaccaattggttgaaggaaatgcaattgatgcaggaggtggacatagcttggatgaaggagttaatgtaagtggggaagatgggactccaaaagagatgtacaatgatcttcgattgaatagggagctaaaggaggggtctcaagaagctaatgatcagaacatgggtgacccacaagaaattaatgatacattgtatagggttgatcaaggaactagttatagttcaagaaatttggttagtggggaagtacctgagacttgtgttgcaatagatccttgtactcaggttgagtgtgtcaatggagataataggaaattggaagcaaaacctaatgaatcagagttgaacaaggtgtccatgaaagtgacaaatggggtgtctgagacagataaaaattcatgtgtgattgatataaaccgtcacagctgtgatgggtttagtgagaatttggaaggtgaaatgatttgtaggatttgccatctggcctctgggcaaccattggaagcagcagatgttggcactgcaagtagtgctactactcatacagatttgattcagctcggttgtgcatgtaaagatgagctagggattgtgcatagtcattgtgctgaggcatggttcaagcttaaaggaaacaggtaactgttgcttttgctaatacttgtttatttctagtatgtagatcaacattttgtttagtttttcttgaagttttttgttaatgcctgcaacattgaacatgccctgaggatttctatgtttctgattaattagtattagtatttagtaatcctatttggcacaatttcagaatttctgaaaaagaaatcgtcttgggctatacattattttaataatttgtaacatttatttcttttctgataatagtcggttgtttttttcttttgcttaataggtagattttttcttttatttcttgtcttatgaaatctttgaagttctgctgcatacttgtactgttatgcatatagcattagcgttactattgtcattattaaatttcgttatcatcaataggaaattctaaattacaattttattgctattattatcttatcaatattaaactcataactccaaaatatttgtaaatttgaggatgaacttttgaaattgtcttcattgtttatcattagtcagttggttaatgtatgcagctcatagctgtttcaatttttactggtacatctctaactggagaactgacatcattgttatgtgccgtgacacatggagtttctattggtaatatacttaaatgaggggtgagctgggcaaatgcatccagaccaatgttgtcaagattgcgagtatgatcgtatactcgtgcgatcttgcgattttcagaggggtcgactaggttactcggagggaggatcgttgactttgcggatcgtttggggatcgagcgtttgcttgcgaggtggatggatcgacgatccgttttgatcccaattgggtttcgttttcggtctcgttctcgcgagagttttgagaggaggtgccgttgttttggagctcttcggagagggcagtggcgagaggctggaggagcttctcaagctcgtcgatgagagcgaggacggaaggtttggagcggagaacctcttcctgctccttgttcagaggcttgctctgggtgatggcctcttccatggtgagggtgcagttcagcttcttgcggagggcgcggaggttgcacctccttctgttggtctttgcttaaatcggagttgtacggtggtgtcgcctcggagaaggattgtttgcggcggagaaagagataaagagtgggatttggtttggtttggtttggtgtgagtgtgtttggagagtgtagtatgggtttgggagagtttataatgagtttggggttttgattttgtgtgtttagaatattgggaggaaaccgagtgggccgaacttgttggttttgtggacatcttcgattggcttccttggatccaattagatatggacacagcaatcttctgtgccagctggatataacggatggatatgttgagttgaatcatcctacacagaatcataccatgcaaatcaaagagaataaggatattattattggatttcgttgtgatgctaaaaatggaatttgatttgattgtcatttaagtatttcaatttcaattgtttatgaaaataatttcctggttagctaaattaatgagttcaaggaatggcagtatttttttgttactatctcagagtgaaaaaatgataaaccagtattgtttttcttgtctatgttattttttatgtatatgcatgtatataaatataattttacatatacacgtaactcttacgatcctcgagttacgatcttttacccccccttccgatccccttccgatcctcgagtttgacaacattggtancccccccccccccttccgatcctattacgatcctcgagtttgacaacattgattcagcacctggttggttttccttctgaggtattagcaaatggcctggtttctagtggttgtgaactgaggttgattgacatccaaaattccaaataatgacatcaagcattagtttagtgtatagtatatgaatatatgaaataatatgagaagctctctctcaacttgcttcaatctagagctttgtcagagtctcagtcgctgttttcaatattgtttacatcaaaattcgaattacgatatgatgtttcatatgtatgctaaattcaaatttttgtggttcacaattatactgttcctggtgaagaatggtctgggaataccattttttttggtcatttgaattctaatttgtttttgaaattactctaatgtatgtacttttttcatcttaggacccttaagaatttgaaagctgttgggtgggggtgggggtgggggaagctctatcagtacttttttttccattcacgtcctatgtacttgtgggttattctttttgtaatttgatatcctttcttgtttattaagctgagagagaagagtttacatgtgtttttttttaaacatttacatggttataagaatgttatcaccaagcatggtcaatcttgtttcacattcaaactaggttttagttcaataatcctgaggttccttttgttctatgttaccttccatgatcacaggttgtgtgaaatatgtggtgagactgcaaaaaatgtttcagatgttacggataatggatttattgaagagtggaacgatactagattcatggacagtgataatacctcatccagaaggtttggtggatgctggcgtggacaaccattttgtaacttcttaatggcatgcctggtaatagcttttgttctaccatggttcttccgggtaaatatgttctaatggaggagtcaaacactattcttcccttcaaatctttattcctgcctaaatgatgagtgcatcatttgctccttgcatattgtttttctgaaggggtggtaatgcttaaccatgaccaacttcacatttctcagggtatgtagttccctgaagccttgaaatttggttgtaaagaaacttaccaacttggcaagttatggccaaattgtttcccaattgcattcttttaattggagtgcgtgtggtttactgagatatgtataacagcgggatccattttataaaggagtaaagcaaagaagataatttactgtttcccaaaggcataaatgttatgttagaactttgaaacagtacattattcgctgtaaaacaatcaaacaaaaggagcctctccttgattttccttctccctttttcgttttttcacttttttctaatctctgttgacttgtctgctagtatgaagttcaaagaatccaatgtcatttgttgtcatcaatgtgtttctattgccttctttttgtttgcaaatgttctagcttctaacctaagtaaaattggtcttctcaaaagctatatgctccgaacgcttgccttaattttgaagctacatatacgaggggcaaaatttaatcgtgataaaaaaatttaacctatggattaaatacacatgtaaacttgttggggatatgacatacacataatacatacatataatattaagaaaataaaataaaatcctagtggggcaaattatattcagaaggttatgtataggtttgtcactgatttgatcatattcctcattttactaaaagattatgtttggtgaaatatctttgaatataattttaattttagtcatgttttataaaatacagatacgggcatttagttatccaatctgaaaaggcacaggcatcgaagttaatattacccatgcatataatataggtttgggtacgggaatttttttaaaattgagagtatggagacgaatgcttcgagttcaactgtaatcctttaaaaaaattcacaagaaatcaccatatgtacgtagtgagtcattaataaatataattaattaatataaagcttattgtatcaatccgttgtagtctagttggttaggatactcggctctcacccgagcgacccgggttcaagtcccggcaacggaagtgtttttttcaattttgcaaacaataatgtcgtaacattattaacataagtacacgtgggaactgagaagatcagaacgaaaacgaggcataatttttttctttttcgtgtaggtaggtaactaggtatgtatagtgggatcaatgttgtttgaagacgaagacagaggccaacgctgaccatgtcgaaaagtatagcaacgttgagcacttatccaacatatcatagtcataggaacaaatcaaactatgcaaaatctccgaattgtttcatcttcttcagacaatctaggacaacatgtctgtcaccttcgaatttggacctttcttgcggtagcagtgttggtgtctctgcggctttgtctgagaccacccataacaacgtaaccgtggacaaaaatgcaaagatttgcaagttctgcgaaatgggtgatctgagaaacgccatggaattgctctcaaggtcacaaaaatctgaacttgagttgaatacttactgttctttgttgcagctctgtgctcagcttaagtctttggaagatggaaagaggtttcattccattatcacttccaatggcatggcaattgatgaggttttgggggcaaaactagtctttatgtatgtgaattgtggtgatttgattaaagggagacgaatatttgatgggatcctcaatgataaggttttcctctgaaatcttttgatgtctgaatatgtgaagattggtaattacagggaaagtgtgggtctttttgagaaattgcagaagttgggaattagaggggattcttatacatttacttgtatcttgacgtgttttgctgcattggcaaaggtgagggagtgtaaaagggttcatgagtatgttttaaaactgggttttggttcttataatgatgtcgttaactctctaattgcagcttattttaaatctggtgaagctgagagtgcacgtattttttttttgatgaattgagtgacagagatgttgtttcctggaattccatgattagtgggtgtgttatgaatgggttttccagaaatggacttgagtttttcatccagatgctgaatttggggtttgatgtggattcggccaccgtggttaacgttcttgtggcttgtgcaaatattggcaaccttacattgggtagaactcttcatgcttatggagtgaaagttggtttcagtggggatgtcatgtttaacaacacattactagacatttattctgaatgtggtaatttaaatggtgcaaatgaagtttttgtgaagatgggtgaaacaactatagtttcttggacttcaatcatagatagctgctcatgttcgataaggtctacatgatgaggctattggattatttgacaatgcaaagcaaaggtcttaggccagatatttatgctgtcacaagtgttgttcatgcttagcaacatcttggataaaggaagggaggtacacaattacatgaaaaagaacaacatggggtcaagtttgcctgtttctaatgctctcatgaatatgtatgcaaaatgtggaagcatggaagaagctaatttaattttctttcaacttccactcaagaatattgtcttatggaatgcaatgattggaggttattcacaaaactcactccccaacgaaactccagagctgtttctggacatgcaaaaacagtcgaagcctgatgacattacaatggcttgtgcaggcttagcagctctggataaaggcagagagatacatgggcacatattgagaaaagggtacttttcagatttacatgtagcctgtgcacttgttgatatgtacgtgaaatgtgggttactagttcttgcatagcaactgtttgatatgattcctaaaaaggatatgattttgtggactgttatgatagctggatatggcatgcatgggtttggaaaggaagcaatatccacatttgaaaagatgaggattgcaggtattgagcctgaagagtcctccttcacttccatcctttatgcttgcactcattctggattactgagagagggatgaaaattctttgattccatgagaagtgaatgcaacacgagcccaagttagaacactatgtgtgtatggtggatctccttatccgctctggaaatctatccaggacgtacaagttcattgaaactatgccaattaaaccagatgctgcaatttgggatgccttgctttctggacgcgggatacatcatgatgtggagctagcagaaaaagtggcagagcatttttgagcttgagccagagaacacaaggtattatgttcttctagcaaatgtctatgcagaggccgaaaagtgggaagaagtgaaaaagttacaaagaaggataagtaaacgtggattgaaaaaggatcaaggctgtagtttgataaaggtccaaggaaagtttaatatctttgttgctggggatacttcacacccccaggccaaaaggatagactcattgctgagaaaattgcgaatgaaaatgaatagggaaggttactctaataagatgaggtgttcattgattaatgcagataataggcagaaggaagtgcttctacgtggacacagtgagaagttacccatggcttttggaatattaaatttgcctccagggaggactgttagagtaaccaagaatctaagagtatgtggggactgtcatgagatggggaagttcatgtccaagacaaccgggagggaaattttgttacgagattcaaaccggtttcaccatttcaaggatggtttatgttcttgcagaggtttctagtaaatcatcgatcggaaaaattcaatagaggggaagttctcccatgtcagtgtatcattcttctcttcgtgagaattgataattgcgtatttcaggatcacagttctcttattgatgtaggacgcattatagattaggatacaacgtcatggccaaaaagtgtatgttgaagtgatagccatagtgtgtagaatcagtgattgaggctaccgtttttgtagttacgtcagaggcaactttatgtcctaacttcgtctgtgaagtgatgttattcatggatgacttatctaaacatctatatttggattggaaaaacattgtagcagagatctataattggggttcagatgtaacattttttctctgaaatagattagtggcaggatgttatttatgatttgtgactgtgagtgatctcagtttgcttttagattccaactttttttttttattatttctgataatgttgaccaatcttgactcttgagaaggggataaaaatgagaatgaccacaaaaatgcttaaaaaatgagaaagtcagcgcagtgtgttgtgtttgtacccattttttgaattaggatgccacgccacatactaaacatgtaacgtgtttgaggtattttagattcaaattgctctccgttaagtatatgattcagctgaaacattacttattcacgtaatcacattcaatttgtttctctaccgttaaaggaatgtgaatcaaataacttcacttctcaaaagtcacaaatgtagtccttcaaaatcattttcatgggttaaaataataatggattatatcattcataagtctttacagtctactaattttaaaacgaaaagtaaagatttatagtcacaaataaaaattctgaagttgaaaccgtgatataatatacataatgtacaaagttatacgacctataaaatttgctttcttgatttttgcatcaagagttacaattatacatgataccatgccatcaaggtatatcattattcaaatattgatttcacccaagcttagccatacaacaataatggtagattgttactttgagcctgaggttctctacatggccatttatcttctcattttccctcaaacgttcttggactgctcaaacttgccaacttaggcttcagtgcaatattttccttgtagtacttcgtatggggctaattaatttgagcattccaaagtaaaccaagctgtaatatatttagctacttaatcagggtatgttggacatctcataccaaaccatccacaataaaatcagcatggacatcataattgtatcatagccagacatccacgaccatgcattattattccctacttaccaaatcatgtgatcaaccatgaccagctcaccgttgttcgtctcctatagatcaagttgtgccaataaataatggaatcactatattaccccatatatatagattagaaccagaaataaattaaatataacttcggcttttttttttctttcccaaatgaaacaatggtcaaacattatttttagggaaattacatagtacaagagatgcaaatagaaaagactataaaaaagtttccatttaaacaatataaactattaaattgaaaaattctttcacaggtttaatttagaagaaatttaaattagcagaaagctaagcctcataagaaacaaatggaatagtaggcactttcctgtgttttctttttggttggaagcacttttcttttaatacaacacaatttgcgaaccctaactttatgcctgagactcatagttcgttcggtggaatggaaagaaaaaaaaagaaaaaatttaaattggaaagaaaataaaaaaaaagaaaaattttaaatttttgtttttagaagtcaagttttcttttcattttccttttattttattttttcttttcaattttttttaatttttatctaccatatttctctcttttaaattaaatacatcaatactaattttataatttccaaaaaataatatttatcaacaaagtaatgtatattacaaaagtgtcctaatgttagaaaatgtattcctaaccctctcaaagtctatttgataaaaaaaaaaaaaattatagtgtgctactcaagtttactagaaattgtattcctaaccctctcaaaagtcaattggataaaaaataataatgaaagtgtggtactaaaggttaatttgagacaaagagcaacgacagtgtacatgtgctcctcaaagtttatttgagagaaaaagagtaatgaaagcgtggtgcaataatcaaaagtgtaattgaggctcgctgggtcagcaaaacggcgtattcaatgagaagtgtgagagaaataagaggttatagcacaagttaatcacatctttctgggtaccacatgatgctttctggataccatatgcatcatccatccccaccacctcttctcctcataaacattaatacacaactaattacaaaagtggcaaagaccatcatgataccttgtatataaatgattgcaccgaacaagaaattgattaaaaatagcaagtgaaacaaaactcgcacattaattttcccctcctgtttctatcgggtgccacattttggcaatctctcatttctttttcaatactcttcctcttcaccttcgaattcgtataataaataaatgaattaaacaaagaaccattttgaataaatgaccaaaattcctatattctaaattcagaaaagcgtaaatcaaatttttcctcagcgacagcacttggagcacagtattaggaaaacaacgagaaagacaatggaagaaagcgctattgccacaccaagaaccaccttgttgggcccatggtgatgctccttcatgtgacgggcactgccaccaccatcatcatcatcttcatcataatcataatccccatcactgccatcatccgcagaattagaacgcttcgaaggtggaggagacaccggcctcccaaacttatcacaaggagcaatctcaagcttcacgataaacttggaagacataacggaacggttataacacaagttcccattcccacccaccttcaacacctccaacttgtcgataaaacttgagttgaaaggcacaaccccgtgaaggaggttgttggcgaggttcaagtgtttgaggttcctcatttcggaaatgaacgtgggaatagtcccgttgagctggttggagctgagatccaagtgaagcaaaccgggtatggcagataacgaatcagggacgttgcccgagaacgaattgaaagccaaggagaggtttttgagggaaatcaagtctccaatggaagagggtatctcacccttgagtgcattggaagagaggtttaaaacttggagattttccaacatggtgatggaggggggtatgttgcctttaaggttgttgaaagagaggtcgaggtaggtgaggttgggggaatggaggtgtttggggagagagccggtgaggtgtgcgtgggagatgattagggtttggagggcggtgaagtgggagaggatgaggtagggtttgatggtgaggtaggacagggtgaggtgggtgaggtttttgaggcgggagagggaggcggcggagaggtgggggaggctgttgatggaggttagggagaggaggtggggagggaagtggatgggggaggagggagtgatggggcagttgaggaggtggagggtggagagggatttgagggctgtggaggagagggagtggtggatggaagtggaacagttggtgagttggagggaggtgaggtgtcggaagggtgtggaggtgtcgcagaggaaggaggtgggttgggagcatgggtctcttggggtggggatgttgagggattggagggctttcagttggtttgggtcgagagggagggatagtgagagggttgtggtggggaggaggaagaggagaatggtgatgaggcagggagggaggggtgatggtatcatggctcaactcaacggtcagaaaggcatgcaggagcaatagtgactagtgagtaggaagaagagtgatcgtagtgagaacagaaggagagggacttcttatatggacatcgtatttaaatgcatgccacctgtatcttaaattaattgatgattttgaaaaaaaaaaaaacttattaaatgtcatttgtaatagatttcacttcttattgtcaaatgtttgaacgtcattgatgaaaattatataggttttaaaaattgagggaaaatgtttataattttcttaaattttaagggaagtttgtgtgtatatatatatatatatatataattctttcaaatctcaaaaaaaatatgtgtaattttaatcttttttataagatatttaattaattttttttcattaaagttagttctaaaataatgtgacaattagaaaaacgtaatctattaatttgttaattttgtttacatggatagttaatttttttaaagataacaattgagtaaattatatgatttagttcttaactatataaccttgtttcaaactaccgattgcattttctagtagattaataacgatttattttcaaaaataaattttgatacatttgcaaattgttgtagtaattgaaattaatttcctaaaaaaatgttgcgtgggtgactgttgtcatgtcaatatcatttgttcatatgatatgttatattacatgtttatgtgaatgtcatgttatatcgcttaacaatttaaattaataataaaaattaaaacaaaataaacgaatttataagaaattaaaattgatcaaaatatattttaggaactaaaaattcatataaaatgagactcaaaaggttcattaaccctattaatctaacttgagctgaggtatttatgtcttccatttcattctttggtacaatggaaggaataatcaatactaatgtttacataaaaaaagtgaaaacttatccgtttaaaatattaatggtaccttacctgggaatgttttcttggggtcagaacttttcaactgaattagaatagtgcgagtgggatccagctcttccatggggttcctcagttccactactcttacattaattttatttcatttagctcgacctttgatggttctctctttaaccaatagccggaccttttattattttactaaattgataaatgataactagtctttattatcacgtcaacaatggtttggttttcagttcgacaacaaaaagaagaacaaaaacggggtaaaaggaagcaatgggggcgtgatgattattatatttcttctctttatcgatctctctccttttcaagattattttggcattttagtttccttgttcttacgttttatattataattaagttctttatttcttctatatattgtaattattatgtttttcttttgatatatcaaaagaaaaaacataataattacaatatattattttaagaaattaaccctttgaaactacgtcaattactgtctgacatccttttatttgaagtttttctgtatcttttatcttcgagcgtgtaacgagtgcatcagccatgaatggcggtgaaaaactttttccataactccatgattaatagagctagagtatgtggttaaggatacgagcacgtgcactttagaaaataaagtatatcaatacgatggctaaaatcatgtgtttagcaaacatgcatgcatgttgagagcaacaggtagcaatgtgactgctaaaattctctaacatgcgtttttgtgtgtacttgtgtcagcccaaaacaatagaactcgagctcatgaatattggactgaaccaacgattgatttggtgaaaagctatccaatggagcaaagaaaaaccaagataagtaataacaactcaatgaaaaatttaacaactttttatagtgtaatctcttgaatgtttgtgcttccatatccgagacattctcttcagatcaatctttctttcatagcccacttatataatgtgacagaattaaccaaaaggtatttaatgtgtcacttacaaaacatctaaattattacaaagaaatagtactagcatatttcaattataaggatttcactttatattgctttaacatgctactccactaagatgtgcacaccgataggcgtagtaattatacaattaagatttcataatgctcatctatatatttaatcagtctgttcgattatatcaaaatcaacttcgctatggccaaatttctattagctcaatctcagttgaaaagttgcaacaaagttttcaaacaacaagctaaaatattattaataatggactaagtctaactcaacttttaaaactaaattaaagaaagaggattatttgtgttttatgaggagtattatactatagttatttttgttatgcacgtgagaaatcttaacatatcaacgtcatgtttaaaattagataactagctagagtgaagtttgtaaaactcaattgggcctaacccttccatgctccatagcacctaataggcccaagggaactatatttgcagccccatccttttctctttaattgcacacccttcaattttttttttatgtaattgttttacaaaaatatccttttaagacattaattttcataatgtaatcatttttttttgacatattacgaaaagtagttttcattttttatgcaaccaaaactagttttcataatataataaaaataactacaatagtgaaaacagtttataaaagtaattaaaactaatttatgttaagccaatcatttaagctattaatcatattaaattaactttgtgagtaagtaaacaatatattgacaaatagacctattattcgattaaaaaatttaagaatttttttttgtgaacactattttttcagccttgagcttagacttaattctttaaaatattgaaatctgttcaacaagttgattctttcaacaaatattattttatacatatagacttgagattgaaccatttttgatcttatgtttaaggaacaaattaatttataagctaatcatatcatactatattaattaagaaattcagttgcaaaacaaatttagctaacgatttttttctctttaataaaaagaaaaataatacttaaaaaatgttaacagataaaatattttttttcacaggaagatataccttttagctagtagggtgttatttttcaataaatgggagaaaatgaaacacgtacgtaaatatgacgtgtaagaactttggacaatacttacctcctgtttaataagttgggaagttcatagcctgaaatttaaaggaaagaataattcatggaaaacccaataagtcaatgagtagcagcagctcatgtctacagttgtctgtgaaattcaagacccattttttctcttcaggataaatgaaatagagcaaaatccttaacatattttaattactcactcaatcttggatgatgtgtacaatccaatctttaaatgattcaaatatatctcatatttttttttcaaacatatattgtattaattcttatcatagataatactttaggatttaggagtaatgcaaaatgccttcaacattttctcaaatggaatattatattcaaaatgtatgcatttatgtttgggttaattatatttttaaatcttaaactattttaaaatttattttttaatttttttaaaaaaatttgatcaatcaatatcttttaatttttcattaaagttttagttcttgtgttgtttattgatgttgtcaaaatgttgatgcgaaatcaatttttttttattatatttttgtgacgattaaaaattatcaaaaatgcttgataaaactttaaaataaatatcaaatagttgccaacaatttttaacggccaaaaattactttttcctgattctcacgagtaataataaaaatcatgaagttcatacaagatcatacagagtccccaaatcaacataaataataaacaaaatcccttgaatcaacaaccttttctcttctcccctcctccaatttcacaattgtaactccttaattctaatttcttttttcgctttgttttccttgaccacgttctttctttccttgaactcgaggaggtgggctctgccattgctttgtttaatacttctacttaaggttaaagcaaaaatgaattaaaagtttttattgtttaagttatgacaaattcataatatatatgtaaaatgtactgcacaaacccttctttttgcaacactcaatatatatcaccaagtctgaaaaacaagtgatacaaatgaagggtttgtttaatacatatatattttgttaatttgtcataacctaaacaataaaaactcttaattcatttttgctttaatctccagaaagagttaaaataaataatggcacaaccctcctcaagttcagggaaagaaaagaacgtggccgaagataaaaataacgcgaaagaagaaattagaattaaggaggagctacaacttggaaacgtaggaatcgtgaaattgggagtgacacagaagaaaagagaaaatgttgttgatttaggaatttttattattatttgttgttgatttgagggttgtgtatgatattcatgattttcttagtatgagaaccaagagaaagtaattccggacagttaaaaattatttgaaattatttgatattcggtttgaaagttatatcaaatattttctaatgatttttaactgttaaaaaataaacaaccataaaatataataaaataataattaaattaacatcacaacatcatttaacaacaatagatgatatggactaaaatcttaacgaaaaaaaaagttaaaaaatcttgacaaatcaaattttatttaaaaacttaaaattaactttaaaaaaaaagttcaaggaataaaaatgtaactaatctttacatttctcagagtataattgtaaagggaaaacaaatacgcaaagcagaggaaagcataggcacatatgacaaataatagatttatttatattacaaattcacaatcccctcgtctgtcaccataaaagaatttgaccataaaacaaaaactgaaccaacaaacaaatgtggtgccatctcgagaaagaaattaaagaagaaattttagaatacatcgatggattggtacgagatgtcgtgctatgagcttctcatcaacctccacggagtgcccttttttgcttggtgaagaggtacgtggcacaatgcccttaggaaatgcactcagaaacaaactgttcttttttggagatgggttcaccttcttgtctaaaacaagctttctggcttttaaacacaagctaagtgaagcatgaacaggaacaacaaagtgttaggacgtgccatattaatgtcaactgcaacgagcaaatgaagcaattgggaaagagagagggaatgactctacgactatgggcattgagggcaagttattatatacttatatttgatgaatataataaataatattattgtgtattaaatacatatattattaatgtatgcatatctgtgtataatatttcataaataataaatgtttattaaatatgacttttcatgcatgtaaaatttataaatatatattaaaattttattattaaataaaatataaataatcaaaatcacacccatgtatgtatttatgtgtagttaacacatacaataatattatattatttgttaattatattaattaaatataatatatatttcatctgttccattataattattgtgtaagaaaaaaattatttcaaaataattgtcattttaatctttaatataacattaattactttttttatacttatgtcccttgtaatattagtaatggaaaaaaatgtataaatgaattaaagataatataaaattaaattttagaaaattactacttttttttatttgttgattaacttttcttgttttcttgttttgtgtaaaataacctaacaagtttattattttgaaacggatggagtagttaatattacatacacattcatatgtatttaatgtattaagtagtattagtgtatttatttaattaacatttaatattggcttgtgtccaatcaagaatttctttgtataaatatttaccatatctttttaaaattagattcttattaaaggaaattaattatatcatattcttatttgaaagaatgaaaataaatctaataaatcatgaacaattttctttttattttactaattgtaaattttctattaattgtgaataaggaagaggtgttggatttttctctaccaaaaagtacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttaatatctcttttaagaattgatcttaaagaacatatattagataatatgttttattttgtttttagttatttaaatagaaatattaaattgttcagtaaagtattatttgattttagtcatgactcatgagtgttagagaatataatggtaatgttgtcatagtgatggaaacagcaaaaaatggactactaactgaatttcaattttttcaatggactgaataatctctatttttcacgttgataaattatatactcaggctaatggttacagattttccattcagctcacatggctacaccgttcaacaaagaactaacaaataataatccttgtataacgtgcacaagctgtggatgaagtcattatcccatgcacccttttggtaagcattcttgttgtgacttaacaatctatggcaatgcaggtctcggcgatggtttcactgtcaactgtattcacaaatggatttatcttgacccaaacaagagaaaagacagaggccaacaacactgaccagagaacaacaatggtcggcgtgcggttttggcgacccatgagacctttgaggaatggatagagatgaaaaatcacccagaaagcaaagaaaactttcccaaaaagggttccccaagactcataccctccattaagtgcatcagagaatccagcaacaacaccaaccatgttaacaatgataagagttgttggaggaatcaagagagtagtccactttactaagtaaagttccccaaactcactgtcctctgcagccttagcagtgacagtgaagttggtgtcaacaccagccaacatcttaagaagtccttggaacacggcaaacagatgggctgaaacacctccaataacccagaactgctcattacgccacaaatcttcgatactaacaccactccatcgcagctcgagcacactggttattataattgagaggaaaagtcctagaaagagaacacttgcaacttttgaaagctgtgtcaaattgtatagaacaacatgatgaaaggcattgatgattagtaaaactgttatagactggtctataagactataactatggttataaataattggtcaaactatttatttggtccatctaattgtctctttcaacttctactccttacatgaataaattgcaagttttagtcattaccgatgcacatataaagttttggtctctattactcaccccagagagcattttttgacagtgtaaaattgttacaaaaatttcttgcggtgataaactgtcacacaaaaactatgcagagaccaaaccttactgttttcttataaaaggactaaaacttaaaatggagacaactatagggatcacgtaaatagtttaacctaaataattttcttttgttttgcttactgtatttcaaaggacaattggtatccattcggattaagctgaattgataacaactctctctttaactatatatcctggaacaaaaagatgaggaaattaccgttggtatgataaattttcctgtgaggaggcaaattgcaggcagagaacagtaagcaatgagaggaagggatgtgaaagggtagacaatggtgtttatataagccattctttgtagccatttgagacggcctccagaaaatccataccagagggggcagtgcctacttaggaaaatttcaattgatccaagggcccatcgaaggacttggtgcaatctatcagacaagttgataggtgcagaccctttgaatgcaggcctcaagggcatgcagtaaattgacttccatcctcgacattgcatcttgaaccccgacaagatatcctcagtgactaaaccataaatccaaccaatctggaaagagaagatgatgttttaattaatcaaaaaagaaattgagttaaaaagtaaagactgtgcatctagaatgagattttaattggtacaagtacattaacaaaaatatcattggaagagagaataggaaacttagaacctgaaggactttgtacaaaaacatttgcattaaaggcaaacaacctcttttccccataaagtcttttcttcatatccacagctaattacatgaatggcctccttgatcagcatcgagggatctgcagattcaggaactcctccattctccattagtgttgattcaatgaaaacagtagacaagccaaaagttttttcaaagctcattttgtgaaataagcattgacctctcatgctcatcataatctgcaagaagaaaagaaaccagaagaatattgcatagaagattctgttatatgcttctctagaactgattgaaaaaagtaactgagcttactgtcaagttccttgagattaaaaatggcggcctcaagttcttccctctttgcatttctttgaaagtctgagacatcgttggtggacttctttgaggggaagcaacagcatgaagatcttggtaagctgggcatagaaggagggctataaccataaagtgcttgtctattgaaaacacatccagtccccacatatactggtccttggatgccatccagtcctttcatgttaacctgaaatgaacaattgaagtccatcaaacagggatgagggttggaaattacagagttgtgtccacaatttttacttcagggttgttaacagttactgcattgcatgcatgcaaatgcagtgtgtatttggtgaaatcattgcatataaggagatgtcgtttttctgtcgactctagataaaatcattgaatcgatgttaacttacatcaaagaaaactgtgttgcaattggcatatcaatcactgcgatcaataccataaaatctctgggggaactgcacataacacacatctctaccaacttctggatccatgagaaaacacattgcttcccgaacggccttgctgttattaacataatgatcacaatcaagattgagaatgaagggagcatttgtgagaactgcagacactctcacctgcataaatccatacaaacatcaagcataataaaatcttaatgaccttatacaaaatattagtgaactatctatacataccagtgcattttcagcaccagctttcttgtgatgttggtaacctggtcttttctctctggaaacataaaccagcctgggaagttcatttccttctatgtcacgggcaccagtgtgtccaagaaaaacctggaaatgggaaacataaattttgcttaaatacaagaacttgtaccaattattgattgctagaactaaactagtcaatcttactaacataaatgttttccattatatgaaaaaggaaacaattttttttcacacagaatgactcagtactttatacagtgttcttttctttatgcctatcattgtcaatactatagttgattacatacagaaataatggatatacctgaatcatgccagggtgatcacgtgagttatttcctggccaaggtgtaccatcttgcatggtccatccttcttctggtgttttctgagccttagctaccatggcattaactcgaactttatactcttcatagtctctctgtgacagaattgaaaggtaaatcaatcatgaagaggttgctctaagatactcaatttgggaaaacaaggtggtgaatactgttggaactattagttaatttagaattggaatatgtccaattgcacaagggtcagaatctgagtagtcaagaggaacaacataatttactacaactgtacaaaaacaatttaaatagaacctgtatgataagtatgaatcagaaacagatgcaaagagatgaaaggatccgagcccaacaatgttgtctccttaagacaatttgttccctccaattgatgccaaaggttaatgaacaattgtctcccaggatagaacggatcacgtctgaagattgatggcacttcaaatcaacagcccaaacgaacaaagacaatgcttgaggaaccacagagttatgtgatatgaaatgcactagtgtctaagcgagactatcagaaaagttaactatcagttttctacttccttcctttctccttccttttttctgactgtctctgtgtctatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccattcctttcgacaaattttcaactaactctctaggaatccctttaattaatggatccgctatgttctctttagacctcacatagtctattgagatgattccattcgagagtagttgtctaacggtatcatgtctacgacgtatatgtctagacatgccgttatacaaaacattcttagccaagcacccccacactttcaagtatttcaaggatgattgctttcatttccatacttcgtatggtatgctttttgtcttcttgtgaggaactctattaataatatagtttgccatcaaaatggcttccctccacaagttctatggtaaaccggacgtgattaacatagcgttcatcatttcttttaatgtccgatttttcctttctgcaatcccatttgattgcggtgcataaggagcagtcctctaatgtataatcccagattctatacagaattcctcgaaggggccatcatattctcccctacgatcgctccttatagccttaattttcttgttaagttgattttcaacttcatttttatattgtctaaaagccacaagtgtttcatccttactattaagtaaataaacataacagtatctactgcaatcatcaataaaagtaataaaatatttcttattactcctagatgatacagatttcatatcacatatatcataaacagaaacactgattaatcacacagatcaaacagaaacactgattaatcacacaaatcaaacagaaacactgattaatcacacagatcaaatagaaacactgattaatcacacagatcaaacataaacattgattaatcacacagattaatcgttcaaagtacagagagtagacannnnnnnnnntaattcacaaagatagaatatactgaacccagattcaaagcaaattgtcttaagattgatggaactattagttaatttagaattggaatatgtccaattgcacaagggtcagaatctgagtagtcaagaggaacaacataatttactacaactgtacaaaaacaatttaaatagaacctgtatgataagtatgaatcagaaacagatgcaaagagatgaaaggatccgagcccaacaatgttgtctccttaagacaatttgttccctccaattgatgccaaaggttaatgaacaattgtctcccaggatagaacggatcacgtctgaagattgatggcacttcaaatcaacagcccaaacgaacaaagacaatgcttgaggaaccacagagttatgtgatatgaaatgcactagtgtctaagcgagactatcagaaaagttaactatcagttttctacttccttccttttttctgactgtctctgtgtctatttatagacaacaaacaaccctggtgaagagttgtcagtaaaccatcgcgactcttggcgatgaaccatcgcgactcttggcaataaaccatcgtaaccgttggttatcggagcggttgggagtagttatttttctaacctttcccaagagcggttataagtagttactattttgaattgttaaccgcctcttattcataactcatagagtttaaacaaaaactccaacaaatactagcaaatcagatacatctaactatcaaaactgttctatcactgaaatcataagtaggaagctttacagacttaccttcattgctctacgctccttcacgaaagaaggttgcaccttgtccttcaggaaatcaatcttctgagagaagtaaaactcaggtgctcttggttcaattgaaaacttcctgcaaaatggcacccacttccttgcaaagtcagcagtctccacaagagattcaaatgtgagcattgcagcaccatcatctgacacataacaggatactttatccactggatagtcaaccgcaaggatagaaagcactgtatttgctgtaatcaatggtggctctttcaaaggatccactgtactgacaaagaaatcaacagctgcaagttcattgggttcaccctctctttcaaacctggcatggtattatagaagtgcgcatcagcatccaaagcaaaggctcagtatcagctcttctaaatattactttattgtatggatttaattttgattaagagtaaaacttccactctccccgaataatatgttaccatatcatttaaagtatttgactcatcaggtaacagttatcaactcgttacagccaaaatcattcgatgatgtgacaacacatgatcatattcatcatgtagaactttttacacgggaagtaattaaggttaacatggaaaaattattttcattagttcatttttataggttgcctttcacaatttctattagggaaagaaatagaaacaaacatttccattctacagtatgatgttttagtgcaaatcatccttaaagcacaaagcaaaacacatccaagtatttcacaactttgtgcatttaccttgcagacagattgtcaataaacgtttgcctattgataggactccatttagggaactgatctagcacccaggaaaatacacaaaccagatctcacagatgatagaagtcaaccaaagaggaaaagcactttcaacagggtttgtaactcgataatggaagaaaagtcccaatattatcaatcgcatgattatcacagttctgtacggtgcaattttggattttgacattggaataactactgaaagtggtgcagcagcagaagcctctgcgggcctgcaaatcatatcaccatgtgaattatagaataaatatattaatttttatgatagattttcaataatgagaaatgtaacaagtcataaatacatgaaatatattcaaattaaatcaattgtctagcaggtgcaaaatcagatggttaataaaaatttgatgaatgatcctcaagcaattaataatatgctcaggtaaaaaaatagatttttaatatgtcaggggcttgagtttgttattgttctctatacagaggaagatttgataaaatatctggtaaaattacaatttcagtaccctgaagtgtaaagacaaaggtttgtgatctcatgtcatcagcttctgacagttgaaatagtaaaaagaatgcctttcattgattcttcgtctcacattagacggatgaaatattgaaatgtttatatttagatttcagcttataactatcagacaacattaccttggaaaatgtatgttttctcacaggatttgtaaattaataactttttgtttttgtctgattccattcatcaaaccaaacatctctaccctatcctcacataaacttatcattagagttatgcacaagtggcatataattctatagcttctcattgttaacctaattaaggaatcaaatttttttgttaaattttaaaaattgctttatgttaaatattacagtttattttccatctccgcaaattgttgtcatttctcattgagcttactgtgtttcttccatctgctgctctggaggaattcaggcctccttttcttccttggatgcagcctttttttcttgttctttttatcctttcccttccagctttccactctatttttccagattgattttccagattcctcatttacttctccagaaaaaaccattttgtaatgatcaatgcttacttctaaagatattgtagtagaaaatattgtctgaagtatcattcacttaccactatcgactgtggacactgtactgacatgtctagcatggagtccaacatcctacaaaattcaaggtgtgattataagtgcaaatgcaaattaacaacgtaagaatattacaaaaatttctgtttttcctcaaaattaaagctatttagtacttgtgcaactaataattcctagtaattatcacctgagagttactgatttcggaaggtgttgtggattgattttcatgaacctttatctcatggaaatcatcatcctcattttcgtgaacctttatctcatggaaatcctcctcctcctcctttcttctctctagaatttacaaaaggaaaaagaaaaagaaaacaaacttatgatgtttcaaaattcattgaacgagaaaataaaccactttttgaaataattttacatacacaatgttacatactttttctttaaaagatttatagataaattaaacaatgttacatacttttgttttcctctttctcacaaattaacactaatactctattactttgtcgaatgattcattaaatgcattagttttaattagcctcccaagatcaccagtctcaaataaccattgcatggagactgaaattgggagcataacaataacgtgagtcacaatccacgtagcaaacagaagcaaattataaattcttagttggaatttagaaataaaatgtagtagacattaaagggttaccttcatagggagtgccacacctcatgcagaccctatggtcctcattaatctcatgctcaaagcaatccttgcaaattgggatattgcattcatgacaagccacaaacacttccccatttgcattaagtcccacttgttccccacaagttttgcagaggggaacactagattgcaccatcttttagttttgcaccacctatcaaagggccaaaatgtcagtatatctctcagtgaccctttgcttctcaatcagtgctcatattggttttatatgaaaaagcataaacccgtatggggggtggagaaagcaattgtgtagcaatgcaatggatttgcatgttggaggtggtggtggtgggttctttttctgaggttggaaagttggtgtcatagtttaagtggcacacaacataagactatctgagtgatgagaagcaaagtctattttttcgttgaagtgtgcaatatatcaatttaatgtgggaagtgtaagggaggcttcagatgacagttgtgttggggtacatcagctgatgaagtgaacaatatgtcaattttggaagtacaaggagtaagtatactatttctaattgattcaatgtttacaaggaaaatattagtgacatactttttaatatcttcttttaaatattgttttcatcaattaaattttattaaaaattctaaattttgtaagttttatgttttgcttaattcaatatttctcttaattttatttttttaataaattttaatcaataaaaaaagaatacattggaaagtgtctcaaaatgaattattctcctactataagggatatctttgacataaaataatttaaattataattctaatcccttaattttttaaattcatgattttggtcccatgatttttagttataatatttggttctttaatttgataaattgatgattttgatcttcctaatagattattaacaaataattttaattaattgagttattaagttaattaaaaattattaaaactttaataaaaatattaatcataatcgtccacaacattgggcttctcagcttttctgcaaactcttcttccacctttaccgttgcatatgactccacatgatggagcacaatattaggattaataatattattaaagcttgttaataattaataattttatttaatttataattaatttaataactctattaatcataattattagttaataatccattagatgaaccaaaattattaatttataaaattaagggatcaaatattataattaaaaattatgagaatcaaaatcatgaatttgaaaaattagggatatcaaaattacaattttctctgtgaaataataaaaactagtttatttttgagcctatgctgcccgatttaattatctctgattttccaattttaaaggaataactttacatcacttggtttgtttgttgccagcaataaatatatttcaattcaatattgctagaacgttaggtcatgccatatatatatacatcgaatacgccatttctcctgcaaatcatgaaaatagaaatgatacgacacattatcctccgaaatattaaatatactaattaatatatttttaatgtgcagtatgattcctaaactaaaaaacgttaattcctatcattctcaataacacgattagatggcatccccatagtttgttatcattttaacactaagatcattataaaattgaagtaaattaaatataattagtgcataaaaactatagatgtaagaatttgtttacttcgacaaatgttcgtttttatttcctattttcatttttaatataaatacattattctattttattttttattaagtaaaaaattatataaaaaaccatgaaaatagtttttttactgttttttttatcaaaacatttaaaattaaaaaattaaagaagatttctataattaagaataaaatcatttttacaaaatcttttacaacacactacattggattcattttcattttggctctgtgtaattcagggtgttataatatcaagtattgataatagtgtatttttaatttgatattaaattattaattcagaatctaaaattgattttgaatatatttttacgtgtttaattttatgttaaagaagaatttattattgattctaaattgaaataactttgaataatttttgcacattagatacaaaattttactcttaacttattttataataaaatactcatacataaaccacatcacttcaaaatcaattttaatcaaaatcaattttatctatccaaacacacttataagagtgagttactttattcagtgttcactaacaattactcgaaaacgatcaacttaaacgtaaaaagaaatacatttgcacgaggactcttagcaagagaagcttcacttctaatttctagcatacattaaacatttacaaataatagctttgacagccaaaaattagaagatagcaagagatatctggaagagcgaggcgagataacatagacgaatggaaaagtgcaagtaaacacacatggcatgaatcacaccatcaccatgtaaatgaataattataggtcatcattgaacagttcctgtaggcaatgaatcagggagagaatcgcaaggcaacctaggcaggtatatctaggctaaaagccttgggccattagcacctttcctgtcaggaacacgatcttcagagcaagtgcaacattacagtttcaaacagtcattttaggttttgtttgctctccaggaatactcattccaagaatcactgtcatctagctttaaactatgttatagtgtagacctttactactttagatgtgtcacacacaacaaggttgtctgtatcagctgaggtggtacacagccaattgacctgccaaataaagagtacaaacgaatgcatcagacatatttggcagaagcagaataattaaccaacatccaaaagttccaattaaattaacttttattacaaaactcacttttcgaggtacttcaatgttcaaatgcaggatattattgttgttgtcgtcgtcacttaacccagcatctgaataacgggaccaattccataccttcaccaacttatcatttcctccagatatcaagaatttccctctttccccaaacaatgaaaatgccctgtgtcacccacgagttaggggacaagtgagtttagtgttacagttgctatattgcagtcacagataatgaattgacttacaggctggaaacagctgcagtgtggccacccaaagtgtaatccaaatgcaacctcttttttccattttgatctgcgtctgtattgctagatgaactaccatcttttgatcttgagtgtgatccttttcgtgaatttgaagagctttttgattttgtagcagccatttctgtttcgatattaatcacatcaattgctccatcaccccttgcaacagcacatattttgtctaatttatctagcatgtcgacttctggaacagctattgcatgaacaaaagcaggattgacacaccggccagcaatgccactactcacatcaaatgtagctgcagcgaagaaagggaaggatcaacagtttagtagttttacttttacatgtttattaaattgagggcgagccctaacatagtgctaaattgtgccttgatgacttgttggtcatgaatttgaatctgaaaacagcctctttacatatgcaaaggtaaggttgcatacaatatctttctctcttactttcgcatagcaaggagcctctgggtaatggggtactttttttttttatcagcaaagataatatatatatatatatatatatatatgagggcgagccctggcacaacggtaaagttgtgtcttggtgacctgttggtcatgggttcgaatccggaaacagcctctttgcatatgcaaggggtaaggctgcgtacaatatccctcccccttacctgcgcatagcgtggagcctccgggcaatggggttacgtggcttttatatatatatatatatatatatatatatatatatatataaatgataaagatgagtacaagtagtactgaaaaaaagaaaaaacaccccagggagccaaccggaactttggcaacctaatacatgatgacaacccgcattaagatgccaaaggtcaacctaaggttaagctcacatgaaggttagaaaaactagacaaaaaactttctagcaaaatccatctctcatctgactagaccaatgatagaaggggatattaaatcctttctccaaattgactaaccaagaccaacaaaaaaataaggcatcctccaacagcttagatccattgaagttttcgttatggatctcaattgtatattactcttatcatttttaagagtatgtatgtttgcataagtaaataaacgaaaatgccaccatgtaaaatatagttgcaagtttcaactgtgaaactataaaaacaaaattagcacaaggatcattaatttacattgcactaagtaccagctgttagttcagttattatctaagctgaggcatgtatgcctcgtgacatgcatacatatatcgaaaacttccaggcttcagtgacaacattttcatgttttggataataactgcttgtgacttgcattctccattgtcaatagtcaccaaccatcattttcatgttttatttcatcggtaaaatatttttaagtggccaaaccttttgtttttatctactgtggaatcatggccaaggatgactatggttgcaaaagctttcgaacataattaaaaacaatcattatcctctaagttctcttttgctgaatgcattcaaaaaaagccgtagagaagtgaggacttaatatcattgcaaatgtcaaattaaaaaaaaaaaaaatcaaagaaggctctaatttagatcattcaagtaatctcatgcaaaacttagcaaaggcaaagtaagaaatttaagaaaaattataccaaaatccactactttgtaggggcgccctttggagaagtcccacaacatgagcatggaatcaagacctccactaatgactggtaaaaaataaaaaataaaatggagtcaactttctatagatatgggtgcaagtttcttgaatactagcatgaaacttagacaaacaaatggagctgttattgtaaaaccttataccacaaggttccaaaatttcatttcaaatagaatcttgtgcttgtacaaattcttttgattgttctatccaactcatatttttgttataactttcctaaatatattttttcatactttaaaaccaccagtagtttacatctattgtgtatgcatgactgttataatgttactattattgggggcacaaattaagttgtttggggtgaaacaatggcacaaaatttatcagaaatggaaatcagaaaattaataacatttagaagggagtccaaatcaaacaaaaagttaatttgccgaagtcaatggttataacacagatatagaaaccctcataagattactactctataaatcagagttgaaacaatctgaactcaagaagaaaatgttgcagtaaccagctatgtcagtttctttcttgatttagcttttttagtaacatttatatatattggaaaagtaaacatatcacccaatatgtgtctgtgcatgagcacatttgcactagctcaatggcttctcgacatatattattcacagtacttcctaggaattccaatttagaaacaaccagttatcataggactaggactagagcatgctcaggtactattgtcaagcagttcagtgtctcatgtgcttaatagagtgagagagttagaatacacagatttttggtctttgaccaaaatatccatacaagcattattatgagactaaagcacctcaggcaatgtcatgagccatgattgagaccctcccaacaatttccttcttcatgattagttagcatgtagagtttgattaaaaaattctgcattcctttccaataagacaatgggtattctaacatacaaggacaactcacatatttactctagacataacagtcatatctttttctcattggaaaccattaattgcactatgatgaggaggagagacagagagattcatatgtgaaaaataagcaagactatatgtaaataccttcccaggttctccaaggaaggaattccacagtgctacatatctacaacactaggttaaggtaaattatcaaaaaatcaaattacttattaatcacaggaaaaaaataataccagaaaaaattgggggaggggggtggaaaataaaatattagtgggttgagataaaacttctgattacataattagcatccatgtagtgaagaagagctaaaaagcaaggatacacttgtatgaccggctcgtagtgttttatacaggcattgctgacgaatgtcaattatctgtaaaagaaattttaattataatgaggaaaatgaaaatgtacgatacttaaccattaacttggcttttcttaaattaaagaaatggtagatttaaaagtgtacactaaacaacgaatagtaaattacattacacaagaaacgacgtcagtttttaaattatcaattacaacacagtatatttccatgttttatggcatgtatcaaatcttttagaataggagataatgacttttatatctctaatgcattacaagtggaaaggatatattcattagagctgataaatgagataatactaaggaaatcagaataagcattgttgtataaatacaaggcataccttcacctcaccattatcatctgctgcagcaagaaatgaggactttgagttgcatacaacctgcaaaaccagacagataattgtattataacagcatttttaaacaaaagaagctcacctaggatagcatcagttgataacttgatattccaacagaatgaagaaatgcaaagcagctataagttcaggaatagttctgtaatctagtttaataatttcaatatcttgtgcaggtgaagaaagccatacactgcaattgttggaaagtcgccttaattgcgatcacccctggcccaacttagttatggcttctttgggctgccttaattgcaaagttgaagggggggtgtttagttccacattgactagagatatggcttaaatagatcttataaggcttgtggggttgagtcaggccctaagccaaaattccaagagcaatcatacttacaattctgttttataccactaaacacaaaacagattccatataaaagtcttgtacaaaaacagttaagatgacaacaaaaatcatacatacgatttctgatctacatctgcatggataatgttaagtacagtcaacaaatttgcttcaatttactttatataacaagaagcagttgggacattcaacaagatctggtaagtgcataacatttatttgaatacaagtcctactatctagcatctaccttgtttatctcttctttgttataattataattctccaatggcttccattgggcggcagccttcagcacacaacataatacacagaggatcagtataatgcaataaattaaggtggagcaagagaataaatcaagaacaacgtatatccatatatcctcaagaagaaaataaatagtgcaataaatgcttaccaatcgcacatcaaaacacttgatttcctttcctgaggagacataaaccatatcttccatccctgattcaaatggcaattatttgtaaaagatgcaagtaaactcatctactggatgtatcgatagaaaatttcattgtagttgggatgtgtttgatttttcaaaaacacttgtcccatgttgatacaaaaaaaggctataacgaacccttccgccatttacatcaaaataacaagtcgaaaaccaatattataataaataaaacagacctgacttgaaacaaagggaggaaactggctccacgctaacatccatcaccagtctcggctcatcagggcatcgcaagtcaaaccagcaaacacgaccatcctgttttgtttcagaatcacaaccaaacagttaaaactataaatttataggagatgaatcctgaaccctagtgattggaaagagataagaagagtatggaaattggagaaggagctgacatcgccggaagtgacgatgagatgagagcgttcacgtgaggcaatgcagcaggttgtgctgtcgtcgtgacccttgagtcttcgatgcttcagcttaagcttcgtcgcatccttctcagccatcgatgatgccgtttcctcgaaacctaaattggttcaggtgtgtgtgtgtgtgtgtgtgagattatataacatgtaatggattaattgattgcacgaaacgcagaccctatttggttgctgcggtgatgattgggaattatggagtcaccgaaccgaacttgctgcggtgaaatgaaatgaaaccgcgcggcaaagcctcactcactcacaccaggtgcccggaattaattctctttgatatgctatttatgtgttcgtcgaatgtcaccactgaacccgactttcgtgacacactatggcccttatttttcaaaaatatttttctcacgccccagagtgttagatcattagattagatgagtctccttaaacatgcttgggagttggaattagatactttgatgttctgttagatttgatttgcttcactttctttcttcttttttcatactatataaaaagtaataaaatagaaaaaaaaatcttaatataatccaagaagacgttaatgacaatgttgaggacttgaggttgttagcaaagacttatttaaaagattataacaaatggttctatccaattacttaaaagattataaacaatcctcgatcagataggaaatgtattattcatatatttccagattaaatattaaattgttttaacaaaatttaaagatcaattatgctttgaaaactttagacatccataatgtaagatataataaatggacttttttatcattagaattatttatttgaattttaaaattaaatttctttttacctgtttcaaattcaaattctctgagattattaaggtcactttgtgagaaatattattcactatgatgtttgatagctcattttagttttatcctcatttatcttttttttctatcagaatcattcaccacatctcctatatccttttccttcctttcattctttatctctattttaactactcaaaattttcttttcataatatatatacttaagagacacacacacacacacacacatatatatatatatatatatatatatatatatatattaaactgataaacataagttagtgccactggatttgagtgacaccgtacaaagagacagcaacactacgttatacttgcggctcttgttctttggtttcttcaacttcttgagcgaacttagtagcgccaatattctgcatcatatctttgcttttgccccacagtagcatgtacaacccgatcatcaccaacatggatcccaccacactataaaattaacaagcacaagcatatattaaactttggtttttaatttacttcttttttccaagaattaatgtgctatagtcctaggtacaagaattaattcaccttccaagatgaagctgctcgtgtaagaaggggatatcaatcatgccggacattatctgaacaagagggctgaatgcagcggtaaagaccggacccctcttctttacgcaccatgacatgcccacatagcacacacttgacccaactatcccctaaaaacatatataatagtatttcactttgttaacatgctttttttttatatatattattggtagaagtcgaaaacaatagtattagaacgtttatcataattcatatatccaactcaattaattgaattagactctttcaacatatattcttaattatattctatttacaaattgtgaacaataatattgtattttttttataaattcttttgcaatttttgttgttgttgagaaatataatttttttctcctagttaaaaaataagtatataataaaaaatattatcttgaaaatataaaatgtatttaatacatcatatattagtataaaagaaataagagaatattagaggatttggaattattcaataataaaatatcatacttttcaaaatcgaccacatgtgtgaacggttcatggtctaactaaattacctaatgaaaaaaataaagaaattaaaacggtgaaaacctgagaaagaagactagtaaaaatcaaccaataatcaatttacaacatattagtaaaaaaaatctgaatacgtacaacatggttttgtttttcttataaaaaaaaatcaacctaattatttttataagccaaaataatttgaaagagtgtacttactgaataaagaacggtgattatttgtatcttatccttgagaacccacgaggacaagttgctgctgccagtggagaaaccaagaatagctgcttgcatggctccaaagaaggtcatgatggctgtgctagaatactggcaaggatatctcttccctatctttgactgtaaaataaaccaaaaagaccaaaaaagggttcccataatcaaagctattacaccaatagtccatttctgtgttgttctagtagtagaagaagcttggtccattgcagatctcatggctactgcagattgatagtgagagccatcaaacaagggctttcctttgtaaagtgtcaacaacaatgcccctcctatgcacacaaatgtaccaagaatcttcgctttcccacctttgcatttaatgttcacagtttctaatctgtagtggaatcaaaagaaaaagggaaaggatatggtgcatttatatatattctccatttgaatgatgatagtcgctataagaataagaatatgaataaaataagttttgtgtaaatatatattcttttcatacccaaatggtaatgccaaaatgaatgtgatcaccgggaccatattaacaaaggcacaagcaaaggtagctgaggtgtattggatccccagaaggaagaagtattgtgttacggatgccctacaaagaaattaattattcaatattacgtgttttttctactatcatgcatgttaaccatgcataaagaactatatcaggaattggaaacacataaagaaagatcgttatttcatgactaacccaataatggcactgaagaaaaggtagcataaaaattgaaatgtgagccgtggtcttccatttctgcaagaaaatacagttattaagatctttcaaagtttccttctggcataaattaatgagcccatttgagcactcatcctggatagcaatatatgattattagcttaacatatatccttgattctaaagagaattacgttcaagtgggtgatttcatagtcattcattattgcaacttggttatctgcatgctaacaataatataaaaaaataatccaaaaggtaaaatgccatacatgaaggagaaataggctatagtttttaatatcacgttaaatttcatcttaaaatcatcaattaagtaatatatatatatatatatatatatatatataaagatcaccaaaataattgagatagacaatgtagaattttttttcaacaatgtctaaaagagattatagtctctcataattggttggaaatactcttgattcacacaaaatataaagaaaggaattgagggtgcctatatacctttccttaaagtagccgatggggaccaaaaatatagtagcaactgacagacgatatgtgataaaaaccaaatggttcattcctttttgaaggactttcttaagcagaatgttcaccatggttaaagaaaaatctatcgatatcattactaggaaaggtttccattcatcaaaattcttcatttcagcaatgcagttttgtttctgggctgagtggcgcctccctctatctttctatttttcagaaaatgttcaaatgcttgcaatacaacagaaggctacctgtggctttatatatattattccagaataagtggtaagaaagcaacattactgttccaaatcagacactttataaacaactatcccttttgatggtagtttaacgtttgtgtagactatgctcttccacatgtgatctttggactgatatctgatcctgttctacagaaggagatcactatttgggaatcgtttaaaaagattttaggttggttcatgaatcatggtcctgatgtaaacattattggttaattaatttaggccactggtttcatattaacaattcatttagacccgaaacaggtaatgttcttcatgttttgttcccgttcttgtaccctttggcatttgaactttttttcaatgagtgacaagcatcttttaaatggaactgtggcagaagcatggcatctaatgctttttatctatcttccacatcaaaaacattgaaaacttgaataaaatgtcacatctcgtagctatttagtcacttcaaaatcttggtgaaaaagaagcacgcaaagaagagatcacagtgacgcaaaccaccagaaactttaatttgcaaaagaggtagatcagcatatgccctggaacttggagttcgcatacattcggattcaaatgtcatgttggtggtgcgaatcatgggtggctttcagtacttgattttaatatgaaaagccattattagataactttaactccaattacaacgttcaaattcttctctttacaaaaaataattaggattcaattttgatacctcaaaactttttatattagagttaaatggaaaatcaatttaaatctctagtgcattgcaaattatggaactgatcgaatctttgactaattggaagtccccacattcatttttagaagaggggggaaacagatattgaaatgttgttagaagtgtgggataatcaatttgcccttatttattaatgttgcaagaagttacatctaccactattaaatgaaggattttgtgaagagaagaaaaactatcctaacccaaagaacaaatcatgtatccaagaaaaaaagagttaaaatatatctatcacctcaaataattattcaaattttgtgtttattttctaataaattatttttttgtttttgattcccataaaataaaaaattcgtttcttgctcttgacattttttaatctaccataaatagtaaattttatatttattttttgataaaaaaattatttattattagtatctttgaaaaatattaataacaaattaatgaaaaatttatcaaaaatcaaatacaaaatttgttaatttattatgagttaaaaaaagtatcaagtataaaaaataattagttttattaaaactctatgaggaaatatttttataaaaataattaacataaaattcaaatacttattaaagttcacaaatatattttttaaaaaaaatatgtaatttcaaaagatattaaagagtttccctcctccatgcttcttaggcttcaacatccaatctaactacgtacatacattacctctggccccttcaacgagaccacgtattcaatgcccactccatgctcgtcacctccttccactacaatcgcaaccatgccttcatcattgtttatagccatgatgactcttgcaagatttcttcactaggagttctgatggcatccctcggttgcggttgatcttaacatgttaccacctaacaataatgacaacctttcgacaatgaagggtttaatatttgttatcagtttagaaagttttacactgtctattaataagaaattattattaatatgatttttaagattatatttaaagttaacatacttattataaatgaatgtgatttgtgattgaatgttaatataaatgaaagactggaatctaataaagtcatgtaattacaaatacaataatttatagccttcaaaatagtaatagtagattttaaaaaactattaaaaagaaaaatatgtgatactcaaatagtttgtcttcttttatagtgactcactggactttaaaaagaataaaacatttaacgtacatgtgctttcctttgaaggtaaatgatgggatgcaacttggattctcatcacatatctagaatccaacatgcaaaatatgttgtccattagccgaagattatgtggccactgtccttcaaaatgcccacccttcaactatttccgatttcctaccagatcttatcgtatctcaccaatgccagtgaatgaatgaagcttgatccgttaaataactttgaggatttaaattgcatgtgatcattttcaagctaggaggttctcatgagctaaatgacttgtcggacatgaaatttgcgtaaaactaggaatttctgctttggaacatctattaaagcagacatctaggcatctcagtactgaaattccttatttagaccatatcaaatgcaggacatatcatctatatctatcttactatttgagaatgtttgcattttactatatttactctgttcttcattgattttttccacgtttttttggttaatattgtcttgtgctataaatatattaaatagggtcgtattttatttgtttatagatatctttgtaatgtatacataagttttttagtcatcataatattaatattaacgtagagtagtgactaattttactaataattaagaaaaattttattacttatttttagttatatctaaatgtatgctgaaaatagaccgtataacaataggttttaaaaatatatttttatttgtattaataattaaatgttaattaacatgtgcaaattatgttatatattcttttgttcgaacttcgaatgattttttttattgtccctttgtttgttattcattttcgtcactttgttttattaacttttttatggaacatttatttattaattaaaagcattactttagtctttagagtctagatagagatttactttagatgtgatgcgctcaaaaaagattatagcgataagttatagatataaccttattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaattaacagtatatgtacctctaaaatatgtgaaaattagactatttgattacattctaaatgatttcgaatttttgtgaaatttgagacatgtgatttacatgatataagcttttaatctaacggtggattttataaaatacttatccaataaaaaattattaaatagtataaaactatcaattcttacaccgatgtaaaaggatctcatctcatatatatatatatatatatcataggaagggaataaactcaacattttacttccctcgttaaagaaaattgatgaaataattaagtacaccaggactgtctactataaaatcaatttaaaagaacaattggtggactaatagtattaagaattagactaattaaagatttaaagatataagattagttgaatgtttaagagagaagaaaaaaggaaatagatggtgggtttgatctcctctgttaacaaagattaatattctagcaaactaatatttgctgataaaagaaactaattaaaatttatttgattgactcgtttacaccactcaaacaaggtcagaggaaacttagagcagaggatcccaatagagccaaactcaaagcacgcagcattgttgctcaactgcattgcatgtccaccacattgctgggccacttctgatgctagttgatggcatgatctgagtatgtcatatcaataatggactgagtgaccccagaaagtggccatacatgtagaagaaatggctgcacctgtaggggcaaacaagctaatttcatgaacctgatcacaaatctgtgtcgtaggccaggaccatatcatatgcgattatttcattggaccaatttacaattgaagttggtgggagttagcaatgttgttgtgagctcactccaacaaatagtaattattaatgttattgcatgtgagggaaacttcaaattcaatttcatgaaatctctttactcatcaaatagttcggccttgagtgcatcaagaggcaagatgtccatatgcaccagcacctggaccatcttcacacacatcttcaaatgaaaagggcttcatgatacgtggcatgtgattggaaccaccaccacacatgaaaatgttgtggcaattcaaaattgggaccatcattgactgcaacaacgttttcccaatctgcaactcttcccctgctaaatcttttgagcatgccaaaagtgcaatacatacacatcaacacaggatatataagtcttcacaaatttacaattttaacaatatttttttttacaactagtcaattttatcaattcaaatgttaacttatgtgactctatgatgaattgatgatgctcatacgtaataaatttttaaataatttttatatttgtaaatgcataatttaacattaaaaaaattctaatgacttaaataatattattaagccttgaaacagagtaacaaactgaattttaaatagtaacaaatgtccaagtgaaacttgattggtttctaagcatgagtaagaggaaaggctcgattaaaagtgaataaccagatttttttggcagaaattagtcaataatatcaatgacatagttataagaaaagttaaatatgaaatatgctttgaattaaatgaaattttgttaaaattataaaacatacatttagtagtgttgacgaatcaagttcatatacgtttgtgcaaatacaaccaatttacaaaatgaaaaattggcattattacgtcatgtaataatttaatttaaaacatattgtatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagaatttatttttacattaagatgtcagattcttaaatatcaactttaattactatgaaattttatttatcaaatatgaaatgtttatgctttgaaatttactcttttcaatttttttaaattcttttttctccctaaatttaaaaataattaattacttaatttaatttccactactgaaattaatgaaccagtgaaaaaaataaaaacagcaaaaatattttcagaaaaatataattgactttctctactaatttcaatttttttaatagttttaaaaaatatctacacaatacttgagttacttattaacataaattataggnnnnnnnnnntttatgacatgttatttaataaaatcatccaacacctaaatcaattatatttttaagattagaactcaagattatttatcaatatagataatttcgtatcaattggatttatgtgcttgatgatgcaaattatacatatcaattccttaaaaaaggtgataggcacatgcataaaggatcaaatttggtaaggataaatagtcattttcatttctggatgtgtagaacgttgataaatttgtttctaaaatatgaaaattcaaattttagtcctcaaaagtgaaaaaaaaaatgtgaaaaattcattcactcgttaacttctgtatgctactgttaataaaagaacttacgtgacacatagggacaaaaatgattgttaacatgattgcttggaaataataaacataatattgattaataagcataatctgtctgctactctaaaatttctaatgtaacaatatcttatccacaatataatacttaaacaaaaatgcatagtcattaagttaatccttacaaaaaatgagacttaacttgattttgtcattatctaatactatcacaatagaaatttcaaagcaacacacaaaactctatcattcatacaaaattcagagcttggagggcttatgtaccgtacagtccgaaaaactcgacacgtactcggctcgtggggcccccacatgctcatctcgtggcagtctcaactgtcacctatgaactcgaccgtgttgcatagaggagcaactcaccaacgtggctccgaacatcgcataactatctcgacaacaaagatatatatattcatccagagggaaaatcctgaggtacattttcattgatctcacacataaaaaccttagagcaccattgacttgttcatcggagttccttttacatgtacctacatttgtagttatatgactgacttgatggtaaagagagaaaagaggaggagagatcatgaattcaaatacttcactaacaaaaaattaataattaatattgactaataaaataaaaaaattcaaatcatatttttagaacatcataatattgatgtaaaatatttatcggctagtttcaataatgattaattttagttgaaaaatttaacttatcatctttaatgagatatctctttctaattacattttttttcatttccaatattccaaactttataccttaaaaaaagagaatttttaccactggatccaagacaatagaaatcatcataccacctcacaactgagaaaagcaacatattgaagtcaaaccgggttaagagatcaacttgcttatattatcattaaaaaactaagcaaaggccaaaatttcctcattaattagagacacttgcacctcttctaataatctgcagaaagcgtacaaatggcactaaggaaaaacaaaacattgggaaagaaagattgataaacacttatttgaactgaagttttaaccatgtttaaaaattcatcaagatcttcagctcttttctttagtactcctccactacagaagttgggaactttgtttgccatgttctttgactgtatccagaaggaaccttggcttgatcgatcagtctccttttcaatgtttcctacacattaagcaacgtaccgagtcaaccaaataccttacaatggtcaatgagcaatcaacaacaacctggaactgatcctcacatcaaaccacagcaaccaatactgctgcagcgttgacacgaattccgctctgcataaagcaattaacaattaaagaacaaacattatttcactgtgcaacagcaattacagctagaatacaacacttttaaaagcctcaactacagttcccgcttcaacggctttgctgtacgtcgtttcatcaccgccgctagcgacaatccccgctcctcctgttcatgtggtttcgcttccaccgccaacagcgacagccacctcatacctatcgtaacttgaaggcgttgttgttccaatccaaaaaagtttatctttccttgcttacaaggagatgtagtagctatggcacgtcctagagagtgatgattacttggagcggaagccgaaaaaaagtatcggcagcaatgaaactcctgcttctccagattgagattgccattctcaaactaacctaaatagaaatatatcataagggaagaatgaatgaataagttagtgttgtttacacatataaatgctacgaacaaggccttcccaaaaaaaaagttagattattttggctgttgtggttaagtaatgttcaccaaattatttcaagctaattttttttatcagttaaaaaacttatttgaacatatatcttttagtgtttttaaatattacttgaagtaaagtttttagtatcttttagtttttaattttttatatttttttcaatttttatcttttatatttatctaacttcctagatattttatttaaataaatcatgattttatgattgatctatcattttagacttttaagttattttaaaagttaattttattaaacacttataattaaataaactatttttttttttaattttcaaccattactaacttccaactttctaactttcagttagttttataagtaaccttgtatttacattttacactttatctgtctactaaataaattctcttttcatgtaatttttatttttaccttttttatttcttttaattttaaaaaataatcctaaaattattgaaatgtaatcaaaaatatttttaaatatatctagaaataatattcctaattatccttaaaatatgattcctaagaatatcatatcattctatgaaacaaatgtccttacttccacttttttttttcannnnnnnnnactttattaaaaacatgtttttagtccttcctcacatatgatgttgactatgtttaacaagcacaaaagtttttttatattaaaagagaatcaaaaaacaaagaaacttcactctttctttgttgcttatgcacactgattctatgtgaactctaaagggggctcatctcgatccgaaaactaatttcagtaaataaacaaaatcataagaagacacaagaatagatgtgtaacatcacgaactattgaagaatgaagatggaaaccaagacagagatgaaactattgaaagttaggttcaatgtgtttgaaaaaacatttttataacattttaaaaaaaaaaaaatttccacatcattttaataaaaaaatttaaaaaagaaaaaaaaaacattgtttgtcacattaaacacaagttgatgccatagtaaagatttggtaagaaatgactaaaaatgttcaccaaattattgtcactctcattttcactctctctctttctccaatttctctctcttccatcttcttctcaatggtcatgttgccacgtatttttcatgtattttttattaatatttttaaaaaattttatatacacaaacagtaataggagaggcctcccaagccttctttgtcagcacttggttggcttctcaaagaatgtggttccaattaagtgatatcacctccattgcaatgcacttcataaaattattatccacctgtatagtttctctttctcaatcagtaatgcatttaatagtatattgtttaaagattaaatgtagtaagtgtgattcaaattttcaagattaacgcatatcactactatctgtctgcatatttttcttttaatgcgtttgagcatataagtattatgtaatttaggttcactcatagaataaagtctcagatgttcccttgacctaaggtagtgttgccccatgtgagcctcacttaagcattgtgttgataagtggatcaggtcttggcataattatctcatcacattggttattagtatataaaaaagatgtttttcatgtttatattctacattagttctctagaaattgataaaatatgagacaatgatatttttgaattattgagatgaacatttttgataaattaataaagaattaatttaaaaattactttctacatcgattaaaagagaaatcaatctagattgactttcattttacataatgtggttagtttattctcctattattattattattattattattattattattattattattattattatatgttactgtattctctatttcacattttgttgttagtttgttctttcatgctctgttacatagtactttcattgtcatcataatctgttcaaatgctctttgtgattgttgtgttagacctctatatgtgttctgttatgtaatttagtgtgtgttttcaattatgtgtgttctaaacatacttcacactgtcttgattcttttgctcaggttcacattcaccattaacatgatgtcttccacaaaaatcatacttcaattcatttacctcttgaattgccatatatattatctatctataaaagcttcaactatttggagataatctccaactgctatgaaagtatcatgttttgagctaagataacacttacataaattttgtgaaatcataatatatattcggagttacaaatttggtttaataaaaagggataaacgaggagaagagattgttgattcaaatttctactaataaaaaattaataattaacattgctctataaagaaaaacattcaaatgttattcctagacatgcgagatggattaccaattaatcaaataatatttttggattatcaggacattaatgtaaagttaaataaaataatctaacttcttaaagttatgagtatgttttaattttaataatttataatgagatataataatcaatatttatttttttactctcccgcaaaaaaattgtcttaccagatacatttgctgtatattagtaccttcgttaagtctaaaccatttttgttagtctctcatgtaggattaaacgattaataacatatttaattgccaaggactagtaagagtacgtagacaacagagccggtttcttatcatccagtgtgtgaagctacagcttttacttttaaaaacacagctgtgaatcactctggctcgagtccagcaagatttggttaaaaaatgaaaagagccgttaagaaaaaaaaaaaaaaaaaaaaaacctnnnnnnnnnnnnnnnnnnnnnnnnnnnnnnnnnnnnngaaacaggaacagcactaatagtattaatgacacagctgaaattcatgcatctcacagaagaaaacatttactactacagatgaggcaccaccacagatacggaacagagagaaatacattaattatgtaaccgttatctgttatccctcatagactctcaaacccacccaggaaccaaccgttatcaccgaggccaagtgagaatttttcacaatgcaaatggtgaacaagttaaactagatagctagctaaagctttcaccttacaaagtttttatctgacagtgcaggcaactgcataagcccatgacttgagatgttgtttcattgccacatcattatcaaacggaggcatcttaatttgccgctgaatgttaagcatctgaatctgatattcccatgactccacatcaaacacatcaaaatcaaacctcaaatcaacccctccatgaaccacattggttcatatagccccaatttgtgccacttccttctttttctcgtctctctcttctttgtttccctacttggtaccatggccttcacttcttcaaatttgtgacaccttggactcaaattctccacattctgagattcatgttgcagtggggtaatgggtttatgcaaatctctcttgggacactctttggcatggattaaaggtgcagattgatcaaccaaagaggcttcaggctcatctctgcaggtcaagatgttggtgtggaaccagagagagtctaggctttgtgcaacccgtgacccatccatgaatgattctatgaccagaaatgtgaacagtgaacaggaccaagaccatgtaacatgtgaactagtttatacaacaaacgaggaagcttgtgtagtaaatgcgggaactttatattcttttgcagagtttcaatttggacgtacgctattcgaaaatgccaaaagcatgagaagggcaaaacaaaactctcgctgtgtgtttcttcggagtaccaaaatgccctcgagtctgagctgaatttgggtataattcacggggacagtttagtctcattaggaaaccagcggtaacacagtgtgcaccggggcgttactttaacatgttcaatgaaccattgtaacagcatctgcactttccatatcaaaacagataattatcgaaattgagcttagcccaattaaatatgaatatacgatgcctgtgtgcttctgctgtgtttcaagacctaaatcttccattttttccggtaaattctttaaaagaggtgcaacacaagttcccaatcacgcattgaatacattagtgttgatataaacgcacctcatgtaactcaactttagtattatgtttgtattactctatatattttattctagttattatgatatcaaggttttagtcaattggcttacaggttcgggagagtgaatatgttattgagtcattgttgtacagtgattattcccttcgtatcatattatattttgtttgagtttttttttttttaattattgtttgagtattttagtttgtcttaaactagtattttaactatatacagagaataaatacttctttatataattaaaattcatgatattttatttaagatttacaataaataatttagatagggatatgaagttattttatttattaattatttttcaaaaaaatattgaaatttaatttaaaagtaaaaataaaagatggtagattgaaagtaataagcaatattaagaagataaaatatacaaataaagataaaataaagatactagaaaaacaaatatgcaacaatttgctcataattgatgtatgaactcttcccaattgtcaatatggcttcataagctagcgtaacatggaagtggttgagatggaaaagggctgaatggagattgtgaggtgaattgacctccctcaaatgagtatttatgatagtatctgcttgtgtcatttgatgtttggtgtttactatattaaggtgggaattagatttactagacttccacatacaatgccaatgatgtattttgagataagactgctaattttgattgaacttagcaaaagtgttgattgaagtacacttcaaatggattgaggtcactaaatgatagtataaccctttgccaagactataaacaccattaggggatgaatacttacaaaatacaattcagcatctaacttaacaccgatttcactagagtgataatatgtaataaaaaaatttcatcacaatgatattgactgtatttgtaagggtttgagataagataaattttctaacacatgactcaacacttaaactgagtcatttagtttaatctaaaatagtttagcgttatcatttaattagaaatttatattgattgattaataagttgttagttcgagtgatataaaatttatcttccttaattaatgctttagttttgaatcttatagatgaaaaaatattaaatatggttgaaaatagatgattaattagattttttcagcatacattaatcatcatcaaaattagttgatactcaatactaatgttatggtgattgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaactattttgaaagtaagaaaattaagaaagattttttttttttttgctgactagcggattattttgacccatccctccaaatttgatattctactagaaaaatgaatgtttaaatttaattttggttctcctattttatttaatttgcaaatttaatccttttatttaaaaataaacatatttggttcccataattaaaaaaaaatacaatttaagtctcctatttcaaaataaagacatttgatctcctatattttaaaaattacaattttgatcaaattcttgattttgattacatttttattttattttattccaattaaactttagacataacatatacaaggcnnnnnnnnnnaattaagtacaattttaagaaataaaaggatgacaaaattgaagattatactaaaactacggattctttaaaatataagaataaaaattataaattttctaaaatataagatgaaaaatctctattttgaaatagtggaataaaaattgtgaatttaaaaaagaataagaagataaaatatctttattttaaaataaaaggtaaaattaataaattaaacaaaattggaggtcaaaattatatttaaaaaaataaaaaaatagatacgtgaattgtcctcattttaaagtggtttttaattaatagtaaaagtattacaaatcttgtcacataaattttaaatattaaaaaaaatgatcattagtttaaattttttaaaatatttttaatagtaataaataaatcactgaattagtgatttattttattcgcctcctctgaaactgggacctgagctatacaaatgaatctgcttgtgtgccgacttatctctttttgccacacttccctccatcctcttctcatctccttcactctctgtaagactgtaagtcctctctcgctccttttttttttttttgctaccgttattttcttttaatacaaacttggctacccaacttcattttcattttgtttccatctctatctctgtttaatcacgcgttgcattattctaattaaatattggctttcactgggaatatgctgtttcctttattcattagcatttttcatactgaattgttttcgccttcctttcagaatccagtgcctgttgtcaatgtcaactgcttcacactgtctgaccatactgcatacttttatagtcatagctgctgatttagtcacatttttcaattcataattgccatagaaagaaaaaaattatattgctttttgtaccataactagaattccaaattaaattttgatgctttaggtctacccatcatcattggaaccttaaaaatgtcacttgtaatcccctcatcctgtgcagcccccttgcatttttctcaacgggagattagcaatttgagttcccaccaaaaatttgcctcttattattccatcaccccttttcaacataaagtgcctttgagttgtaaaacgaggcatataaggactcacttgagaaatgaactatatgttcttcataagtatgcagttaggtctaaggggcatgattttgagtcaattaatgatgaatccttgggttgggatgatgatgaagaagtcgaagatatgggatctccttgggaaggtgcagttatatacaaaagaaatgcaacaattttacatctggagtactgcactaccttggagaggttaggtctagcaaagctttcaagtgatgtctcaaaaactagggctgctgcaatgggattacgtgttacgaaagccgtgaaggactttccaaatggcactcctgttcagatatctatagatgtgaccaggaagaagaaaaaattgaggcttgatgggatcataaaaactgtcatcactcttctttgcaataggtattgccttcaattcatgaatttacattgcctacttttaagtgctttttctaaatttctttatcatctcttagttttgcatttttctttctcgattttactctgctttatatttattttgatatggtttaatacttcaggcctcaaaagttaaaaactaaaatctctatggtggaatatattttgcattactgtaattattgtctagatgctcatttatgcattattttcaaatttgttttgcatgtgactccatctaatataccatattaatgataataagctaggagtagataactccttgatgcctgatactagtcttaggataggatggtgttggtttcctctactctcccttcccttctctttagatttgttaagcccaaaactacataggaactttgattaacaggaatgggtatattgcgttgtgtctcaagatagctcactaggtttttaatgatgagaaaaatatttattcatgaattctagctggaagagcctgcttagttataagcagcaatgggaacagaaccctgtctactagcaggaaacacgtttcagaatatgcaattttcttaattgatatctactagttatgcttgatttaagacaagtttgatgataacagcataaactttatgtgagcagtgacattgaatggtaggtgttcctctataaaaataaaacattagcatagactacactgtttctttctatccacattaatagcttctcttaaagtaagtaacaaattgctattacaatggtggcatgaacatctttcattttttattcaatatgaagtttaacctctaagaatttaaaagtgtgaaattgcttgcattattacacaagattatcaacttgtaatttggttattattctctctggttgcttgtgtaccatagtatttattatgtaccatccaatttccatgattgctgaactgttgaaggcgtgagggtttatatgatatgagaacatatttttttcttccaatttcgattgcagtgccaacattctgatcggaactagatcagaaatggaagaaaagcagaattcctttgttgattcagtgtatctctacaaagaatgcctttgatatttaagagacaggtctcttcctagtctcaattgtatttcaccaaatgacaaactcttctttgcaacaccttttcctatttataggagctactagtttgctaacataatcccatcctcaatgggcttaatcagttgcaggcccattccccttctttctaacattacccctttgtatttctttgactaactaaccctactaactaattatgcgaacatagctaaataaatgacctgtaagctctattccaccagggtctcacagcataaaacatgatacaatttacaattcaccaaaataatgaaattatacccaataactctccttttcttttgacattactttgacctcccttaatctaatataactacataagaaatgagggatggtctgtacactgtgttaacaggaaggatgtattgtgttgtttgttatataagttaaggaaggtttgtgtagtgtaaaaaaagggagggttatcaagtgaaactttgttaaatttcagggagtgtgagtgtaatttgcccctattttttttgtgtggactgaggtggaatgaaggtgcatagaccttacagaggcagatgcggaagtttcattgaactaatagatttaaatcactttgataaaaattgatgttacacaatttgctggtgtggatatcagtcatcaactcactcttcaacaaaatgctctgttctaaattgttcttgctcatttctgcattattttaattcggatggccatacattgtacatcatctgcaaactttttagatataattagcaaaagcatggaagctttaaatcctgaaaatgattggtctccaacttccttatcacttccaccttcctaggattaatacaaatgatttcacagaaaattacactccactgaaatataactgcacttggcttagaactccacagaaaattacacttccaccttcctgtgattgaacttggcttagaactttttattctaccttctattctctttattgaactttactattatttacaatgaagttctggcacatctgcctccaggatctggtgtaactagatttatatgcttagtcctgcaccccaaaagtagtaaacttataatagttgttgatattccttgcacttttggttgacctgtgtcacctaattatgaactgatctactatgatcggtttgttttttgaacaacaattgcttgttgcataattgtattacgttattcatctcaatttattaaatttcacaccaatgctccattaggatttaggctttataacatggaagattcttggggtagttgaaataacatgatatcttgtaagtttacaatagctgctaacaggttaattcccttcaggtatctggatgctaagcatcgcaagtaccattgtatacttattcacctgactgagttatcgaatatcttcctggataattgttttaatgtttcatctttttatgaggtagccaatagtgcaaatatagcagtttcagtcaagtacttatattgaagaaaccaaaaggcaggcctgaaaagaatttattatttgttgactccatgtgaaaaaaaaaaaattataggaagtatgcccctgccatattctataatttattatttccacaacatagaataacttgtttcaatgtgattttcttttgaaggtgttgtgccccatctgctgagagcatattctccgagttctcacttttactcactgacaaacccattgaagaaccagagactattgatatgggtgttatttttggggaagacaaacttacaacctctggaaacagtggtgaggatgactatgacgatgatgcacttgttgacatggatgatcaactatattttcctccagaacagagacaaattgacatttcaaagaacataagggacagggtgcatcttgagattaccatgaattcagtatgtggtcctgggtgcaaaggcatgtgcctgaaatgtggtcaaaactttaacactggcaattgcaattgtagcaaggaggaagtacaagagaaaagctttggcccgcttggaaatttgaaagagaagatgcagttgtaacaattatgaagttcatgtgtaggatttgctcagagtgctgtatcgttatgtgtagaagtcctgaccttaatgggtttttgatgttctgacattgtcaagcgcctaccaagagctcttggatccgtgatcatacatggcatggatgatggatgttattgaatatagatccatggagcattgttctagttctagctacgccttaaagtatgccgttggaatgcttctttccaaatgtattagatccatgatcatacattagtactatttaaattaatattacacacactttattagtctaatatttatataaatattagatactattatttattaaatataatatacaattgatattacacacacacactttattaataaagtattcatataaatattaaatattattatttaatatatttatgaaatataatacccccgtagttaaaaaaaaaaaagaaaaaaagaaaaataataccctcttcgttccataacaaatgtagtcttagatttattttattttatttttatacagactcagaggaactaataaataaaagaaagagtaagtgaaactaaccataataagtgttgtccgaatatcatatcttaagatcatatccttattaaatgatattaccaatgttttatttatggtatatgttaattgtataaattatatatagcatcaatatgtctttattaaatttgtggatataatatcattaatattatgtattcacaaagatttgattttataataatttataaaaaattaaatttgtatttttttttctaaacgggatatcattcgggtcttgaaaatattggaaacataatatagagttaattacattgtctcatggcggtttcgagtaatgacacccgctatccgtcctctcctttttacaacgttacttttagccgcctaggatctaactgcgttttggtttcgttagttgtttaaaaaaaaataacaaataagaagttggaaatatagtattccttaattgcccctgcattaagcgagtactgttcattgtttgggaagggtttcttacgttttagaatctgaagttagggtgacggcaactaacggttgcttgggggaaaatcgcgagagagtgactttgtttagggatttggttgcttggacgaagatctcacatgaagtaggttagcggcgcaaaggttccagcgttcgatttgaagggtagcgtgaaaaccaacgaaggtgaagccaagaagcacttcgtggtaacatgaatccagatctgacgccgcaccccactcaattgaagtttgtctcaacttcaatggcataaaatcagcgcccaacacgcccaagatctgtttttttttaaaaaaaaaaaattaaattcttcaatgggttcttaaatttgaagtcctcccaattttaatattcttgaatagttttgttactgggttgttgctgtacctactcggttgtcctcttttattggtttatctatggaatatgaggtatatataaaatcatctagtacatggagaaactactgtcacgttagtttcgtttgttcttgtaatttgactgaagaaatttacattaagcattctttttttatctctttcaagctttgaagaatttgtatggtattgaacttgtcattgagcttagattgggaagcgaatgttggcggaaattttttgttcatgttcttcattgcctatcttgatttgtttttgaaatttattatctaaatttttcgttaatagtcattaagtgaactgcaaatccaatggtttaagaaagcacagagccatttttggatggtggctttcatttcatgtgctagtcacgtttgggcatctattaacggagtcaagaacattttggggtgaggggtagttgctgttacgagaggcaacaaatttttaggaggttttatgttgggtaaaaaaagaggagtgccaaaactgtaattacatggaacctcaggcctatgtaattacctccatattataatgcattaaatattatcattaatatttttttacagataattaatattaagtgttacgattcaattatatattattttctaaagaatcaaatttgtatttttttttatatttatttacatgtttataatgatgatatcttttaattttggttggaaatataagacttaaatatctttttgttttttataatttaatatttttttattttcattgttataaattatgtttttttttgtttttatcacactttaaataatattttttattatttaaagtgttatttaaagtgttttaaaaattaaaaaataaacataagtgatcaaaaattaaaaaaaaaaattacaagagaaaaatttaaaaaaaaaggttaaattatcaaggtcaaaaagtatttaaacccgaaatataattatgtaatgtgaagaacactacacaatgtgttcttgactaaaactctccacaaaatgaattattcagtactatattccttattgctcatcccttgcttgatccccatttgccggtcttcctcgccaacaaattctagagcttatggccatcatgatcatgggctgcttggtgatggtcctgacctgattggccaaatttgcaatgaaatcaaacaagaccagatgatcaactgcacaaacattctcagagcagacccaagaatcctgtttgaaaaaaaaatcgttgaattttcaaaggctgtccttggacaaagcaatagaagggcagaactttcttaagggattggtgaagacaaaaaaaatattctccagccattgatgaatgtgcaaacattctttatggtggggtggttggatagttcagaagtgccctgggtgagttgaaagatgaacctatatatgctaactatgatgccaaaattgctggtgatgattctgatacgtgtgagattgtactggcttctgcacatattttttaccctgcaatttctgctcttaaccgccaaatattgttgcttagctatattgtagtcctagccacaaataagttcactgattatggcagtttatggggataacatgcatgcatgatgtcaacccaaggtatagtagaggtttctatttgttttagcatctcttttgtagaagggggagattaattgataagatcaaatagaagtttactattacttgtttttggagtgttgtctgttaagatgaaactctatgatttaacagagtaaagaagaagaaaaactacctaccttttttatttttgcttaatcagaatgagtgtacaatcttatttatatggctgatacaaaattaattttacaacaataaaatagaaaagccaactaatcataattgacagctgtttattctaacattgaccatagtcttttcctgcctatgaatgacattattcttacattgaattgtctattatgtgacatttgtttgttttgtgagggccggaaattgtctacttgctcgtcttctttaacttgttcaaggtggttcaagacaagaatttcaaacattgttgaatgtttttcatatgcggtgagacttcatcatcaagatctttgttactgacaaaattagagtctgaaacatccatgaattctgtaggttgaggcattgtttacccttcttcaaaaaaaggcttctttccaatggagatatttagcattgtttgtcaaaatatctattgtcaggctctttctaagctagtcccgatctgcaaaatcagaaaaagttgtagtgatttgcatatttaattattgtcatcctttttttattaaactttttttgcattttaatttcaaaacatatttaaaggagtttaatattgttttctgtaattttaatttaaaaatgaaggcttaaagaaactttaacttaaataggtaactgacaaaggtgagtacgcggtcttttaaaagacaaccaaattatgcttatgttctaccccatgtacttggagagatttatcttcagctttcctttatcgctcggttttaaagaggaaatctttagaggcataaaagataattactacggtttatttgcataattctagctacgactttaaagaggatatctttttttataaataaatactatatttgtataattctagctacggttttcagatattgtagttggaaaaaacaaataacaaaagacaagggatgttcacgtgttagatttgttttttttttttttttttnnnnnnnnnnnnnnnnnnnnnncactcttctctatgattaaatataaaaaagggcacgtgataagaaaataaaccagacataccagaatatgataaagtagaccagaggacaggttattataaggggggaaaacagagaaaaccacacaaagctaataatacttgcaaattttgcatctttactgatcactcaacattttccatgtgcatctctcgtactcgtaggtccacacatataaatgtcatgccattggctacgtgagaatttgaaattacacatgcatatattaaattcgttctatattattaaatatatttattattatattaactttttatcacataaatttaatacttattaattttatattaaaattattaatattttattaatctatatcacatttaggataaaatatattttaagtatctcaattattttttgtcaaatttgatatagattcttatattttaagattactagtatgtaattttggatttcgtattttttttttaaattgatgaatttcatcagtctttcaagaactcaggaaaataggataagagaagaaattcatcaattataaaaaatacagagatcaaaatcataatttttaataaataggaattaagatcaagtttgattgaaaataaaaagacttaaaaatatattttacccttaaaattaatgtgatatataatatatatatttgtaaaatattaacaataaagtttgtttgatcacagcctagattgattctgatgttggatcaaaagattgattccgatgtccatgctttgcctactttgctagaatgaatcatccaattcattcatgaaaaaaagaaacaaaagccttagttgataaaagtaatatatataaaaaattaaaatgttttttttagttattctttagattcggtctacgcacgttctctacagtacaactggttttgtgaaaactttttcaccaaacaaatattagttgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactcttaaaaatattagatttggtgcaaatattataacttaaaaactcgtcgatcctgtgtaggatctgagttcactctagcgtgggttgttttgatgaaattattttaacttaaccaaagatttgaagtcatgagtatgtagtcatgttaaatacttagaaaaagagttataccatccttaatgattttaccaaactcaatcaagcctccagtggaagcacctagaccaaaaaaaaaaagttgccaaatagaaagaaaaaaaaaaacaaatgcttcacactgagcacgcaataagcacgtacataatatatatatatatatatatatatatatatatatatatatatatatatatatatatnnnnnnnnnnnnnnnnnnnnnnnnnnnnnnnnnnnnnnnnnnnntatatttataacataacaatgaaattgatataaccaaatgattagatataaatgattaaaatactgaaattaagattaaatcgttcaatcagtattcaagattgattcttaacaaaaataattttcgatcatattttactcacttctctacttgaactttaaattaatcaaaatcaatttcttcttacaagtcaaagggttaaaaccaaaaactaatgaaagtgatatacattatttgaacgaacatatataatctttatccaaaacaaaacataattcaactattcacgattagtgaaaattacaaagtattttatannnnnnnnnnaaaaaaaacaaagtttgttcaccatcaacctaacatctaagaagcagaagtattcagacctaccatgagcaccatcacaaaatttgtcccaggacctacataagtacacattcagccaataaatctgaaatgcataatgaaatttcctctctttttgtctaaaattacatgtaacaaatttagtggaatgccagattccagaaaaaaatttagaaaagggaataaatacatttctaaattaaaaaaagaacaaggaaaatgtatatatgaaacgaaagaaaaagaagaaaatttttggattatgaaaaagtgcatcatcatctgacagtggaagcaacagtgtgagcccaccatctgagactttctttcatgtcagtttcattgttgatagccggcattttccaattcaccaaagggttctctttttttctcctatcacattcctgaacctcccatgcttcagaaaggtaaggccttggaacacttatctcatcacaatcatcaccttcttctttttcctcttcctttttccctagccgttgcaacccaggaataattgaagccaagcttgagtctttatcctcctctgagaaaacaaaacccagatccatgaacccttttagctcctcaaattcaaggtctgacaaactcttgctctcccttctcttcctagttccattgcttgagatttttttgttcttcttaggacacaacacctcatcaggttctgagtcagtggcttcttttcctgagagaatggtttggagctttggatggagaagaagcactgagtctggtgacagagaatcatggttgaagcttgttgttatcatggataattggtcactcatggatctggtgtgactggttcggatcaagggtagttttggttcttgttcttgttcttcttttatctcataatctaaactttctgtgtaacttataattgatgtgtgaggacttgaatttgtcttcaaaatgttaacctcaaaccagcaagaatcaaagaggttcaagacagcctccggttccatggcggccgaagaggaaaatcagcagaaaagaaaaaacccgtgttttgtgaattgcgtgttagcggaagtgaattacttagtccatgtagataactagaatatatatgcatgtttcatgaccatattgcccttcattttaccctataattacaaaattctaacccaattgtttatttgtttacacgttttgaattaagtaattttgaaacatctttttcaattcatgtgtggtataactttgtgggaatattattttctattttgccgagtgaagattattgactccgtcgaaagggaaatactgtttggaattaggtgggtttatgaataggtaaaaggaagggttaattgattgaggtggaatagtgaattatggatgctactagataaagctagatataaggtaggggattttgttaacaatttgacatcaagttacttatcaaccactaatgtttatcttattatctcttggattctgacattttactggttttcatttcttcgtgtttgtttgatgattacaccaaaccgttttgatgtaaaattaatggctctaactacagcaattattgttggttgcttccaaattacacaaacttgaattgcgcatgtcactgtggttggcatttgcttcttaagattttcaaatataaaactctagaatttaagatctcttgcatgttttagtgtttttcttgtttgtttttctcatactttatttttttattacagtttttaacctttgttgccaaaacatttgactcttgtgatgatagactgatgtttgaaaatgagtttttatatgtaataatgtctattcccacctctggcattcctctttagtgtaattaatgttttgtataattaataggtttagaaggaccacacacgggaatcgcttcaaagtagttaataatttgaattaaattaaggtacacgtggtttttactttttgatacataacctacacgagatcaatataaaaaagctttacattatgataaattaggcatcaaccaaattatattatagctttaactcagatcacgtgtgaacaacaacagcacacttggggactgttagtaaaatcaatgtcatatagagaaagggggaatcagggaataatcgatattatttttagatacaaggggagaacagggaataattaatataaagatatgaattttcctaaaaaaaattcgctacacgcctgcattgctttataacacgtaatggtatgggaatactgatgtcgtgtatggtgtacctacttgtataagatagtactgatttatgttttaatttcttttttatatataaagaagtttaaatgaattgaattttagaaatttgttaaaaccggacaaacctcaatcttaaataaatgtttccagaacaacaaggtgaaaatcaaatgcatctcctaataaaatatgagtctttgttaacaactggatcaatttctctttttatctcccttgttaactctgtgtgaatctgaaaataaataaaatatttatcaggtgttgactattttttgcccagtcacgtgtgcatctatacaaataaaatattcattcagacacgcattattggtagtcaaattcaaaatatttattgtattccaaaactaagttcgaaagggtcctttagtaaatactaaatagtaaaaattaggcagcagaatttcttttaaaacgtcgagacaatctgaaaataaatacatttcacaacaatgtcaaactgattgtacatagtaagggatccctctgaaagtgataaaataagtttattattaataaaatcaataaatactttatatttataacataacaatgaaattgatataaccaaatgattagatataaatgattaaannnnnnnnnnagtattttttttttttataaaaggagattcgaattcatgatctcctttttcttcactaataaatcatccttatatcttccgctatgatagttattatatagggtctacttaatactaaatgtaaaaacacatattgaataaatatgaacattattaactgtccactaataagttgttgctgatattttcttcttgattccttcttccacaagcctagctcaaagaaagaagagataaaagagtcctatagaaaatgtgatcaaaaattcataatagaatcctatcacaacgaattaattatcttcatgcataagaatattagattatcttgtataaaagattcaaaaatcatctcaagcctttctttttttctattttaatttttggattattatataacgatttttcaattttttattttttaaaattttttatttataaaaatagatagactagaaattacatctcttatctcaatgacaccaaaattaggaatattaaacaaatgtaattagtatgtaaatgtaaataatgaaataaagtcactttaagatttcttatgaaatgaggttttactatggttgggacttgagggaaaaaaggatcaagagagtatcagctgcacaaaaattgcgatattcacagaatttacagataaatgcaacggaggagaaacaattaaatgcttctgatatttaaagtgctgctagtctctttaattccccattatgtttcagccaattattagtatgttcttatgaactgaaatcatcatctaattctgtaaaactatattttctgagtttattatctaattacctatgaatttcattgtaaattccttagccaaacaagcaagacaaaaaaaaaaaaaaaaaaaaaannnnnnnnnngtgaaaattacaaagtattttatatgattgtatatcgaatttcacatgattattcattgaattatattctaacagatgacaatatcaactaaaataacgtagtacaatgcaatatcaacttccttttatttataagaactttttaaacttaatttactttataaaaacattcaatttaatagttacattaattaattttgtatatatgcaaaacatatcaactgagaactcttattattattattattattattattattattttgacaaataaaaattataaatataaactattagatcatatttaaattatcaaaataaaagataaatgtatatgatttatttaagtagtcatgtgtttatatgactcaaatttatagtttttatttctcatgatattcaagagttctcacttaatgcatcctctttccctctctctatagtctatattattaatattatttagaatttagatatatttgtgggaaaaaaataataaatatttgatatattatcacaaatattgaaatgaaacaaacggactaggacaacatatataatttcctatgaagaatattcttgtaataaactgtgattggttactcggaattcggattcaagtatccaaagttgaacttgaatgggaaatcaataattaagaaggccaattgtccacgtgctacttgcgtctctgttgcattaaaaaaaatttgtctctactaagacatagctttgtagctagaagcgaaaggcaaatgtttcatgctatccagtatccaatatgttatttaatatttagagagaatgaaataagaaaaataaaataaatatgatagaattcatgatataataaaaaatataacaaatatttttttaataaaagatatacaattttgaataattatgtatcattatttgatataaaatttgtgtgtaaattttacttactgatgaaaaacataaaaagatttgtcaatcattcataaaagttgttgtttgcatgactgaatattttaatgattaaactgagcattataatgtcctttcttaattatgaaaaacaaatatatataatttaatttacttataaaattacttacttaatatattttttttatttttaggaattcaaaacaaataaaaatttacaacaatttatacactttgctacaccaattggtaccctccattctcaatgattgcttggcgcctatcttcgagcgtggacatattatgaatgtataaatagaaaaagtgttttgattctattttttatagagttttgacacaacaataaaggtccgatagatgttgaagaattagagcagtgcattaatgcacgctcaatgtgtgaagacaaattagaagttagctatattgagcatgggcgctaagtgcacgtttggacgcttagcacatggtcacttaaaacaaatgtactttgcatgtgggcttattgcgcacatgcatgctaagaacatagtcatttccgaaaaacatgattgtgcagagttttaaagattataaaaagggtgacactatgcttttggaggggattggttggcaagggcaaaaagagagcaaaacattcacttgggagttcttcttccattttttttccatttcgtttgttttatcttttgtttttgaacctctcatgattatgagagactaaattatccattgttgagggcttggataccaaatactctttgatgtaatgatccttactattcatttaatgttatttcaacattattccttcctttttaagtttattgtcttgtttatggtttgatcactcattaacatgtatgttataggattttaatcatcgggaaatatttttactctaagaacttgaaggagcttctatgtaatccatgtctagggatagaatgatgttatttagtcttatttgcatcgttagtcttaaatcaaattacttagtttaactcttaagggattataagtgaaattagatggtttaagcttttttgcatgaggaatcatggttagagtagttgctaaacggccaacaagcgcaccgatttgtcaagtaataaaatccggtaagtccagatgttgaattccacagggactttgcttatactcaagactaatacacgtttgttttcaagtgatcaatgaataaaattgatttgtaaaatgagttgcattatattaaactgtacttaaatgtaaattgaaagcttaataaatacaaggagagaaacacaaacactcggaaagtgaacgatggaaatatgatgccattggtgttaagagttcattaaccgaaactaactttgatgcgatataaaagatttttctctattcaacgttaaatacgattaccttcatccactagtataatctaaccttgattccccaagtgctagacctaaactacttaatttcacccttgatccctcaagagttatattaaacgatttgcattaagattaggaatgacaatgtaacataggctaaacaagaccattctatccctggacatgatattatttagaagcatttctcagttcttaaagcaataatcattttccaacgtgttaaaacctaaaacaagcatacaaatgggtgatcaaaccacaagcatgaataaagctcagagaaacaacaataatgcgcaaataatattaaatagatagttagaactttacatcaaagtgttcgattggtgaactctcaacaatgggggttttagctcctcatttccatgaggagcttacaacaatggaggttagggcaatggaagataatgggatggaagggaaagagatggagaggtagctccaatggtgcaaaatgatgtctccgtcttgacctagcaaagctccaagcttctctaagtgtgtgtttttcctttttgggtctctacaatacttctttccctcctatttttgccttaaacgctgccctatgtcgtggtacttgctaagtgcgtccttttcacgctcagcgtgcctcaaatagtccagttggattagtgaccacgcgttgaatgagctggtagcgctgggcaagcctggtcgcactgagtgagtcactgctctcgcactgagcgcgcctgttcctcgctaagcgagcagctcgaaacatgaaatccatctttcatgcccttgcaataaattctacaaaaaaaatacaaccaatacttcataaatccactagttaaagcatccactggatagaagctaagaagaagctagttcctacatttaaatcaccaaaaaaagcattaaaagaggaaaaaatagataattgcaaagtaatgtatatgtaactttatgtatacttagcaattatcagtagtttagttgatgaagataataattgaaataattttaaaaggtgaaaaatccttaatattgcatcaaaagtaattttggttggccaaacacccaacacatctaaaagaatatgcaccaaatatcaattttcacctctaagtctttgttttcttgtctcttacatcatactatgcttttctatcctttattatggtggaagtttatatttctacactatcactttgaaaaatatttagttttagtcattcatccacttaaaactcaatgtatacaaattctgagtacaaccaaagtccttatgaggtcttatcattttaatattactttaacaaatttgtatacctgttaaggagttaacaataagatattgaaaataataagatatttatggatcattactcttaaaaatattagatttggtgcaaatattataacttaaaaactcgtcgatcctgtgtaggatctgagttcactctagcgtgggttgttttgatgaaattattttaacttaaccaaagatttgaagtcatgagtatgtagtcatgttaaatacttagaaaaagagttataccatccttaatgattttaccaaactcaatcaagcctccagtggaagcacctagaccaaaaaaaaaaagttgccaaatagaaagaaaaaaaaaaacaaatgcttcacactgagcacgcaataagcacgtacataatatatatatatatatatatatatatatatatatatatatatatatatatatatataaataaatagatagatagacagacaatatatgaaagtgataaatgtgcgcaggatgaattgccgggcaaatcttctttggcggtgaacatagctttttcgcttcattgcctgaatgtcaagcagctgaatgttcaattcaactgccaaagaagtcattgcccagtaatgcatctgcacatgagtttgcttttcgataactaatttctggttatccatgtctatatatagtgtagggggtgataaaactaggacatgcatcgcacaagactaaggatattcccagcacatcctctgctcaacaactggttacaaaaaagaaagtggtccatcctgtgcctttagtctcacagctactgcacttttactgtgagattggtaccacaggtttttcttctaaaattccatgcatttaatttttaatcaacaaacatgtctctacacaaacagaacaagcaatgaaatgggagtccgtgacgaagaaaattccatccatctgaaaggcataattcttctctattccttttctagtgttttctgttcactttaagttaagaatatgctggtagtaaatacctattccagaactatgtccaattctcaatgtcatggttgaaaaatcaaccccccttctttttctcacaagcgatgcattaccaaattctgaaataacaagtctaatgatattgtgatctgctttcaaaaatcaatgcgatctttccattcaagtgactaaatttattattgattgctgatatcatacggcttgtgtagtatactgagtaaccaatgcagccgacactttgaaattccatttggaaacagtttctcaataaaattatacataacataaatatacacatgtatgtatgcatatggatcttcttatgtacctatgtacatatgcatgtagtcatatgaaaatttctaggcaaatttgagctattagagaaaaccagttgatcttgtgttaaattatgctctggcttagcgatttattgccctgattcaagcaatgaaagtgcaacagcctgaggcaatttgtatgttgaatgaccaaggttatctagaggatttgttttgttttccctcacttgtctatctctctttcctcgtttaatcaggatggtcttcgaaacaaagagatatttttagctaaattattatgagaatgaagatattttggtatctttttgctaccggtttattcttatgtacatagtacatactcataccagttgtaaattgagaatcttttcttttcttctgtctatggtgacagtctgacataaaatttcataggagaagtgaacgaatgtcaaagaacctctggaagtaggtagaaattaatcaagttatgtaagcaaatcttcatttaaatttttacaataaattcgtgaatagtaaagcaaattctcttccattgtgtagtcatgcttaagacaggttcaactagcaaaatagcaattcagcgttgaattcttcatagtggacgtggacacctctaagaaatgatttatataccagagtaatgaagtgtggccttgaacatcaacttggtcaaagattagaaaaacttgtaatgccttgtaatccccagagtaatctcattaagctttatcgtcctatccaacagtctataatccaaagtaagtggctgctagactctttacacctttaattttattcacctgaaattttgttttggattgattaacacatcataatatggacttataatcggcatgaaaaggaagtccacttctgcatgcataaactacatatacataagtactgatagttcatttcgtgcatgtatatacataaactgtttatgaccaattcctacataggaaaagcatctgatagtaaatcatgatataaacaaatccttgtttttgaaagggattgatggtgaaagaatttggaccagtaaataacaagaaccttacaatggaattgtaccggcatatgctgtctgctcctaatgcttatcagtggcatatccaagttaggtgctcatagctacctataaatagccttccattttatgatgatggcctcagacacaaatttggtgttggaactgtgatacataaaagtgctgttgaggaatgatagagcaaatctccattggcagagagaagtagagggcttgaacatgcatgcttctggtttgccaaaggagatttgccctgccattttttaacagtttctgactaaatgcaatgtgttggctattttctatcttcttctatgactgtatttaattaatttctttcctgtttactaacggttttcctttcaatatgtggtagatggacatggagaagtttcacttttatgagacatggagatcaaaaggatagaaagatagccaacaatcagagattttccaagacaattgccagcatttccagtttcatctagtgtcatggagcaaatgaagatgcttaagcactatactgtgaagttaacaaaaagagaagtttcagttagcaacttcgtttgctgcattgatatttgatgcacatatcttacttcttattcatctcgagaaatcttcaaatgtcaaaatctatccgtcaccatttcagtttaaataaattccatgtgttatttcacgttcaaatgttttgcatttactacaataacaccccaaatcacactgccaatatgagggtttcgtttgtttaacgtttagttattcattatgataataaaactaaaaggttcgtactctaaaattcaaatgtatattgaaagaataaacagactgatgtcgagtataactttatgagcgattatatctgaaggtatcattgtgataaaactttttgataatgcagaaaatccatcagactgattcagacatgatgcccaagcagcatctaagagcctatttgttttagatttttggtataattgattttacacctttgaaagtgattagtatgtgtgccttaattaaacatgtgcctggtgtgtaaattcatttttgcttgtaatccaaacaagcacttttcaagcattgattggacttagacggcgtttgctgcatgccaactcgttttagtttcttctatactgtctttttttctcatttatcccttttaggtccatctagctcaacattattaatggagcctaagttcatattcccttctcaaggagaagttttgctagtacaaaactacaaactagaattttgcaagtttgagcttgagaacatggaaggcgatgaataattttttcaatgattatttttccttatttatttgatggtaaagatattagaccattatagtagcattcatcaatagttaaacagcacttcccgccaactcacaatgtcttaaatataaccactaaaagaaattcaagctttttaattttttgactatctaataagaaattctgatcgaccttatgcaacttgttaagaggtaaaaaattttgcatatattttacatttgtttctgttaaattatgagtagaagacagaaaaagtctgtctcctatctttggaattatttaattattattcaaaaaaatttcttctattattttctaaaaaaaggctttcatcatctggtatgaagcgttgcatctcttgaacttataacttgctagtatagtgaacatcctcacatgaaaatcatagaagaaaagcattagtacattgggaaagacattctgaagataataagcagagactaattttcttgttggtaaaggataaagaagccatactactggtgtgcacttatactttgtcttcataatattagtgtgatcattgccagagcacattgtcgcaagtattgcatccatgcattatgatttctatccaataaacagagttggggctgagcattggtttgtcatgcgaaattaagagttggattctggaaaactcagttccggaaagaaatctaccaaacttgtactttcaggctaggatacaatcagaaaagtaatgtagattaattagtctcttatgaattacgaacttctccctttatatgattttatgcttaatacttgttaactttagaaggtaagtgagggaatacaccttagatgattaaaattagttatattatagtcatcagtcattgattagaaaatcaactattgagatactagccttattgtttatcatacatgtgcatgtgtatttgatcacaatctcaacagttggtgttctaatcaatggctataactatactttattgtttaaactgaaaattcttatttcagaggagttaaatccaactttttacgccttacttcatctcattgtttctgtaggtatcatgcatatagatgacaacttttttaaataactataacttcagacctgcgagtttgtattgatctaatgcattactatttaatcttgcccttccattaatgcagcccctcacactttaaagggccaatcactagtagcagaataaaactttaaaaactgaccaagagcagaaaattgtatcatatataatataggtatttaacttttcagtactttagaatatcaatcgtgaaaggtgaaagaaaaagagaataagcttgctgaggaggaagatccatatgtttgtgctatgccttactttctctcctctgtcgtgtcagtttgttgacaattaatccttcttttgtggtcagatgaacatgtgaatttttaaatctttaatataattgacaaattattcttgatttccatgaaaatcattctccagaacttttggttgtaaagattacagttcacaagatttaacttagtaggtgctgttgccatttcagtatatccaaaaaaaatccttgttctttgggattttacaatattgcatgactgaagaagtcctttatactttattttccacaattattgtatactagaacatcataatgtggtcgaatggtgacattttccactatcagcaaaggaatcccaggaacacgctaaatttgtaaaccgtaggttgccaattccttttctgtgatccatacgcgaatgatatgcactgtttaaggtaaaatagtggagaaaaaagaaaaaagaaaactttatcaagcagacctttaaaaacaatgaatttgagaaagaggaatctaaaagaatcaattcattacttaggttgttcaacttgtgacttcaaataatatgaaattgaccaattaataagagtcaatttatttgataaatctcgtaagaaacacttttacaagttaaaataaatttatacatctgtttctcgaaaaacttaatttttcttacaactgagttgtgtaggttgattttaacttattaaatcattcattttatcttcttaatttattttagcctcctctccaataatgtttatgaaaaatttatctaaacgagtcttatataatatatttcgtttatctaataaatcaatgagggttgatgatatgctgctagcatataataattttaggttaaaataatcaataattcaatcataatttatcaataaaagttaggataagtttaagtttcatcaattcttggtccattacttattttatacatattttgtttaataggaatcaagaaaagaagaaaagaagtataatcaagaaagatttgtcataaaaatagaacaacataggagtttaattaccctaaatataaatatggatgtgcagaaaacaaaggagtgactttttgacaaaaaacaacacatagaaatgcaaagagaaggtggaggaagaatcaaagctaataggaaaggattgaatcaagattggaagcaattatttctcctattgtcttgagattgtttgtttaggtacatgttattcatgtgtttaaggttagttatgagcatgtctggctaattccctttactatggttagagctaaaaccaatgtgaactcctctgtaattggattcgtgttaatataaattgtgataattgttttattttattttgttcttgaataaattattccttattagacttgatcattctagtgagcttctaaggtttagggtttataataggaatgttggagctctaatttctgaaagcattaaaataacaatttttacattacctaaggatagagatgtatgattacagagcaatacatgtattagcttaatgcttaacttaatagggaattactaagaaattaggatttctaattgaattaaagggttaaattactaaggaattaggatttaactaatttatttaaaaatacatcatctgagcaattagaataattgaaagtagtaactaatttcaatacagaaggtagagatcaaagctaaatatgctctaaccacaattcttcctcatcactgcataactcttaattaatattgcttttgaatttttattaatttttaatttaattattaaattttcttaattccaaaatacaatcatattctctttaaaaacatattatttgtcattccaattttaagataacaagttgcgataaaattagtgtctcaattattgtggagacgatactctatttacactttattatttgtaactataggtgtatttgccaatatacttgccgctacgcaacagttgatatataggatatataatatatgagaccaggggccagcctgcatgccttcaagaaaaatattgtagtggttcaaactacactgtagtccttcagtggtaatcatggaaccaaaatatgtgatacaaaaatgatgcaattaattatggaagatgcattattttctagtcagactggcatttagttgtgcatgtttaatttaaagaaaaataccaaactaactaatgaaaaatcataaaatgcttcaaattaagttccaactgtaacgaccttttattaaggtttgttgaatgaggagctttatcacagcaagggggaccatgacagcaacagcagacacaacacaaaggagttcccgaaggataatccgtagcatataccagtacaatcaaaatggttaattggtatacttcacaggtagagaacaattaataacagtgcaaatatactttaattttggcaattactgccacactcttgcttgagatatgatattttctgccaaacaagaatcgcccggccactcagcatcatacgttgcttcacaactacaagccttcttaattagacagcattggttgttctaaattataatataagttgaaatgtacaacttatgattgagttttcctttaatttttacgggcacttttatcattaatactactaggttttagaggttgaccaactacaacatgaaaggatttggattcctgtcacagtcgagaatatgaaccgttaaatctttatcagacggttcttattatctgactgcgtgaatatatgttttctccgactccagagaatccggatccaacatgaaaagtgttttaaattaaaaattttgatccatcctgtcctatcaatataagtattatttttctaaagttaattttgatgaattcatttttaattaaaatttagacccaacaacatattttgaagaaaactatcaatcaaaatggttctacccagagagttaatggcattaattaatgtggtaacaaaaaaagttacattaattttataattcgatcagttatatataatgttaaaattaatatcttatataaataaattaaattgattcaatcttattttatatattattattggatcgaatttgaatttagtgagatgttattgatttttttgttatcatgttataagtgtaaagtattaattaattttgttgatgaataattttcattgaaaatcatgataagacatcttagtggatctttcttttcaatcacattttttctcacaaaactcaaatttgaaacattgcctaagatgtctaagccattccacttggactaatataaggttggaggattaaattttgatcatatctaagtaaatagtcaaaatttccaattagataaagacaaaaataattttgtgctatttttttggtccaaattatagttaattaaaaatgtataccaacacttacaaaatannnnnnnnnnnnnnnnnnnnnnnnnnnnnnnnnnnnnnnnnnnnnnnnnnnnnnnnnnnnnaagaaaaaatatatatctttagtcgatgtgagatctccaacattaccttacatcaaggtttgaacatcttaagcatgaagttaatttgcaagtcttaatatttgtggatgttccaacaacaattcctacgatcaactttaatatcatcttaaaattttgagtttgtgcatatgattgaattttacaaaactgacttgtaatatgatttttaccccctatttatatactcttctttagatatatctttagttgatatgaaatttgcaacattatgaattcaaaagaacatgcataaatcttgcataatcctctactctaagctaattgtaatccatgaaatatgtataccccaattagatggagttattagaaattagtacatggatatagggttatccatcaaatgagatttgaatgacataattaaaatcgaaaccaatgacaatgaagcattaaaaatacactgatttggattatttctttgactagtatagtttttgtttaacgaactgttgatatagatattataatctattttataataaaaaaaatattaatagcagatacgatacactaagatcggcttaattatagggatttaattagaatgatatgcatgaattcataaatttaatatttactgttgtcattgttaaaaaaaattgtctaatgcataaaacctagtaatgcatgcaaatttaatactaaactagtgcattagtctaaaccttgtcgaacacaaaaaaaaggtgcaagtacctttttctcgtttaagatacttgttcacttttgatagcttaaacagtgacgaagtaaatttaaaaacagtatattaatgtaaagtacacatactttaaatctaaacgactattcaccttactataagcaaaaagcaattatgggaagaaaaaaaaaaaagaggacctcatgcaagtcctaaaaaatgaacgtagcacatgcatcaccttctagtttcaaccactacagtgaatgttttactggataatcagatgaatcccgcacatgaattaattgaaaaagagttgcaggagaattgctgggcaaatctcctttggcaggttgcacacacttatagtattgcatagcttgttggtgcctgccaaagagaacttgtcctgtaatgcacccacaaaacaactagtaaactaaagatggcacacattaaggatggctactgggaagattatttatcgcttgctagaacgggtatatcctatagaacaatgccttccattttgtgtttcatactgttttattcctttgtctaggaaccatatatcccttttggcagtacaaaaggaaaatcaataggttaaaaaaatttagagctagcaattttatttctattttcattttttgttttagcttttaattgacaaaactgtcacgtacctcttatatatatgttaatttgattcctattttcaaatatttgtatagaaattggaaaaaaaaaacccatcatttttttctgtatttcctatataaatattttaaaacagaaaatatataaaaaataaggtgacaattttatatattaaaagtaaaaacagaagtaaataaattgactacgaaaattaaattcatgatggcatggtacatacatgttgcattggcgacctctccaaactcgaaaggctttctcttttttctatctctgaaggttaacacatgcttgccggagaatttatatttgtataggatgttaaaatgttaatatttatttattattgttaaccagaatattttttaaaaattaaaccaaacatattggaagaacttgaaaaaatctaaagtaattactgagtaagtaaaagttatgtttaatttaaattatttaataattaatatgaagttaatattacatatcatttaacgtgtgctaccttcatttttctcgcagctgcagcacctaatcaaatcacaaggaatcaaagaagaatcttgacctcttttttcctttgaaaaagaaagagaaagccatcataagcactttggctcctggaggccggcttaagcaatgtaccttttcacgtttcaagcttagggtgaccaaccagaatatatggttttagattttctgcttatacattcataaaaaggaacttgatttatttttggtttaaagaattaaggaatctgaatattgatggaaaggaaaagaagtgcaaatagaaagagaataagcgatgaattatgctgctgcgagaaaagaagatactataggcgaagttctcaagcacaaggttagccatcggtgctatcaaataaataatggaacataaaagttgtttatgaagaaactagaagcagcatggatttggattcttagcttatgttggaaagaatgaaagagattttaatgagttgtatgtgaaacgtatgctctctattcctaaattgcatgaagctcactttaatttggtactgctcctgctttgatgatccaaatctgtaaatgtcatatacgaaaaaatgaatccattgaagtggaannnnnnnnnnnnnttttttataaaaaaaaaaaaactcagtgatacttataattaacacattaatattgttactatcttcatttttaatctttagttgcttaagatttttatacatgattaaaaatatatttaatttatacaactttatatctaaaatccctcatttattatttttcaaatttctatattattttcaacgacttattttttcaatgcaaattttactacgacataatattaatgcttcatcacagtatctcgtaaaaataaaagttattaatatttcactaaaataatcttaattaatgctccaccatatataagggcatagttagaagaggaaagagtaaattatattaatcaatcttgaagttttatagaattacataaattcttcctgttttttaattcctacaccaactcctttaattatttgaaaaatacattacaaataagaaatattttttgtaaatgttaacaaaatatgagttttgtgtaatttcagagataattagtataatttattctagaagaaaatgtcagttacataatggaattttaaaataattaaagttttgaaacaaatacaaaatactaaaataactaaagattggggatgaagacagtattagttataggtttttaaaggatcaattgaatgtgaaaattcacacccaaaatcattaagtcatcttgtaatgatcatcgcctcaaagttaaccgaatgagtttctaattaactacaataactgtttctaggatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaggattttttttataataagaattaaagatatatattagaaattataataaatcacgcactatgtcaattaatgtaattggactcccattaggaaggattgtttatgttaaaaataattagcttatgttaataaaaacagaaaagattgtttataatatatagatttttataatacattatgtgtgtatatatatatatagtttacattttaaaaatatacaatttttatttaactaatcttttaaaaaaagtagataaattttttttataaaaaaaaactgtttattttaaataaaataatttaaataaatacattagaaaatcataagactatttatttaattttattttaaaaaataagattaaacaaactagtccaataactacttaggagaagataattttatttttttaaaagaataaaacactgcaaaaacatttattaggaaagatactgtaatttatcctaatcttttttttttcttcctttttgtcgtctttgattaggtatttttgtagacgaagttaattatgtgactaatccacgaccaactaggagagttatgtatagttagataaaatctatcacctgatgacaacttcatgattcaaatccttgtaaataaaatttgtctgcattacagttcgttttcgttatgcaaccaatcactaatgggttcgttcatttcattttcaccccggtatactgtactaatatgtgtaggtcctcctaattctgagtgagattgtcatggcgcaaaagcagatatggtccggtattcccttgttccctgtattggttatgttcttcatttctcgtcactaataattgacattcccttacttctgcaccaaatcaaaaattattaaaaactattattaatgattaaaaaaagaaaaacttttcttaatgataacatgtactttaaagaattaattgaactacgtacaagtctacaagagctttactgtaattgaagaaaccatatcctactatgctttcctcagtaatgcagctgcagcctggaagtgtaatttctactgctaattaacgttttttacgactggtaagaatcggcatatcctatgggacaatgccttcataatattcttgtgattgtggcctttcatctttttctttcattttcttttatcttttacatatatattaaagataattttgaattgaagtaattaacaaaaacacagctagcagttcaaataaatgcttattcagcacaaacaatgaactttttgtacttcaacttatagtattgaattcgttgacagcaaaaagaaatatttggcaaagtaacttacaccaattatcacactttttttagtactaattattacaatttgataatgactttatatatggtttgaatccattataactttatcttattttattactgtatcaaattttatcaaaattaaataataaaaattaaattattaatattaaataataaaaattaaattattaatattgtagtattttttgtaataaatatattaattacattaattttaatttatataaataagatattaaataattttatattaataatttgtatataaatatatgatcaatttatagaaatttttaatccaatgacttaggatacatgagcaaccacaaatctaatattacattttataacaaaaatcttaaaattcaagtttacaagtcttctttttacttatataatattcaactttcttattcttatatcatatgaaatttcacttcatacttttactccaacaattattattattataaatctcttggacaaatttttatgatcacaaaactttcacttatgcttttaaactaagttttaacatagatgaatcaatgaatataatttaaataaaaggtttgtagtagcaaaaatgtgaaacaaaagagacaaattaaaaatattaagctaattattaaatcaaccatagacgacaaattttcgcatttgaccaatttaatcgtaggagagaagtttcacatgcatgctcttcattgtaatgtacaaattatattaaacacatttcttcaaaatgagatagtaaacacattacttccaccaaatatcttattaaacaaaatgtgtttcgatatctcattttggtggaaaagccaccaccaaaatatcattaaaatatttttttaaccacttgatgaaaatagtatcattcctgctccacatactttcatcaagtcaaagcagaaattaagtaatgagtaaattaacataaacttcactgaaaaatataagcaaaaattattctcagagaagacacaattgatattagagtcgcaggagaatcgctgggcaaatcttctttggcaggttgcacactatgcaagtatgcatgcataattgcatatataatatagcatagtatagtaaagtgccaaagtagaacttgccctataatgcatctgcaactgggaaggtatacgaagcggaatggcttctgggactgttatttatggcttgctagagtcagcatatcctatggaattattctgggcttttcgtatggttatttaatccatagcgaaccaacttcttaaagtgaaataaaagtaggtttctgtaacgtttgtgattgtatggtacatattgattgcattatgtgttggtaaccatccaagctagctagctgtaaaaagttgaaacccttctttccagctacgaaagtcctaaatcagcttgcacaataatttatcttctttttttttttcgaattcaggttggtaaatatatagatgattaacaattattatattatgaagaaaaaaaatatcttaatttgcttttctatatgtagaatttaacaaattttgtttcattattaaccatagttggttaaacaatatatgtgaatatattgttataatttttttatccttagtttgattcttatagatttttttatatataaattatttgattggaaagagtggtacagagaaggatgagaattttggttcttaatttgtttacatataagctcagaaaaggacttaaataagataattagaaacacatggagactctttattgtataccctttgttgagataagacctatttgttacctattatttaaatttatatatccttttcaacaatgaggttagtttttttcattatattaatatttctctaattaattaagtgtagccttattttaaaaaaataataaaaattcttcaagaattcatgccaataaatagattaatataaataaatatactgatatgaattaacgatcaaatattttaattgtaatatgttttatattaaaaaaaaatcaagcaattttttgcacaatggaaccaattaaattaagggtgttgatagtttataacatcctgcttgtgtgaattttttttctaccacaaatgtttcaattatgcttaattaattctatggtgcacttttaacataaggcaatttttttgccagagtgaaactaaacaccgtctgtaagttgtgtagaatctcaaacaaacaaagannnnnnnnnnnnnnnnnnnnnnnnnnnnnnnnnnnnnnnnnnnnnnnncatatagttgtgaattcattctttaaatggttacattaacgaatgctttaaagatattaattaacgagtatttactatattctattaaataattttaattgtttaaaaataaaaatattgaattattttaatatatttgatatgataaatatttttcaataagaatttctattaaattaattttacaatcaatattcttaggagattaatttgcgttgtcttttttcataagtgcaaagttagatattaattacaaatatgtcttttaaatactattgtaggatacatttaattttttttataaccancatatagttgtgaattcattctttaaatggttacattaacgaatgctttaaagatattaattaacgagtatttactatattctattaaataattttatttgtttaaaaataaaaatattgaattattttaatatatttgatatgataaatatttttcaataagaattttctattaaattaattttacaatcaatattcttaggagattaatttgcattgtcttttttcataagtgcaaagttagatattaataacaaatatgtcttttaaatactattgtaggatacatttaatttttttttataaccattgtaattaccgtttttccttcttagtaaaactctggaatatctttataagttttggtccttaattaaaattgattatgagactaattgttgatttgaagtgtatctcatccctatttaaagatgtgttttgcaaaaattgttatggaacaattttagcattcactctcaacggattatgagtgatattatttcttttgaagtatatattgggtggggcacattgcatatgtacaattgtgttttgaaaatgttatttacagacacctttggaatcaaatgccaattaataatattttttttaccttttaaaaaaaagaattaaatttttccctacaaatttaatatgtattgtcaactgaatcatatcattaaatataatgcatttaattaatacccacaaacaagaaaattcttactaattttgtttgaataaattaaaagtgataaaacaaagaaacaccctgatattatatattgtacaagacatgaactcattttttatttttattatgattatcaacgttccaaacttacaatcttagctaactcgacatatatgtagttattaattagaaagtaatatatgtacatgttgcatgttacattaagaatttggctatgcaaaagtgtgtgtgtgtatatatatattatatatatatatatagggtaaatattagtgtcgccgttattattgttcgagtgcatccttctttggtttttatttctcctctcaaataaacaataaaaatttgacattttcgttctatatatttttctttttgaatttccttcttctctatttccaccaaaacaaacttggaggcaaagaaaaacctaggcacactggaagcatttttaatggacccaacttatagaattatgcccacttgtttacttacatatacaagccgatcgagtcaaatctggtcttacatttcccttgctgtgtaaccctgtaacgtatttaacgatatgtggcgaacatcagatagaatagaataatcaaagaaccaaccaagtatcgcagaaaaatattcatatatacgtccttttatatatgaacatgaacctgttaggtcagaatatagtacctttcaacggagagtgataaataagaatatatgttttcagattttgtgtttatgcattcataaggaatctaattttgttggaaagaaaagacttactgttataggtagaaaaaagaatagcacgattatgctgaaagaagatactacagcacattctctttggcttctacacgcgatatttgatatcggtgactagcaaacactattatatattaattgacccaaaagttgtttatgttgaaactagaagcagctcaaaaatttgattgtatgcttgttatattcgtattggagaaagagagccactttaaccaatttttatattacaaaacttatgctcactaagtgcatgaagctaagcagtactttaaagccctgattaagatactaattaactaagaattccttattacaaaagattgatttgacttaccccatatatttacctaaatcttgattacacacacccaaaaaataataataagtagctttggcaactatcttctcgatcccatcctgacatttgttcattcctaatatataagggaaaattaattttttaaatattgtttgataatgtttaaaagaaattagaaattaaacaggggttcttaaacaatatggttagagcaactctaaccccagaatattcagaagttacttaacttacttttattaataagaaacggtcacacttcctattgcagtgtgggagacttacaacatgtaagcaatgggagtttattcaaggcataaatcaatttttttttgaaaggcaggtcataaatcaaaattgcttgccatttttgggtcccaataaaaattgacgaactgaaacaaaaaataaaatgagaggaggcacatagtagtgaccatgtgaataaaaacatgatcatatttctatttatatgatcatgtgaataatatgatagtgtaaacgtagttttcaaaggagagatacaaagatgcaagataatttgtctggttcaattcataaactttttaattaaatattttagaattacattactaaagggagaaaaaaagttacttaaatgacaaaaaagtaaaaacttatgcaattaatgtgttataagatggattcatacaaattataaacaaaaagcattctaaccattagaggtctcctatatataaattatgcacttactagtcttttttttgtgttatgtgaaagattacatttatcttcccattcactaaattagaaactaatcctgttttcattatgagataatcgctgattcaaaagaattttatacacaaaacaaatcaaatattagttttctcactgaataaattgtttttccacgtttaaatacaatggggcctataccactttactaatcctgtggcttgtgggttattctcctgctggtctatactaaccaaaatgtaaaataaattataaaatcataatatcgacttcaccgaaaaagatgctgggaaaaatggtttttaccaaaatacaaaacaagggaaatatggcatatgcatgaatggttctacatgcaacatttcaaccagtacaagaaatgtttctaatgaatggttgaagaaactaacgaatactgttttcatgaagcagatgttgcaggagaatcgctgggcaaatctcctttggcagattgcacactaagaaagttgcaaatatatatgagatgcatatcatagtggctacctgccaatggagaacttgccctgtaatgcagctgcaactgggaagatccacacacacacatagaggaatgcctttggaaacgttatttatggctcgctaggatcggcatatcctatggaacgatgcctttattttgcgttgcatgtgtccttttataaggttttattcttttgtatgcgaaccacatcctttatggtgaattaatttttacattgaagtgctaaccggcaacaaaagtgaaaagggaaaatgtaactttgtttctccaatttttgtgtgtggtacatatataggttatattatgcgttggtggccattcaaagctgcaaaagtcgaaatcccctttccaaatatgatattcccattacaccaacacaacagtttatctttctatgtttggttgttaaacttgttatatgggattaaaatagaatctttgattaatttattttgaaaaacaaagcacctataaagaactttccttttatagctcttaaacagagtttaaaaaattagtattccattgttgcaatcttttgcctttctaacaaatttataggaagattggaaagagaaaaagcatcagaggcatccttttaaataagaaaatacaaaaagactatagaaactattactttacaactgacatgaaaatattaatgacttctttcatttcatgggatctctttgattttataattgccaaatgatcataagggtaattattttcataatttcaataattaaatttaaaccccatgaccatgatacacagctaggagtgtctgctagatctctttctgttatctgataatttcattcttcatgtttagtcactcagtttcttaattacaattttttgtagttaactaagtggcacactcaaatgaaagagattgagttaattaatattcttcctcaactttttttttttgttggtttaagatgtttacttgtccacgactattgggagtcaaattgtcacaacaattaattattgatagacagtagttgtgattttattttttatctaaaccacggatattttttaccggagtcaatccttacatattgatatcattttaattctccttagcacacattgaattgtgaacaatatggactttaatgctagcatctaaaataatttgtttggaactacatgctgttcaatttgcataataatttgtaggagtgacatcattatattcatctagaaacttgcatgtggaaagtaaaagtggctactgttttcgaatggggaatatgtttcattggattgtgaagtcatacatccaaaattatacatagatacataaatatcttttagtataaaaagacttatttccatggaacaaattcagttggttcaacaggataaaaaaaaaacaaatacgttatgttggagaaataaacttactttccaaaattctctcaaacaaattaatagaattaagtatttaattatttaagatgagttaactcaattacgcacagaatttattacgagcagaagcaacgtactgctccttgtttaagcatctaatgtttacgtaccaaaagattactagtactacttatgtcaaaagcttcacgtgatcgatcaatcacatggtctttggacagtgaatgaaatacgaatttgcatactgagaggaggtgggtggtggaggctagggagtatttattgagcctcacctagaagagtacatacaatttcagtttcagttgcatctctcacatggcctctatttctatagttttaattagatcccttagattttagtatgttgaaggaaatataggtaattgataatggagtgtaggtgttgaacagctttgaccagaagggaaagtttttattctcgtactattcaacatttcaaccctttgttttacttacttggaagttgaaagagatcatacatacactttaattatattaccattattccaaacagaatagacattacatgaaaacaaattctaaaggggagccattatgaaggtattttgtgaggtcttggaccaggttaactttctggttctttcttcgtggaaaagattgtagaagttgccaattaccacaatatgttagagtccggtgtattgaaattgtgggaagttttgatgaactttgaaattgctagaatagtctttcctttgtttcttggcaactgctcgtatagttaaattttgtagtatggataggatataacattttaattaatatggatatataggatatctcttatatagttgaaaactctcataaatactcatccacatttcctttcatctcttgcacattattgtgcaaactcttccttaacaaaccaaataaatgcaaatcctaaagactggccagagaaaaacaattaaaattaaaggtgaaatattgaaattgcattcatggcaaacatatatatatatatatatatatatatatatatatatatatatatatactattttcttgcaactatccccctgaaattaataacggttaaaatgttaaactcagaagatatataggcctgcctgaaaagcatgcccattgccaacaaccctaaaaggatttactattacctagccagagtaacttcatcaaacgtcgttcagagaggatgagagaggaagccctgcaaatggaaatgggaaactttttgtttttgtattaaagactataacattgcaagtagtggatcaattaatattaactcaacgagttatcgtagtcaatatgcaataaaacaatttttgttttgttatgatgatacaagagtggaatggaatgacaatttgtgtcctttgttaccatctagtttgcgaactgaactccatcatccagctcctaatctagttatgtaaataaatagtttctaatcttcttcaggggactatatatatataaacatttcctcaactccaattttatagcaactctaatcttcttcatctctttataaaggtgtttatggttttgctgctcctcctctgggccaaggcgaagaatttctttaatttctcagggataatcaaagagatgaagaaggatgttcatgcactttactggtcatatatccttcttcatttcttgaatatccatgaaaaatgaaagaaaaagatgggagtagcgagagacctcgtttggttactggtgagaaagggttgttgagaattgaattgggattaaattcacgggggagagaaaacgggagtgctatgactgtgagggtgacgtgagattgaatgtgagtgatgaatgcatggaacccctaatcgtgggtatttattattgtggaaaattaatgagagggagagagcgcgcgtggtgaatgtcatgtctacttgtgaaagagtagggcacactcataattttttacatttacatcagcatttaatatctctcattttttttttctttatctctttttagtacatcattttttcatttttctctatggattggatatagcaatattaaggcctatttcttggtgaaagaataataatatttagacatttttaaatatcaaacacctcatcaacacacttaatttattttaatcttttttagaaaaatagttgataaatacttattttactataaaagtatattgattaaacatttaaaataaaaaaaaatgtttatatatatcatcttttttttttttatcatcatacatcattttaacatttcgaggcagctacattaccgggcaattcccgttttgggaggaggctaccccataacatgtaataattgtgatgctctaacttattttttatttaacaaacattattatttgcattctgaaaacaatgattacaggttatggtaaattattttagtttcctctagttaattattttacacagccgtactctactatatgaaaactgtgtaaaatattgacaaatttatctttgaaagatagaaatttaaatttttgtctttaaaagaaaaaaatacaataaattcatcaattcgttagcttttgtctgtcaatgaaagagtttacataatatatttaaggacgaatttgtccgtgctttacacatttaaggatgaatttgtgagcgttttacacaaaatataattcaatcttcatctccctttttttaatcatttcaagcataacattataataaatactaaaaaaatgaaagcaaacaaaagttagaataaacataataataagcataatattgattaatatttataatttttttattgctctaaaatttttattatgacaatattagatagtgacaaaattaagttgagtctcattttgttgtaaggcttaatttaatgattatgtattttaatttgcttgagtctcatattttggataaggtattgtctcatatttttgctttaaaaattttaatgtgacagtactttatccaaaatatgatactcaaacaaaaatgtaaaatcattaagttaatccttaaaaaaaataagacttaatttgattttgtcactacctaatgttgttacaacaaaacaacagacatattatacttatgaatcaatattgaacttattattatatttgttctatcttatatttgttttcctaattttttaagtgtttattgtatttttatacttgcaatgattaaaaagggagaagatgcatattaaatttttgaactgacaaattcgttcttgaatgtgtatagtgcttacaaattcatctttgaatatgtcgcgtatgttctttcaatgacggtaatagacaaaagttaacgaattgatgaatttgttacacttttttaacttttgaaaacaaaaattttaattttcatattttgatgacaaatttatcaacactctacacattagaaataaaaatgactatttaatctatattatattaatgattccgtgtatccgcacatgctgaatcccgatcagctggtttctttgtttgcaggtctgtattattaaatgcatacatagtttattcaacaacaaaaaatgcatacatagttaaagtcaaaatataaaagaaggttcatcattttaatacgagaaccacattttttacttttgtacagtgtgggatacggacgatggacccctttccttgctacgttttctgctaccactgccacatgccctcccaactttgatggatccggctcattgagttggtttatttgtcccgattccatcttattggtgcctttcttgctttatctttttgtttaatctgacatatatatatatatatatatatatatatataataacgcagtccggaggggaaaagataaatgagttgttatttgattttcatttttattttgttcttatttaactttagttattgattcttttgtttgtaaataacaccacaaaaaagttgcatagttaatgttggagtttttgtttaagagtttttgtttaaactctatgagttatgaataagaggcggttaacaattcaaaatagtaactacttataaccgctcttgggaaaggttagaaaaataactactcacaaccgctccgataaccaacggttacgatggtttatcgccaagagtcgcgatggttcatcgccaagagtcgcgatggtttactgacaactcttcaccagggttgtttgttgtctataaatagacacagagacagtcagaaaataggaaggagaaaggaaggagaaaggaaggaaaaaagaaggaagtagaaaactgatagttaacttttctgatagtctcgcttagacactagtgcatttcatatcacataactctgtggttcctcaagcattgtctttgttcgtttgggctgttgatttgaagtgccatcaatcttcagacgtgatccgttctatcctgtgagacaattgttcattaacctttggcatcaattggagggaacaaattgtcttaaggagacaacattgttgggctcggatcctttcatctctttgcatctgtttctgattcatacttatcatacaggttctatttaaattgttttttgtacagttgtagtagattatgttgttcctcttgactactcagattctgacccttgtgcaattggatatattccaattctaaattaactaatagttccaacagttaattaacaagtaaataacaccaacgaaagtaaatttgggcaaacgtaagcccatcagttgttaattgaaaataggctcttgtttgtacctctatttcattccggaatgcaaattacatttcggaaaggaacttttcagaaatcaaaattgcaggaagtacgatccctggaaaatacatacacttttgtcatgatattgggccaatatgagcccatgagttttcctttctaattttgcttctctttttaacattaaaaaaataatttatgcctattaagctcaacctcaatcttatgaagaaaaaacaagtttgggcctgtgtttgagcccaacgtgttcggtcaacaaacaaacagactaaaatagcaatggagattagagaccgcaattagagagtgcaagtggaaaattaaaattttaattcgcgattaggataaccagaaacttaacttgccctataaataacttacacaagaatgcctcagttttggggagtgaagtttttttcatccttttggcttttagtttcagtaactaattttattcaaaaaaaaatcttaagatttcattttatgctagaattttctgtttgttcctaattcctaatttaggttaaattcgtattttagtattgcataggataaatatttattaaaatagattagatattcgaaaggcaagtagaattaattatggaatttgataaattagaatatatgggaacaaacaaactgtggaattttgtattgacacgattgcttaattgaagtaaaaattattctgaagaaaaaagaaatagaacaagaactaattgtagtgtttagattatttttcaaatatttggctagaagagcatattttactccatggataaaaaacatttcatgaagattaagaggcatacggagcatgaggggtttttatcgttatggttggcaaggtttgttttacctacttgatacccagagtgactaaaacatagctctaacacattgttttagcaagtatttatggggatttatgtttactgatagtcaacaaaatcaaaattgccacaaatgtttattactttattcttttcttcacttttatatatagaccatgactatactatttaccttcacgacttttactttcaaaagtgacgtatctataatggtgaacacaaacaaagattccagttggtacggaggatttgagttgtgtggatggtttaaatggtaaaactcacatgatgcaatgatggacatgaaaatgataaagatgtaagaagtcttgaagtacaagatgaagaagctcaactctcttttggccaaggaaggtgggtggtcgcaactagagacccctaaattaaacaccaacatataggacccttgcataattaaacacctcttcgaagagaaacttaaattggggagtagaaaatgttggttgttcacttcaatactttctatttcccaaatgacacgattgaaaagatagaaaccttatgtgtaaaataatgttgcataaggataaatatatcatacgcaatattatcgtggattcgaaagtttgaatataatactctaaagactagttgttttcctaaataattcaaattacaagaacaaaataattttgggcgttttatcttgtgttgaaagtgtttcatcaattgtgtcaaagaaatataaatcaagctaagcaatagtttttaagaaaaatgtatgaataaagataagtccgaattatgaatttgcatgtaataattttttttccttattccaattttaattaaccctaagttaatgatttatcactttaagttaatcaataacctatggtcaagatttgaaaatactcttccccctaaattaattcacaattagtcatttggaatttaatttatgatcagaaatgaattatagaaatatttgaaaaaaagatattcatgccaccagtttgatcatgtaagttttatgaaccttatgattttacaagtcagttaatcatgagtaaatggtcactaacatgtaattaactatgaattagaatgatcaatttcaatgtaaaagagaaacaataaaaaatacgattaactgaattacattagagaactcaattaaatatgaaatcaaagtacatgggtacaagtacatcataattcaagctctaggggtttagccaatcatgttcacaatatagccaaacatcaaacaaaatagcattaagaataaaagagatcgaaaactcttacagattagaactctaattgttcctggtgcagctctagaattcagaaaatccttgttgtttaaaagtaataaaaatataacctaaaaatgtctccctttttttctatttatactattgacaattaaataacagcgccgaggtcgacaagggtcgtgctaagtcaacatgagttgtcctaaggacaacatggttgtggtcaaatgtgtgacattgattttgatttttggttctgaaacatcatgtgtcatgctattagtagtatggtcattcttggatatgtgaagttgattctgattttttgctctggaacatgggtcgtgctcaaatgtggggtgctaatgagaaattttcttggaaaatcaacataatcatgctggaatagcatgatatgtagatacaacacgggtcgtgctctttaaagaagatcataactatttcttttgaatttttttctcaatttatcatctttctttctcaattgttcacacttatctataagttcttataacaaaataaagtcaaaataggataaagtgggaaaaaaatgggattcaaacatagtcaaataacgatttatcaaaatcttggaagttttctcttttctcatcattatcacaccttttgcaagtatactaaattctgcaataattaattagtaagtaaatatatagttacaataagagcatctttagtggtagatctcaaattgggatcttagaccactttttggtagatcccatagtgtcatgtaggattgaagatctctcaagatctctcctattttgttctttaatggtagatcttattttgagatcttagagagagagaaagagaaaaaaaaattattttttttgaacaatatgcagatcttaagggttcttctacaagaactcattctccatattggagatctctctacatcctttattgggagatctagtgaagaccagatcttaagctcaagatccttactcaagatcttgcactaaagttgctctaaggatatgtgcaatatttaacaaatacacaatattcactatctagacgatcgaaaaatgtatttaatatgaacaaagttgaatgttataataatatatgcaaaacatcgatttttcaataaaaggacgattaatcactattttaggacattatgtttcgtaagaagaatgttatatgacctctttatgggagattggtaatatttttttatggaaaatgttggttattcatgtgaaacatgtttattgtctcctttggagagtttttagaagacgcaaggtaagattcaaaaacagtagcatgaagaggatcacatattatgttgtgatgtatattttacacttgcatacttcttattgtaatcaagccaatagggttattagttattagttatgatcgttggtgaattcaacgctaaatagtttaacttttcttcccgttatatataaatgtgtacccgttcaaattaatgaaataatcgaattcctaaaagaatatcttttaaggggtacacaatttactactaaatcctaatatttatataaatcttaccaattaattctatcattcaaaccactctaacgccagctctctgaagtctgatcagtcatttntatatcagcattctaagttttcattacttctatattattgccggttttttttttttttgtgcttttatttccttacctctcgaagcacaaaccaaagacatgagcatgttagcccgtggaaaggtttggtggtatacaaaatattgctcccttattttgagcatgtgagtctagattccatgagggatataagcaaatgaaaagcatagagcttttagctagaagccaatgaataaatacaaatctaacttcctttttcccattcagagagagacaagtcgagcacaaatggacaactgaaaccaatggaaggatgaactttttgtcatcggtacatgagaggatatatgaggagacactaaagtagctagtcctctttcacatactagctcgcagccttcaaaaaagagaaaattagtgcgtacaacaaaacaaggctaataagagcaatttaaggaggcatgcaactactaaaatccaaactttctttttgccttgtagtgctagtgcttgctagtgcaagaatgagatgattcagtagtggacaagttctttccattgccttttatgctggttatgtgctatgtgtttgtcatttctagctctagagaatgaccagccgatcccatggtttattccaaacggtttccttcaacttggattaatattatatagctatagcacacatgcacacatcctgcattttatatatgtgtcggtctattaaataatatttaataattaattactaattccttaaactccttcctttatccattgatcagtgatctatctctggtttagtttagctacatacaggcatggttacagaaaattaaataattatagccgtgcgagtccttaattatatatataggatacccacaaattaattataaatctaaatcaccacaataattattttggtgttacaaactacttgtgatctggctgtcacaaaccaatcatgtcaactacatgacatttatgttgtgaattgtgatataacaagtagctaaccctaattgatttaataaattcaatttaaaataaaaaaaattaaattataatgccaaatacttaattactaagttcctacttggaaaatgattttcttagataagtttgcaccaattaaaaatagaggatgcatttgcgaatgtgataaattatttcttttcacattttttaaagtgcaaaaataattcatagacacctgtatataaatctaaacccagaaatataaaggaatgaaacagaaaaatgtagataaaatataccacaatatgatatgatgagagaaaaaaaattaaaggatatatcaactaggtgtatgtaccgaataaatgtccatatatcattagtccttaaaataataataaaggaagagggaaataataaatataatgataacataataaaaaagagaggagacaaataaagaaaaatacaaggtcagtttaaaagttagtatttgaaacttgaaagagtagaatattgttatctataaaaaaaaaaaaagatttgaataaaaccaagtacaaacatgtatgtagatttttttcattttaaagtgcgtgcttgttaaattcattcaaaagttaaaaatcgatataagtgaaagtcgatcataactactaacttcttactaaacgtaaaaaattacatatataatgtgagattaaacagtaaagacatgatcagtcattaataaaattaatagatattttatagtgatattatgaagatatataaaagatacattaaaacaaagaatataaagttttaatattattattatttggtaggttgaagaacctaatttatactttaggaattaattgaagtggggtactagccagcgaatctggctgtgcagaagtcggaaaagggaacgatataaagaataaaacagaaattgtgtcagtacatgtgatacaactgtggccactagctagtgaaggtttggcatgggaagggatgcaaattgcaatggaagaggtagagtagagagagacaaaggcaaatgaaaatgaaacagaggcccgtgaagggtgtgagtgatatgcatgcatgtatgcctcattggcagtcactgatattatttctgactgagaaagaccatcctctcttattgtccattggttcagttcccacatcccttcccatgcaaattttaacagtctcctaatcaagaatatgacaactatatcatccacctttttatgctcccccttgttcagtttctgtgattcgtaccaatccctttcaccaactgtgctgtgtggtgataagggctttgtatctagcacattgagaaatgagaaataaagtagtgtttacttggcttagcttttttcatttacaatgcaggtacatatatctcgagaagggatgtcacttaaatcatgaaaatctattttactatgccatgaatttggtggttcaaaataaaatgaaacatatactttcaataatcagttaatctcgatcgggagtatgataaaataaaatgagataagcgaaataaagaaattaaaacagaataaaaatactattaacatactcaactccatgtgtttaaagaatttaaggtattagtcacttgtgttatattttatggattttcttttattaaagattatcactcattgcttgtaaatgagaaatttatgactactgattctgtgctaatgaaaatcccatcatttcaaagagtagaagtgtacgtataaaactataaatcattataaaccttgaataatttttatcaaccttaattttttatgttcttggctcttctttttttaatatttttcaataaaaactatacattccaatataaatttataaaaaataatttaagtaggcatttcaattacgtttaataatttaaaaataattttattaaaattgattttactcaacaaaatttagtttttacacctatgttatgtgacttatgtctctttgtctctccactttttttatcattcacagtctcgtcagtggctttctttttcccatgtcactacgtgtaataggtgtggaggtgtcagctagtctttatccaaattttaatttgggttcttatcaaagtagaaatggactatttttatgaattcgaaaatggcaagaatccaagacacatcactccattcaccagctataaataccctgccaaagttaagtactcacaaatcacaatataacattcacattcactagagaggaagataaagttatataaaaaatactgctttacagaggagatggcttgcagggtgcagaaaaggatttcactgcgcagaaaacttcacattgtgcgagtccttacctactcaaactctgtaatgctatctaacaccatctattgcaacctcaatttctttcccatggtctcaaattgataataactatttttcatgcaatgaagtaattgtttctgttttgttttgaaggccaagagaatctcccttgccaagagtaccgttctacgcttatacaagctaaagctcgcactggaaactgtcaaaagacagtatgaaaacctattagccaccagaagagactgcattagcctattgaaccatgtcaaagagaacaaggtatgcttattctcctaacctttcctcaaaggcacacattaaaaacaaggcctatatatagaaatgaaaatatcctatcatgaataacatgttagagattagaggttgactagtgatatgatgaaaatagtacatacaagtgaaagtccaccattagctattttagaatttaggtttgaatctgatttaattttaatagttaacttataaggtgaaaattgtctctattatatgcattattattttgattatatcaccagttaactgaattcgagctattttaaaattttagtttgagcttgatgaattcaattctaaaagttaactaatagagtaagagttgtccttatttatattgcattattttgatcatatcagtagttaacagaacatctttatgcttatgatagctaacatgatattgaatatttcttatatatttaatgttccaattaaatgaaacaggatgtgaaaatagagaatgtaggggcaggaacttttatggtgaggatcacatgcgagaaacgaggtgacaatctggtgtctattttagaggcatttgatgagatgtgtctgaatgttcaacaagcgagagtgtcatgtgaaaatggtttttctctggaagccattgctgtggctgagaaccaaacgctggatgtaagagacattactgaagcgcttctaaaagctattggaaagcagagtggtgaaaaggactcgcagaagtttgacaaaggctgtgatttgtaacttttttaagtactttaatttgttcaacatcttgtgtatctcaaactagttaataccaatgtcaagttcatcttttatataaatcatattggtgacatgggaggggaaaaaggttgagtaaggctttccattatcaagattatatagtgtgtttggggtggcagcacagtggaaaaagaaatcgtggccaattccacggtggagccacagcaacacataattgcttctcaaaattcacggtgacaccatttttttgttcgaaaattgattatgcgccgccgtatctaaacacatgatcattttcctactttaaaatgttgattcctaaccaaatagagtggttgagtatgagagattgacttattgatttacctatcgtgccttttgccaatgcacacaaaatatttcttaacaaacggatcatgaattcgtgttcataattcacatttttcatatactaacttgtaggagaattagatatcaatttgttaacttctgttgtgaatttctgtgtttttatttttttgctgatcttaagctataaatatctagaatttgctttgtaactcgcctaatctgaggtgaagtgagtagagatccatttagaggagataaagctctttctgtgtcaatttttttttcattaaaattcctttgaaaccagattttagactaaaattttccttcatatataaagtgcgagggaattagagaaacaacagtgtttagttaaattgatttttgggatgaacgaaatagagtggagtgatgtaggagagatgttttatagggaaaataacaagacaacagcataaatacaatagcacaacatgcaagtgaaaaataaatccctcccaatttataagaatttggaaataacaacaacaaacaaatagctggagacaaaagaacacaaatatacaagaaaaattaacaatacaaaggtaaaaatcaaaagccattcaaaccaaaaataattctacaatgttcaaataaaaataccaataagtctcaaaaagggttacaaattgtacgtttataatcggctaaatatatgtcaatgcttacaaatgagaaattacccaaaaaacagttattatgcaattcaagctcttgaatatgcaaacatagttacctcaatccccagtccaaattctgaaaaacaagaataacgtgtcttgaatctattgctcaaattttaaccaaattcaatgacaaaagaatcaattttatggtgactattgggtgcttatgagagttttcttttcccttttttccccctcttttattggttgttttttctcttgaaaataagtctctacatccttaacatgaaccatcttctctttttgataaaagtaactgcgtttattattttgacttacaaggtagaattgaaagtgattacgagaaaattgaatctaatccaaatacattctagttcacatttataattgtcctttcattcctcatgttacactcatgttggggtacttaaattaactaattatatattcaactggttatacctaattgtaataaattatatataaaattaattatgattataattataatgagaatttagagcatctttaatgaaaaatagttatatggattttttagaatttcttattatctttttgtgatttttatagtgtcatgtcactcataagatttcttacaaaattttactctaatacaaaaaattataacttcaaaaaatggtggtgtttgaaaaataaaaaacgggataaatgattttttctattaaaaacctaaattttttctaagaaataacttcttatttttagaaatccaccgaacatctctcattatatgcccttataatctaactatttattagttatggttatcgttatttgataatcaatcatgagcatccctacactctagctttcagtcatttctcagttatagacgggtgtggattagctgcagtcggaattaaaaaggaagctcaatctctacacttaatcagttaatcttattattcaacccttacaaagctaatcaaaaagaaaaaattgtaatccttgtatcgtaactgcagagtgaactcactcaactgtgggaaagttaactgcaaggaaaatgtttatgctaagagagataaaaaagaaaaaatggaataaaagtgaaatagaagaaaatttaaacttattatcttctccgcccatttccatttcctatacactgttatctttatttcttatttattttgttaaggtctgtgagcactgctcatacttcgtatgttctcttgttgtactttgggttgggccgagaggtataagtcttgtaggggtgccaactttttttatttaactacccatgcataatgcatgtacatgttgggcatgtacatgttgggacggccaagcttcgacatctttttgtataagtcttttgttccaattttgcctttaatttcccataattatttgtctcaagtcttaacaaaaagagagagagagcgcgcactgagcaagacatcttttacgactgcatatatccgttgatgacgggaatggatgatattataaaattatatactcattattttttgaagagtatatactcattattattacagctgctgataataactatatacttatattataaattttatatcactaaatttacaatataagatataacttcttatgggctaaaatatacaaatgactctttaatttatttttttagttctaaattgatcctttaacgttactttttttttgaaatagttctcttacttatttaatttataataagttaatcatttcaaaaaattgttattttttaatttttgaacacaattttaaacttttttattaatcaatacatgaaatttgttcattatatttatctacataaaaattattatgaaaatcaactaatgtttggacaaaaacagacataaacaaaatgaaaaatacaaatacataaaaattaaatcttatgattaattgaaaatctaaaaatcaaatattatatttttttattatttatgagactaatttgtcacgtgatttttaatatatttatgactttttatattttgaatattagttgattctcataatatttatgtagttgaatataatggaataaatttcatgtattaagtaaataaataaaaagatataaaattatattcaaaaatttaaaatgataaattttatgaaaagactaatttatcattaattaaataattaaaaatttaaaaattttaaaaattaagaaactaatttaaaacaaaaaatagcatgaaaaattgattttatattcctatctaatttatgagtatataacatatatttttaagggacaagaatttaatgatgataaacatataaaatatattatcattaaatgtctgtcacttaaaagacatgtttcttatagtattattgataaatgagtaaaaaattattgtaatttaacattgaagaacatttcaattttaaattttttatttgaattatctttgacagggttgagagcttagattaaaaaaaatagtaatgttcacgttatcgtatttatggaaaaactgaaatcaaacgaatcaataataccggtggaaaaatcttcaaatttaatgcgacttacaggttacacgaatcatgattctacagggcatgtgagttacattcaattggtttggtacaaagtcaatgagcatggggatcatcaaattggcattattctttgaaaactcgaacaatacacacttggaggattgaggatatcatttactattaattaatttatactacatggcttcaataaaaagaaaaaaaggaaataattttcccaaggaagcaaaacaatcaagcaacctttgtcaaagtttagcttaggaaaaggacaaaaatgaaaaatgttcagcgtgtggaagtgagatgttttgatgcctcgtctagttcagccagtaatttatttaaaggtagcaaatacttacccatccatatttaaattattaatttgataaatgaagaaataaaggtgttaatcaaaatgttgtaattgatgcataaaaatgcggtagaattaagtgggaaattatatccagttaattttagaattttcattgtttacatatttataaaagattaccccgtacaaagagagggttaaattcaataaaaaaaatgtagttaaaattttgaatttaatacatttttttgtatacatatatagagattttaattttatgaaatgttagcataaacttttaacatcatctactaattatgataagtgtgattatatttttaagttaattatgataaaaatcaataaacttacttacaagtgcaatcagatgataatgtaacaagtttttatactatcaatagatttactatttattcaagtgagaaatgaaacttataaatctgtcatataattaattaaggggtttgaaaaatgaaacgaataaatggagaaatttctgtttcttggaaggtggcggtgacatcatgatgagccattttacagggcaaaataatatactgtagtagtaatgctaaacgatcacatcaacaacaaaaataaaagttagaaattcacatgaacttaaggataattgttgtataaatataaactactccattaaatgtctatattatgagtcataagtaggccttcgattattttggaaagaagatttagattatctcacgatcttttgtaaaataaacaaaagcgaaaatatataagatatccagagaaggtagtatataataagaaagaaatttatggtggagaataatgtgcatcactaatgccgtaaggaaaggaagtcaaaatttggggaacaagaaacctatcaaatacattattttttcccccgactcatttgtagattgatatagttattatttttctgacaaaatgtagaaaataaaaatggattgaacgagtttcacaatataaaatttgggttgctggagataataaatgatcaataatataaaaccagttgttgcattgcttcacgcttttaggcaccttagaaaattgatttgttttctggtctttgatattttttatgtaacatattggccaataggtacttccattccctttcacattacagagcgacagatccagccataagtgactcggtcaaaactcaaaactaatgggatctgaatattaaatgatacgtcatgacaaaaatgaaaatgttatttaaacttttcgatagctacccattctctagaatttagatacaaaataaatgtgatcatataatcatcaataaataattaaaggtatattaaacaattttgggggtggtgaccgttgtttagctcagttttgttgtttttcttccttttccccctatcctactaattaacaaatgattaattagttatatagttgcaatatgaaaactgaaaagtggatctgaactaagaatatcccttttatgtattttctcataattctttaatataattaaatctaattaatttcattcatatttaatgatattattaatattccttaaacatctttcatttaattataactttattttcaaggactttattttattattgatatcaaattttaataaaggatgttttagaaataatcttatttcctacttaacatttataaaatgaaattatttcaactaatcttcttaatttatataaaaataattatttttatttaaatatataagtccagagagaataatatgtaatcttatatacaacccattcataatagctttagctaatgagctctttatatatagtaattttttctttatgcattttttaacaagatggagagaaagactattaaaatacaccaatagatataaaaaatgtaccaattaatgtggtgaaaattgtgagacttaaggagagatagtagattatcaagtgagtgtccaaaatgatcttctcattgtaccactaagttggaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaattgttaaagaacattttattttgtttttattgtcgtttattcgcattgatgtaaaactccacacatatgtcagaaaaaaaaaatcattcttgatccccttattctttttcgtttattcgcactgatctaaaagtccacacatatgaaaaaaaatcgtccttgatatctttattcttctttcatgatctattttctctttaagattttatgtatacgtctctaacttattacatatatgctcataatcaattctcatgtgtgagaaatcaatatttttatgttttattgagtcttataataaaattataacctttagtcatttgtgagtatattttaatcaattatttttccctatttatgatttgctcattggcatccaacataatcaattgaggtttttagagagaattttttcattattgagaattgattttccaggttagacaatcaattctaaagtgtggtatgcatacttgattgtttattgttagagctattatcttattatctttgatctcattactctcctcttttttcatagtaaaccaaggacaatgctaccgtagaccatctttataagtggtctaaagtgcacaatttttattcatggctagattcatctaatcctcactaatatagcatgcacctttcacacggaattattctctccctaattagaaactctccaccgctgaagactccattatcgttgtgtatttcttagaaacagaaactcctcctccaccatcagccgcaccgcgcgcctctgccattgtcgcagtccactgcctttgcctcctagaaaacaccgcatgcatagtgtgttaaataaatcattcaaatgttcaaaaaaatccaaaatagaatgcttcacttgaaaacatcatacaaaatctgaggggaacaggaatctccaaaaactatagataatataatttcaccttaacagaatcccacaaagcaagagaaaaaagagaagacaaatcatgaacatgtgtagcacagtgggttggaacatatcgatgtaaagtagtaaacttttaccaaatagattacacagcttttgaatttccggtttctaatttctgattgaagcaaccatcatgaaatggaaatgatagcaaaatttatcaattgggtttcaaatatggtaataaaaaaatatgggttgtttgggtttaagattaaatgaccgaagaggtatatgatattgttgaagaaggccaagtggaggaggtgtccatggagggatgcagggagatggggaggtttctgtgtttgttcgtgaatgtgactatgtgaggatgacgaaggggccgaaagtgaaggatgcgagagaggccaggagttctacgagtaggttgtgcgtttcaatctggtggatttcctgaacaactgaggattccgacttgcggtggttccaaccaagatttgaggttgcaacgtcgttcccgatgctagactattgtgtataataacttgtgttacttaaattaatccaaaggtcgtaaataatgatacataatgaatcacctattaaggtggttcaccctataattctcaaggtgagaagaagttttaatattttctcttcccaattccactcctgtattcctcaactcaaaattcaactttttatttatttatctcttttccattcttctctttcttattttcactaatcttatttttctgtgttgtgccaaacagagttagtgagagtttttttttttttttcatacttaaaatttgaattcaaaactatctttaaaagaaattagacatgtatggtacatgaccaagtactggttaactaatgataatgcaatacataatataattaatttaattattattacatttaccacagaaaaggttctcgttggtttggctaaaggaagcttaacgcgagaacaatttcaaagtaggatatttcattggaaaagaaagccagttttgttcctcccctctgcctctttcctctccagcccttttatgtttggtgaaaagtttggcacctttattaatttctatatagtttaagtataagttttattcataaaacaatgatattacattcgtcccaaaataaatgccacgaatggaaaaaaaattatcttaaaataaaagtctcatggatttttaatataatattaattattctttttcactcatatctaatatatatgttattttagtttttgaatttaaatattaatattattttatttcatctatttaataagattaattttgtaaaataattaatcttaaatgacacttattttagatgaatcgatggaatactttttttaatttaaatctttatataaataattctttatatttaactccctaaaaattgctgataaaaaaatccctaaaaattatataaaaaaatatatgattttaatctccaatgagaaaccagtatttttaacattttgttaaatataatattttaaaacaaatatttcttttggtaatttttttttttaaaaaaaaaacttatttttgatgtatagccttcgcacttggagtatggaacttgtacctttttggtttttcaccctgtttttgacggaaatggattacttgtattcaggcattcatgaatatagaccgtctgatttaatcagacgattagtattttaaaagtgtttttaaaatgaaatttattaaaataatttaagaattgttagatttccatcaaacaattttagtcgtctcactgcgtacgtgaatgtgtgttcttccgacagaaaaaatctggatccgtttttaactagcacgacataaaacgcttcaattatcatcttcgttatatattatataataatatgaagaagatgcaccattccatccataacaacccagttaattaattaaaattgaggagttaatactgcgtacactatatatgtaagcaaaagtagatcgactaagttgtgtttgaaagggtgccccagatatgacaaaaaagggtagacttagttccattaaactaatgaatgggcttatcctcaaggaaatttcacataaaataacgactaaagaaatcatggggttgctttcaaatgacatattcatatataaattagcgtttgttcggatatgatgaagtatttgctctcccgtcccctaataaacaaaagaccaagccaatctgtcaacacacgaagcccccgtttttaaaggggcaccccaccttctctctcctccttccccctttaatttccttttccttcttaattgtcttaatttccttgtattctggtaatctagctaacccttttttttcccattagccatagtcatcaccatcgccaccttctaggtgggatccaggggtcaatatataatatcacactcaacacagttaccagctccaaatctcaagaaatggatagcaagttcagaaaaaacaaccacaacgttaactcatataccagtgaacaagatcaagacactgatatagctcaagaaaacattgccgagtcccctccttcttccactgtgttcaacatcgatggcttagtcccctcccccacttcttcatcaaagagaaggttagtactccttagtctttcttgctatctacatatatacctaattaccttccgtttaaaatcgaaacattacatataaggaaattaattctaggaacgaattcacaaaggaacaacaacgatatgagaaattgcatatactctccaaaatttaagattttggtattgatattgagaaattctctcttcttctttcttttattagtttgtaaacttattcaactattggatcaaaaactcttagatttctctagtgtaaaatgacaattcttgatatgagcaattctatacttctaacaacacctcgctagttagtgtgtatatatagctatggaattttgaaagggtaatattgatgggaattggttatgttgaaataagcaggagggcaatacagaaaagggtggtgcaaatcccaatgaaggagacagaagggtgtaggctaaaaggagagagcaacgccccaccctcggattcatgggcatggagaaagtatggccagaaacccatcaagggttccccttatcccaggtaattatataattccattgcattgcaacaacacgtttggttattttaaggttaatttgtgaacatatataaccgacgacaagaaactatttgctggttcgttaatttgattagtgaaagtggttgttgtttatgactcagagggtactacaggtgtagcagttcgaaggggtgtccggcacggaaacaggtggaaaggagcggcgtggaccccacaatgctagtcgtcacttactcctccgaccacaaccatccctggccaccttctagaaaccacgccaggcccaccaaaaaacctgaaccgggacccgaaccggtttcggatccggtcgaaccggacgagaagttcgcggacgagtccatggtaacaaccgcggaggaattggggtggctgggggagatggaagcgacgtcgtccacggttctagaaagcccgattatggccacgacgtaccatgctgacgtggcgctgattccgatgagggaggaggacgagtcgctcttcgccgacctcggagagctgcctgagtgctcggtagtgttccggcaggggctgctggcggagcggcggcggtacacggcgccgtggtgtgggaccacaagttgagggcaaaaaagtcaacacgaaaagaaaaaaattacaaaaactagaggtgcctgtttgacacgttcttcgtgcgccacaagagaaaaagataccagcatttttttttctagtattgagatatttttaatttttttttacttatcagtgttttcaagacattaattaaaaattataaaatatttaaaataaaattataaaaatattttaaaaaatatgaataatattatttgatgtatttgaataaaaataatttttcttttaatttttaactaatatcctaaatagcggtagcctttacctatatttgacttaattgagagtagaaaaaaaggaaaatagaagaagtagggttggggaggagtgagagtggtagtaaagttgtaattagcgtaactttgggcgtccatttcaagagcttgcattccacaatgtttgagaaagaaacaagaaatttgactggacccctatccccatctcttcttcttcatagaacaacatattagtaatgcgccgatactattaaatgccaaccaatggccataatcaacaaaatgttcgtttaaattgataacgatattaacaacacaaattctagtacgtaacaaactttttcttttttactactaaaactgatacaatggaatatccgacctcaaattaaagtgatagagaatgggttcgtttaaatttaaatggtcagaatgttatttattcgatcaatcccaaccaactcaattaaggttgagttgaaatggtttcgattgcttagaaaaaagagagtaaaattaacccaatttaattatatttaattgaattaagttataaaataatttaaacttgattcaattcaataaatgtgattggaagagaagaattatactaaaaatgattaatcattttttttcatttgaaattatcattgataaatattttgtaacaatgctaaaaactttattcaaatattcaaattatttacacctttattttttatgagtttttattattaataatattttaaaatttatcatcactctttgaaccccccaccccaccccacacacatataagagacaatcgtactgtcacatttggcaaaaaaatatacctaaatgttactcgcacagtaaattttaccaaattgtcacacggcataatttgcttgtcagtccaacgaactaggtgatagacacgtgtcagataggtagcaattcgctgggaagcctagcgaattaggtggacacgtggcagacaggtagtaattcgctggggaacccagcgaattacgtggcaatggaaaaaaaatgtcaaaaacttcgaacggttataacttttgataagaatgtccgatttaagtgtaggatatgtcaaaacgctcaaaatttagaggggaagccttgggcaactacccaaaagggagttggtctaccattttttttccaaaaaatacctctaagtgccttaaaattaagatttaagattaggatgtgtcctttaaatggtctaacttttgatagaaatgtccgattgatgcgtacgatatgtcaaaatgctcgcctctgaattttgagtattttgacatatcgtacgcctcaatcggacatttctatcaaaagttagaccatttaaaggacacatcgtaatcttaaatcttaattttgaggcacttagaggagtttttttggaaaaaatggcggaccaaccccagggcttcccctctgaatttcgaactttttgacatatcgtacacctcaatcggacattttctatcaaaagttagaccatttaaaggatacattgtaatcttaaatcataattttgaggcacttagagaagtttttttggaaaaaatggcagaccaactcccctttggatagttgcccagggcttccgctctgaatttcgagcgttttgacatatcatacgcctcaatcggacattcttatcaaaagttatgaccgttcgaaatttttgacatttttttttccattgccacgtaattcgctgggctccctagcgaattactacctatctgccacgtgtccacctaattcgctgggctccccaataattacccagcgaattactacctatttgacacatgtccatctaattcgctgggctgcccagcgaattactacctgtctgtcacgtgtccacctaatttgttggactccccagttcagcgaattaccccctaactgccacatgcccatcacttagttcgctggactgacaagcgaattatgttgtgtgacagtctgataaaatttactttgcgcatggtatttaggtatattttattgtcaaacgtagcagtacgatcgttgtctccacatataaagcgtgaaattaagctgattttttttttaaaaaaaatctaatatgaagagattttaagatagatttgtcttctttaaatgagttatctttaaaaaaattccttataatggtttccctctctatgagttatttgagtttctctttattttagtaactatggaaatggtaatttattccaattgactaaaaaaaatatcatttccatggttactgtttttttagtggtttaattaaaacttagaacaagaagacgttataaatttaattttttgtttgtaaatgtaatatatgattttttatttattagttttgttgataattaatctttgttataactcaaatccaatatcttacttaaagaaaagaaatatagtttcattaaaatcaaggatatatatgttagttaatatttgattttaccaagtaggactcagttaataatccaattatctaaggtttagttatcagtgtaaaaaagagggaggcaaaaaagatggaatattatataaaaaaggaaaagtaaagagattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagacaaaaaagattaacgatttaaaatctgaactgtaaaatttgcatgaatatatgtgagtggtatagtataatcattggataaatcgtaatattgcatacattaaaaataaattgagtttaactcaactaactctaaaaattagtttaaaaaggaaagtttgtccaagtcttagaaaaactactttgatttttttatttgatgacgtatgatcttaacattttaatttcagttcaaagttgtgccaaagactttgataattattatatctatctttttctaccttttcattgataattattctaaactctcgtaatactcaaatcgttattaagtgtctatttatatttactgccaaactttgttgttattttttaggtaaagagtttaatgcagatgtagaagttaaaaaacacaaagtgttagcaaattcgaatatcaatattttgttttgattattgtttcaaataatcaataagtatgaaactatcagctttatttaagaaaaaaatgaaaaatgaaaatataaaataataaaaaaattatttttattatttgctttatatgcgagtgaaattaaagaatagcatgaaataaaaaaaaaattataaaatattttctctagctaaccaaattatagaatctcttgtctttttcctttttcctttccctcatgcctcgagatagagccacgagggcctatcatctggcctcatatataacaagctgggggttattgatttgcattaaaaagtattaattaaggaatatatatatatatatatatatatatatatatatatatataaagaatgactttcagcatttttaactgaaaaagtgtttttttcgtttggatgaacatttttttttcagttaaaaatgctgcttttgcaaagtattctttaatatttaattgcacttggaagactttaataagaataaaaaaaaaaaaacaaattaggtgccttttcgcctacagttccgtgtttataaaatattttttctttacagcacgcattaaaattcccttaaaatatataatcactttataaatttacattcaaaattgtggttttcttttttaaattgctaactcaaaccagccaatttgagacgtgtgtgtgcgcgtgtgtctttttttaaaagcattttatttatattttaatatgtttttattatacaagcatattttttgaattctcgttgttctaaaaatttaaagagtacccctttttttataacagtaaaactgttgaaccattaaaatattacatcgttttactatttcatttaacatcatcacatggtatacaataatataaggggacaagtttgtcacgttgttaagagaaatctttacaacctcccaatgtaagaacatataacagttggtataaaatttatttattcttagatggataactcataacttcacttcacatgcatggattaaaaactttgaattttgaacactatcagattcaggagatgcccccaatattactacagattttttggttaaaagaggtgcatgtttttattattattattattattattattattattattattattattattattattacccagtttgacctcccacacttctactttatttgttatcttgtttttttaagctctcctcccccttttattattattattattattattattattattattattattattattattagggtatgaaatatatttttatatgaaccaataaggataaggatagcattttctaaaagtggatagcgtcctttattttggttaaaaatagaattattttcgtgtaggaagtgcgggaggtcaaaagtggagagcatttattagcattaaaaanattattattattattattattattattattattattattattattattattattattattcgtgaacgttttctaggacaggcttagttcattcaatcaaagaaaaatcaaatttgcatggaacttgactagaaatagaaaatgataagaccattaccattaacaatgattaattaaaaaatataagtatattctatttttgattaataattaagatttgataaaaatatatgtattaatgtaataaatttaaaattattaaacattaaccgtttaatttaattaataattataatttcactttattatgcagtcctcgctgtcatctatttttcctttcctgacaggcccatgtgattatagcccgttctatgaatagagatagggagttactatttgcacaagcacaactgctaatggaactacccacatggatatcttttcactttatttcaaaattacccttttgacaaaaacacaatggaaatgtgattgcctttttattatgattcaattacgttattttttattcaaatacgaacgaaattccattgagaagttcaaaatttttaaaataatagaattacaatttcattggctaaaaatcttaaaatgttcttactaagtctataaatgagagaagaaaagagaaggattggggatataggaaactcagaaggataggatgatcattcctacattcttggtactgccataaaaaattgtagtagtgacaatagcaacgcccattgaaatatgaccttagtttcgaaggcccaacattatccttatccttagtaggatggtagcccattttctaaaagtggatagcatattatgattggcattgcaatagtgtttaatgatcatactctctgaaaatatacaatatttcataccctaataatataaaacattttaattataatttaattacaaattattggtaatataatttttagaattattatcataaaaaattaataaatgtactataaatgataaattataattaaatgatagtgtaaaactttttataagtatataattgtttttctcttgcaatattagctatcttttttatgatactttttatatttctttcgcacagtgattgacaatcatcagtccatcacattaagaatttttataaaaaaaaattcctaaatttccattcaaaattttaattcaattttattttttaaaattaaaaaaaaaattgcataggaaatcatattaaatccgacataaggtcatttcatcattcctttcaacctttctctttatgtttcgtcattgaaatttttggcgacgaagggagggaaatcctaaacccaaattgccaaacagaaccaattcagaggcatcattcttaaccatcattattgacacccgggaagttagtgaaatgatgataaaattttctgcgtgtaaggtttctacttctaggatgctgatacttcatgttcatttcctcattttttacctaaaagatgaaaacagaatctgacattttaaccctgatagaataaataaagagcagagttagctccccatattacgcacataaacataagtacaaagggaagaaaaccaaaggaaaaacgaattaaacttttcccatgcgattttacatcttccaccaagggaaaacagtgtgtataaagttaaatatttcatataataaagaaaagctgaaaacataaatacggattagttactggcttgagttgtcagcatttttggtcaaattttcaaccccatgtgcattctttaaaatcattcaataaataaacacgtcgtcttcattccatcttaattccatgtttataaattactcaaacaattcagccgaacatgcacaaaatttcaaatattattttaacataatacctaacatgtatgcatatgaaatataggtatgcgcaaacgggtgtcccagaaatgattagcctcatagtcacatctacacatgcttctgttctcactagcaagtaccaaccgatatggaaaagctttaggataacccacttagtagggccaggccaaattgagtttttgttcattcattacttctaggaacttcttctcagacaaaacttagatacaattctgcatgaaattttagtattgtttttcaataaagagaaatgctaccgaaattttaccatagtaactaatgtaaatttgaacattaattctaattggagaacaacattaaaaacatctaacgaagtatatataggttttttttttatcttatatttaaatgcaagttctaataccaaacaaactgaacacttggcattgaaacaccaaagaatctcaatatctcatattatggtgatcacgacctatctatgattgcatagagccatacacgtccttgtcacacttcccaacttctgcatcattagcccctcataagatttgtctccatttcaaatgctacatcactcccaccctgtattctcactatctcacatacaccacattggcgtgttatcaacaacaatatcattcaaatttttcttttaccatcatcactcataatatatgtcagagtgaaatgctagctaaaaccaacgtgccccatgagaccttatctccacagaagattaaagtccaacatgttccaaagtgtgtgtccgataggttgctagagaagttctatgacgagtcagagttcgattttgattatgagcaaagtcggttgtggtctcctccagttccacgcacggtgttcttgagctcaccgggaagaatattcactgagcaagaaatgcttgaaagactcagaagcaaaaatgcaccaagacgtggcaaaagattccgagtttgtttcagtgtacaatgataatacttcttgcttctctttccctgttccattggttcctctgcttctttcatattttgcactgaaaaattctatacctttattccttttgcaggtgttctgttgtgcctgacactgaatgtaaacaaaagtgggtaggtttttcagcaatgtttcttgttttagaatacaaagggaattaatccaaaaatttcctatgattgttttatcatattcacaggaatttacatgtatttcttttctttttctctagccaaaagtcacgtatatctgtgaatttatatatatatatatatatatatatatatatatataccaattatccatagactcctttagaaacaagttatttttaaattcgaattcattattaacaaattatcaagacacaactttatcattatattaagatactacaacttaaaatgtttttaatttgttaaaatccattttctttttcactttcgaaagatactaagatgaaagatgactagaaaacacttttgtttgggtcttttccccagcttcgggaaatcatgtttttctcaagacaacttggatattggaatagctagtggagcatcgaattttgtgcctacgtcataaaatgtttacaacctagactagcgtaaattatcggagaaaaaatattaaaaaaaatgagggaaatgtagctttgcatttgctaatgttaatgttcttctattctttctctaattaaatttttatatacacaaccttttttctttaataacataaagatatttaacaaattctaatagaagattatagagattattcataaatgataaaattaagggtgtaaatgatttggattgagttgagtagaatataatttaagactcaatctaataaaatataattaggatggattgagtttgttatttttttattaagtaaccaaaacccaatcaaccttattttaattgcaaattgggttaactaattaaaatatattttttatccttatacaattgacaatgtttgaattttgtctttataaaaaatttcatttgttttcatcttcatgaaatcatgtttcattttttaacccaaagtaaaattcaattatatttgaatatatgatgataattttttacatcaattatgcatataatcaatataaatgtaacattttttatattgattatatgcataattgatgtaaaaaattatcatcatatattcaaatataattgaattttacaatgtaacattttttatattgattattcatataacctatttaaatataacatttattacatttattatacatgtaatcaatataaaaaagttatacacatagatatgggtatcataaataaaaaataacattataatttataaaaacaaaaacggatgaaaaactttactgagacgaagtcctaactttatcaattttgtaaggaaagaaaacattttaatgataaaaacatatcgaacatgaaaagatatgttttattaacaaaaacacatcccaagtgaaagagaccggtaaacaacccaaaatacgaggagctagagatgttataaattaatttggaatgatccaatttccactccaatctggagtcataaaatccttacagatattaaggaaaaggagattatcagagtaattaagaaggaacagcaacacattattgaataatttcaaacaatttgtataagcgctgtcctcggtccggtaaccaatccacgtgcctgtattctgtagcactggatgctcaccaacctctccacatggcatgctctcaacacattttttctgataacatacaaaacagatctgtatttaaaagaaactagttgtgatactaaaaaaacaatattcaatgcaaatcagtgtgtgatagtaaaaaaactagttgtctaatattatttgagatgtgataccaaaaacatctaaagaactgtatattctcaataatatacatacgtcagtgtcaaaacaaagtactttcaaaacagtgtctcctttcctaggatgcagttttgttgtttttctgaatgattaaaaaaaaaaaagttactttcaaaagtgtgttgtgtggattttgattttgattttgaccacgatgaccataataataataataatatacagttaggcttgtctaactccatgtcttcctgtaattctcattcctctcatcagctgagagatgtaaaccaaaaactgttacatgaaaaagaaaacgatagttctatcttcttacggtctgaatataaaaattgtttgcatccctatttgatagaaggaaaaggactcatgtttggagacaggatatacatgcagattgtaagatatagttcatatctaactcatagatttgtcaagtttagttctctttagatcaaagactgtacaggtctcaaggtaactctcacatcctcaacattcatagttgaactaaacagaaacagggttttgttggagagcttccttcccagtaatgccttcttttaaatttttaaaatatacgtcatagtccttttctggaggagggtttgctggatccacagtgaatggctcactaaatggaatgacacttttgacctgcaatacatattagagattgtgtaactagcttgcaaaatagaatgagactatccgcaatcaaattactagatccatgaacacggataaacaatttatctcaatcttaaaccattacatgcagttaacccgtataaaatccgatgtgcactataattgtggtgtttcataaatagaagcagaaacagcatattcaataaaaggctaatatcactattcgagccaaagccaggaaggagcaggcttctcctctccacaaaggaggtcaccggttcaagagaaattcacattacatttagaaaacgtaaaaatactaaacaaattctgaaaaaaatatgaaatagtaagagaaaaggctgacctcaaatgttttgtcacatgcataagggctatcaagcgcagctacacacataagagcaatctcttcccttgatattttaccctgttaagctttgtattagattggcatttggaaaaatgagaaaaatgctactatatagttaccatgaattgccataagaaatcaagaagtggaaatatatcatgagataggtagtttagtaagagcacttgaaccgggaaaagcatccatcttttgttttcacaataccgtaatattatctccttgatcaaaaataagatcggcaccagcaggctcctcagttaatgcacaaggcctcacgattacatagggaatgccactttctctaagtaaatcctcgccctgttacaacataaaccacttttagcaaatgaacaagtatgtgacagggaaatataaattgcataactaaataggctatggcaagcaataaggaggttcctttagacactcttaatagagaatgaatacttcttttttataaacttgaatgacaagggaaaaaatttcatagtcaacagccactctaaaactatagcaaaactccaatcgttgagtgttgacataataactataggcacgggtggaaatgggatgagtaaactagaaggcttaagtcggaccaatttacttaatataagtctttttattaaagcctagcttggtctttataaagcttggcctgacctgaagcctaatttatatagtctatttttgcagtaaagtcttaaccaagaaaaatagttttgcagaccaaaatgaccgtgatagacatcaattttctgcaaactggagaccttaaaatctagtaatacatccatgttaaataaggatccatcatcagattttacctttagtttaaatgtgaggatataatccagttccttgtttaatcgaacggcaggaggctgtttacttagatctagtccaggcctttcgggtcttgtaactcctgctgagctcacatgtacaaacctaaatgtgacacaaaggtgtataacaaaagatttagtatatcagggtaaacaatggaggggaaagaagcacaaagataaggctatacctgggggttattgaatcctttattatatatgcatgtatgctagacactggaagctcaaatggaccttccacaaaagtttcatttaatttaccatcatactcaaacttgctgaacatgagctgcagagagttttgcttcatcattaagaaataagaacaagtgtgaaatttctaataagccaaaagacatacagagtcatgcctgtaatgatacaacaatgcttggatcaaatggtggagcatcagacacagttcttgctcgaaatacaggcctcaaggaagaaaatggcacttgaatctatgaaagacaaaagaaaaaaacacatgagagttggtattattagataatatagacagcaactattgcaatagatgatacctaccgattgccattttcctttctcagtgtcaaaaccagcagtgtaaccaagagcgtcccaatcacggcttgtgcgaacaatgattttatatctacgcccatcaccttttaggcgaaactccaaaccatcatatgcagaaagattttcaggttctgagaaattctgaaaaccaattgtgaaaactctctttttaaaattggaacttagttcactacgtaaatagtcaaagtgaaatcaaatatatgttaatcactgcaataacagctagtcataggcaggtagcaacacccgaaactgagcaataattagaatcatacaattaaacgttaataattcaactaactggaaaaaatatagttcttgaaaaaataataaatgcaaaatattttaaatgttgatatgttctgttcctccatttcatacttccagttaaatgttttcaaggggaaaagtgtattcacttcttactgccctaataaataaatgctttccttgctttaaaaaaatggttctttattatataaatttcacaagcactgaactattaaattactaaaaaaaaatagctaaagggtgatttagagtttaaaaccacattagaaggcagtatcagaacacttatctaaagctataattgaaccagcaccgcaattcaatgtttatgtccatccatcagaatttagaagagatttgggaataaagacataggaatagaatttttttttttattaaacagaatgaactaagcattgtggtcactttcaagatttagaaaaaaagattatgtcagaattggttcaaacaatattaatcaagtatgtcattcccatttgcctggccttattgaaacgttaatataaaaattgcatattaccttagttctaatacttgtaaagccaccattgtttgctgtagaaacaacacctgaactagacacacatttgtattatttcgagcagtaaaacacaggctacaaattaccccaaagtgcagtcacatgcatttgcaagaatttgacacatacctttaaaaatcccagttggtccaccattttcacccccacgtgggtcaatttgaaatgtactttcactaactccacccattaccacatcatctaaagcaccccaaggaagctgcctgtaattattgcctgcaaggaaaatagaaaacaaattatattcacaggacacatagtagtaaaactaaaaacacttgttctctcaatacaaagtacaaaccaacagtaattatattcactatagcatgttgcaagcacaatccatgcaacggagattgtcttcttctaattcagaaggctgctgcaatcagtcgtgcaacttaatgttctaagttcaaagctcaatctagtatggattagcctagtggaacatgtcttcaaaagccaccagctagctaatacacttatttatgcatgaactgtgcctcacaaccacccaacccccaagaaagaaaataaaaatcaattcagcttctacaagtttcctttttattgtcatgcacctaagttgaatttggtggtcactggtcatgcatatgtcaaaaagttagatcgggcaattaagttgaatcaatcaatcaattgctttgtcaactagtaatctaccttcaaatccaaataatagcttttctctttgaagtccaagattgtccttcacggccttgatcaaatttctcattcctatgtactccaccttttctggcgagtcaccttttatctgttttcaacaaccaataactaagaaaaaaaagcttcaagaatttcccaaatgagcttgcagaccaactggacttccaaattaaattgacaagaacaaatctgactccgaagataatgtcaacaaaagaagaatcagtaagctacctctggctcaaagaacttaattccctgcacataaataatttcattctgttagagaaaaataaatatgaagccttcagcaaacaatcatgtaacaaaaacaattaagacaagtaacaggttgatataagtcaacgttaacacatccatttctcagtgatagataaccatggattactgcataagcaaaatccaaattctactgtcttaatagagctaatggacatacttggctgtattttgctctgtctggagtgtctccttccttggggccaacaatgacagaagcagcattaatcaccttcttcacacctttaaagtattcagggatcaaagtgctatcttttgtaatgtctccaacgaccttatttaaacataaaggtaagttcgcagcagagtaagtaaaggaaaaagaaactatcactttacgtagtacactatatgcaatcactcaatccaaaaatacatataccaggaaagtctgcactgatgaacatcattttcttcctccaaatcttgaaactttaacaaatcttatacgtaaaaactggcaaagaacttcaaatgacctgaagtcaattgtttatctcttcttatgcaaacacataacttccaaactaacatctattttccatcgttgaattttaggttcaataacacctcattctcaacagaatgataactagaaatctaagctgtcaacttttgcaaaattcagagcccaattgtaacaaactaagaaactacatatttattttatcatttgcaaagtctttcagtacattaaattaaagtgactcaccaaatcaacatctgagcctaacatccttctagctttctcttcatttctaacctgataaaaattgatacagaaatgtaatgtttgttatgcgctgaataaaataattaacagaacgaaaatttctaagcttcttttctctatattttctcttgtcagcaaggtaagttaacaacaataccaatactcggactggaattcctttcttccgtaatatgtcaaccacccttcgaccaacgccaccagtggctccagctaccaggacaatatcagaagttcccattgtgttaaccacttcactaggggaaggatcagatagtttctcaactagaaaatcaaagaacttcacaattcagaaacagaataatcattagttgatccatattccataccaacctctctcttttcttcctattactctcaatttatactaactgaaaattgaataaagtgttaccttagcaggagatgggaacccattgaagaagaacagtgtttttacaaatcttccaaaatcccaattttgtctgccagcttcagctgatattgttgctctatgtgctccagaagagagtctggttgacctaagcaacgtctgaggtctaccataaatctgaagaaatggtttaggcagagttggtgatgccaaaatagtgtgtgaagatttcttacaaagctttcttctaggcaattcagagccctgcagtatgaattaaaagaagggcggcaacatgaagtaaaaatgacataaatgactaagaagtatcaaactttcactagatatgatgaagtgggtagtttcattttcagcaacaacagcaattagaatcagctagcatgaataagggatacaaatgcttccagtccacatattagttacaattcaacttcaaaaatctattttgaaattcaaccaaattgagaaaagacattcaatgaacttcccagataagtaccagtgaacaataagaataaaagtaaaatatcatattatcagatatcaatacaaatgcttccagtccagatatcagttgcaattcaattttaaaaatttaatttgaaattcaaccaaattgagaaaagacattcaacgaacttcccagataaccactgaacaataagaataaaaggataaaatcagataacttctttaatcttggcttagcaaattcatgcaagttgagtgtaaaagtgatcaaacaataaataacgagctttgaatttcttccaaagacataagagtggtacctgaaaattgagaatagatgtggaagcaggggaggagagagttgtgtaaaacgcttccatctgaaaagtgatcgtaggaatatgttgtcaagttaaggttcaatgatatgatatttacagtgcaggattcatatgaaccacaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaacagttcctatatcgataaaactaaaatatataaataagagataattttaaatttttaagcaaatttttgggattgaattaaagagaaattcacattttaagaaagattttctttcttttccctctaatctattctcttgttaattattaactcgttttcttcttaatgggactattaactatctatatataaaagtaaaataaaatatttgtattaattgttatcatttttatgtagtatctaattttattcatttattattctggttaatttttcaattggtatccttaattttatttgattaatttttaatttaaaaatttcttacatcaataattattaatctattttttgtttacatgaaacaactatttaagtcatcaaattttgaaattttttttattaattttataaaataataatgaaattattttaaataaaaattcataaaataattagaaaataaattaaactgagaaaataaattacaaaatactccattaaaataaaaatgatcacaaagttatatgtattgtaatatttcaaatcaattttcaattgatatttcatttattaatttaaaaaaattactttaaattcaaaaattaatatctaaaacatggcaaaaaataaaaattatactaaataattcaatacgaattttgtacaaattcaattgcatgtttttaaattaaaaaaaatataagattaggtgacttcggggagctaaacatactctcaaaatcttggtgactcctttaaaacacattaaagctgatatggttttcttaaagcaacaatgaattgtttgaagctctccgtaatactaaaaataccattttggttcatcttaccgtcacctcaaacatgctataagtcaatccaatatgataaaattctataagtcaacccaattaataaataaataaaatatatacaagattattacatgttctataacacataaagaaagatcaattgagttagatgtgtgtacctgggatgaaggactcatgaaagaataagagtcaatagagaatagagatgaaagaagagtcccctctactcaattgattattttttgtctatgttaaccatttgatgtgtgaatgattaaataacttaatagatgaggacatagatctcttatcagacatcaattgaataatccaacccatcacgatccatttataaaaaaaagcccaacactattcatcatattgataaagtgctattaaccataattaaaatgttaaatataaactctaataattacttagtgttaatccataacttcaactaattagaattaatataacatcctactcatcttcaataacattaagcattatttcttatattgaaaacagatgaataattctaatagattaaattatatatgttatgtgtaaaaatatatatagtcaactaattaaaagttaaatatataacttttaaaataattattatcaaatttaataaacttatcatacataaaaaaatataattaagtgatatcataaaaaaaaaactctttgaaattgcttgactaatattcctctttaagatgccgaagtctactttttttgggtgggttcacttttgttccaataaagttcttagtcagtacctagtgtgtttaaataccattggttttttgtgaactttatggtttactttgttatttataacttataagtaagttcatacttttgtgtgcattttttttttttatatttgatatcatatcatccttcgatcatctttcgatcgagaagattgtgtttgaatcatatggtgttgtttttaggaatgatgttacgaacaagttagaattgggtactgaactgaaatgattttatatatgtaaatgaaacttgaggaaattatatttggatttctatttttatatttaagtagagtatctgtaaaaaaaaaattaagtagagcaaaatacatttttataatatttatttttatctctttggatttacctaacatattttttgatcattgagaaataaaaaggactacaaacgcaagaaaacaattcctatggcatcagtcaaaaggttcaaaagtaaaacatcagggcaagagccaagaacattgaaggatgaatcccatctttgcaaggatatcagcacaagaattagcctcgcggtaaacgtgttaaacttaacattccaatggttgaatattgaaggggatctgatctgagcctagattgaagcataaggatgatagcttgatgatccttgctgaatcaattgaataaaggtaagagaatctatttccactaatacgtgagtaaagttttggttccaagcatgctgaaatccacggaggatacctaacatatacatacatgctcacgttaaaaaatttattacacacataagtttagaaattttattacttttactctcaatcttaaaaactgatttgatttttttaatttttttttataaaaaaaagctatctcttcttatcctatcatttatcttattgcattgacgatttgcatttcttttttaatgtcatataagataaagagcacaagaatcattttcggaaaatatttgtactttatacgttttgtttgagcttcttcaataattggtctgtaagcttactagctagctcatcttacacattcgatagtatctttctttttcgtttgttatatgaaaatcacttgaaatttttaataaacatgagttagataaactcaaataagagatcttgaatctttgtctattttttttatttgccaaactcaaatgttaaaacttaagggagaaaaaacacaaatccagtgtcacttgaacaagagctatgattaatgatcaataattctctgtagtcatttttgggtcgctacagtttgtcataatgctcttattggtatcatattgttgtcatgataatgtagttctgccattgtttatcgtgtttcaactttatggtgacatcaacccagacaaagccagagtactttcggtaattaggtaaatcatgtcccaagggaaacacctgaactgtgacatgtgtgaataattaaggcttctcggtgtccattcttcccagcaccttttccttcttttagaacttttctaaagaagaaaaaaagtatttggcatacatgtaatcggtaatcgtatccaactacaaattttgacttccctcctactctttccttcaacgtgatatcaattagcacaagtcagccatattgtcattgttattcttttatgctaaaaatggttggttgtatcagtatgagctcctcctcctggtccaattacgcacaacaatcacaagtatatttattttacatatttatttaatcgatgtaattcattttcacttgaaaatgttagaaaggtaagcccattttgaatttttttaattatcattttagatctccaatcaaatttaaattcagctcgattttcacccatgtgaatatagggattgctaattttgtagtgatcattagcatcctttatactagtagtattttgtttaagacaaaaactcaacacaaatttcatttgaaaaatgaaaataacttaatttttttttattttatagtcttttcctttataccaaacaatgatcatttttttaaatgtcagataaatcttaatacatgcatcaatcttttctttttattggaaaatctataaataaataaataacaaatttaaaaacttaataaatgtgttttcaatcaatacttttgtaaacatatgtataactacagtcacaatttactttaaatatatatgtacaactaaactaaatccaacgttaataattaccgtcactataaatatataaacttttaatgatgattttttttcttctaaatcacatatattttttattaaaaacaattttatttgagtagaataaaattattataaactataagattcttcattcaaatatttaacatataactatatgttcaagactcaaatatgagataattaattaagctaaaataagcaactccaactgcatcaacaatctatacctaaaactaatgataagtgacttataaaagtaaacatgtaaagtaacaagtatatagatcataaaataatatattattgaatggcataagagtgaattacacacatatatatatacctcacttgagttctcagttttgaaaaccatgtcagcacttaattaattacaatgataggttggggataacaaaattatccatgtattatgtgtaccatagtagctaggttcacacacacaaaaaaaaatattgtgtaccatacttactagcgaatatttgagaggaaattttttcttacaagctagtagaactgtagaagtgagttttattttccttatttattaaatatgtggcttaatagatatatctaattaaccttcgtttccatttatatctgtttttttttccttcagtttttgttcatttttttaattattctgctatggtttaatagatatcatacatactcattaacacattaaatccatgaaatttatgaaataacttaaagctagtatttatccggcaggaccgaaacttctgaccgccccccgctaaacttaaaatgctgttgcagttgcacacggaccacgcccacaattatagtcttgcctacttattttaattggtaaagtgatttcaacctttttgaagaatgatgatcacataattaattaacgaaaataaatatatgacacaattatctttaatgtaaggaatacacatcattttatacctttaatcgactctttcttcattataaagcccatcacatgttttggctccttacttgtttattctatatttaaacgtacacataaaacacgtacaaaagattaccttgcatattatagatagtatagctagttttgatcgagacacacgaaaaaatggtatttcaagttttgaatacccgtaatccaatttagtatgttttcaacccaaaccatacttttgaaaaattaagttaaaccttacgaaaaagtctcttgctgactacgtacgatcataaagacatgattaaagagttaataaaaaattaattaaaaatacaatgacaatattgcactagaaacatttttctaattcctaaatttagatatttcaacttttagttgccataaaattattttagttcccgcttatttttgtgtgtttttttaaaaaatttattattagaaaagtttagttaaaaatgaagtgataaatggagagccatcacctcaccgtgtcattacttcatggagacataatgactacatatttttggaactaaataatagttttaaaagtactgaaatacctaaattctaaaacgaaaaacatgcttaaatctttttaattttttattcagacaattaactgtaagcaaaaaatgagttttttcaacgaaagaacaagagcgactcaaaaaaacaaaagaacaagagacaacctgccggctgccctaacctaacttagatcttccacagtctgtactataaatcaatatggcttttttatgtatatttttttaaactacaaatcactatttaaaagtcgaatcagggaaaattaaaattaatggtnnnnnnnnnnnnnnnnnnnnnnnnnttttttttgaatcaattggagttagattgaatatcgtaatacagaatgttagaattttctttttggtaatataaagttaagccatttatcactccaagtcctactctcgctaaaatctaaaagattacaagaataacaataatttaaattcatgtattaaaattaatataggtgtaattaaatttagttattattattattattattattaatagtattttcaaattattttacaaaataaaagtagatcaatataaagaatatttattacattagacataccaaaattatttatctaatggactactctttagaaaaagagtccaatttgacaaataaactaatatgttggtgtccaatgactgagacccatcatttgaggtttgagcaatacaccattgagtttgagaaccttcaaacaccagacaaaactataatacatatgtgaagcatagaatcatagctatcattctattagaaataacaattctgttatgatttattaaaaatacatttttcatgctatgctatctcatgtagagaatgttatgataaaataaataaagaaattatataatagagtcatgagtatactttctttaacttttatcatccattcatttattttacatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaacagataaaatatgtagaaaatcgtaataattctacatctattttttattttcttttttaaaaccagtagaatacgaaaaaaaaaagttcatcaaaccattcaagtcaaatattttgatagtttaaaattgtcagaaatcatttttcaaaataaataaataaataaataaattttgacttaaaaattgtgaaatcatgaacactttgataaaagagggactaaaaataattttccaaaaatttgagagactaaaaataacaaattatatttttaaggattacaaaaataatcatccaaatttaaagcactaaaaatatactgatcaaataattcacctctaaagattagtattaaaattttaatattaatatttttaaattactaaaaccaaaaaagaaaatatactatagaaaaatgtcatatattgtttatataaaattttttacaaaatatctaattataatatatgataaatttattaatttttaaaataattattttaaattaattcaaatataatttataattgaaagaaaatgtaatattttagtgcctaaaaattaaattcaatatactatctaatacatattcattaagataaattcttaagagatattaacaaattcctttactttatatgccgagtgtggggcttgtaacatttttaatatatgatcaatatcttaatttactatagacccacctacattcaatcccaacaatcccattccacatcctgtctgaatcacaatttggattttcaaaccccacgcccactttctcttgactttagccatcccttattccttaaagctagcttgatctccaagttctctctctctctctcgacccacttctccatttccttatataatacaataactccctcataaagccattccctcactctttcacaatatggcacgacctagcacgttgctgctcctgttgatgcttctcttggcttcattttgctcgtgtttagaagccagaaaacttgttctagagaagcagcagaagaaggaaaacccatcttcaagaagggacagtttgtttctgagtgcacttcctaagggcaccgtgccaccttcttcaccaagcaaaaaaggacactctatggaggttgatgagaagctcatagcacgacacttcatagccatcgatcgagttcttctaagatctgtccctagcccaggtgttggccactaataaattaagtttgtgtgtttatttatttcttctttaacttctttcttgagatatgacaccacattttttttattggttcagttttgttattatgtggcaagattctttatatggtggtaaagaggattttgaaagtgtgatataaataaacctacggaatagtttaattgtgtaaaagtggaatgaaagaatatatgtgcttatgctttcctctgctttgggactatcggctttccttttacgattatactcattcacaaacataaataaatgaatacattttgaactttacgtcacttcttttttcggcgtacttgtaagctttgcagtttgcatcaacgttttctcaattggaatataatattatgtgccatttggaattggaacagagagaaattgttgatctgctactgggaatccagggataaccccatttggcgtcatacaaagaaattagaatacaagaaaaaaagaaaaaagaaagaaagaaaattcattccagacaattctttgtaagcttccacttactttttttcaccaagagttggtgcgtcaagattcgagggtatctgtttgacaatcgatgtttaattattatcaaggcatagcttttcttaaagtgtggtttgtcttttgtattaaagtgttattcatacgcacaagtaaaagttaaatcttgtagtcaatgtgttttaaggcgtctaactatatatatgtgttggtacttacttgtgagttgtgacttggtgatgatctcgttaaatggttagagattgaaattgcctatatatacttttctccccctttccagtctctctaattaaaaagcgacacatgattaaaaagtagagtttttctcctaaattaactgtaacttatttttgttgatatgtcactttcaacgcaacgtcaagaggctattttttttaaaggaagttaagaggctatttcattgacataaccttttgatatttatttcaaagcaaatgtctttactaaaaaaaatttatatgcaaggcttttatgacacaatttatgggctaaaaaaacacttatattaattttgatcatttaagataaaatttaatgaataatgtttatttttactactaagtcgttaatttaagtagtattggagtcaatttctttaaacaatgtttaagatttgaatcttataaacgaaaaaaatataattgaaaggcaaaaatttcactaaagatgtccaatcaaattttttatgaaaattaatcatcaataaatttagtgaatattacgtaccaataacatgataaacaaaaaaaattacattcatttctcgcacacataaaaaaaatgttctctctcacattttcttaattcaaatgactaaatatcccaattcatgacactcaaatattattattttgactacaatgataataataatgaggatcaaacataattgttcatgcatttaccccaacccttcctattaaactaaccttagtgagtaacacctaaatattattattaacttcatttttgtttgtaacaacaatatctcaatagtttaatagtagttattacttgtttggtaggataccttttctaggtcagtacctgtgttaactttattatttagattaaattactcaatacatacctcaattatttgtgaatttttaagcaagttcttgtacttttttttttgttaaattggattcctaaactaaaatactagggtcttggatttatttgttagtagtttaaaattgtcacaaaatatgacaattgatgatagtttagaaactaaagggactaaaaaaaatgggggacctatttaaaattttgcatataaattagagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttatataacgtttataattgagcactacggcagcatttggttaagtaatcaaggctatgcttattaaagtaaaaacttaacatacactccagtcaaaacatcccaatgattatgctttgaatcattactccttactcctatacttggaaattaaaccaaatgataatgaactgaaagagacttatccttcatttattacactatattacaataacacaagataatttacagttgacatcgctgataacagaagaaaaacacagaaattgagaaggtgtatataccaaatgttatagtactataaattctatgaagagagtctaacagagcacctgaagcatccctactcttgagactaaatgtacaataacaacttcaaaaaatgcctaattacacaggaattatgaattaatactttggtatcctcccctccccccccccccccccnnnnnnnnnntatatatatatatatatatatatatatatatatatatatatatatatatatatataatataactaacagtccagaaccatagcgaaatgagtatctcccataatgaacacaatagttatgctgcatcaatttttttacttcaagaagagtaggacacaaggaactttaattcgacccggattgtcctagcccttacgcatcgcaattgaggtataattgtgggagaattccagtaccaatcccatcatatagcacataatgctgatcaatctcttactatggtactttgaaaaaaaattcttataccagctgtaacacttagacaaaaaatttcatggtacaagtgttataagtaaaaagtcctttggattaaatgccagatatactcaatttcagaaaacatggtaggtgagatcttaaattttaaagtacaaaaggaggaagaaaaaaatagtcttggatatggtccatgtacacaactactggtctgccacttaagttgcacattttggccaaaaaaacaatagcatcagaaaagactaaaaacgcgtccaaagaaccaagatatagcatatcctcaaccagcacccagctgtttttttttttagaaggggatcaccgtcagtggcctgtgttttgccatttgcacatcttctgacccaacactcttttcttgttggagtaattgcattatcattttagcctggcacatcttctgaaattattactaaaagattaaaaattacaatcgatcaattaaacctattacattccaaaggtaattttataatagcatccaagtaaaatcaattattctaaattaaattttaaaatattgttctgaaataggaatcaatcttttaatattacttttatattaatcattttaaaatattaaactgaactaaagaagcattttatgaagataaggggaaaaaataatgaaaatgagaatataaaataatgtgtgcgtctcacttgaactatacgtttaatttatttgcatccatatgtattggatgacggcagaggattgaatcttctacctaccataacagacacctcacacaccggaaacattattaaaaaatcagaaactacatgattcattagaagctcgacgtatgtcacacgtacttgtgttccaattagggatggcaaaacgggtctggcccggcgggccagcccgtttaacccacgaaaaaatgtgggctgggttgagactttgagcccacattcattaaacggggcgggccaacccggcccacaaaaatgtgggccaaatgtgggccaggggtgggccagcccaccgggccagcagcccaccaataaaaaataataaaatatttaataggtaattaaatgagtgacttagagggagagtgactaaaaagaagttaatgattttgaatccttaaccctaatacatttttatttggaacctaataatgagctatactacatgtacaattatgttttgatagtctgcatcattgtgaagcaaatttctaagaatttgttaagacttaggagctaattgaaaaccattgttaaacatgtatttcgtgcttgcttttacttctattaggcatgtattatatattaaaaatcattgttataggattaagttagtacattattaatttttagtataaataattacatttgaatttttttaataatttattttacctttttaaaaaaaatatttttttttatttttaagtgggctggcccgctggcccactaacccactttaaagtggggcgggctagtattttcagcccactttacaaaagtgggccagcccggcccgatccacttttttagtgggttgggccagcccggcccgtttttgggtgggctggcccactttgccatccctagttccaatcctacttcaacagtcagcgttctcaatcacacgcaacaaatcacttcacacactgcgtggataggtccatccttataattatagttatctccactaaatttctctctttcagtctaataatttccaaggttcatttttattattattaagatgtcctatgtcatttgcaatatagtccaaatattctttataagacatggatccatttttaatatgatattggcgctaaccaagctgagtctccaaaagttgtcaaggcccactcagaattgggtctctagaattggttcagctgcgtcttcaggacaacgaggattgaggaggaagaatgtaaaggatacatgagagactaaaacatcttgcacttttattattgttttcagttgtgtctcattgcattccaaaaagtcttacattttggattggacttttcaaaatacaatggaacctaacagaaagcaatagtgaaaatgcaagaagcaacatcctatgtacatgagaggtacttcaatgctaaagttaatgtgtaaaatgtgttcatcgacaacgatgaaaaatgcaaagagttgaggtgaaatgtgttcactattaactatcaatgcaaagagtatagagaactcacataatgttgaaccatgcatacctatgaaaaatgagagtagatagaactcacggaatgttgacgcataagaatgatgggaataaagaaagctcaaaaaacattaaagcataaaaacaatgagagtagagagaactcgtagaatgttgccattgctatttgctaaccttgagctcacagaatgttacacttaccagccttgtttgtattcaagcttaaaaaaatatttactaggtaaaaataattaaatactaaaaaggtaattaagaagaaaatagtaagatttattattaaaaatgttaaaaaaatataaatcagatgaataagtattatgtattgttagaaatgttacaatatataacaaaaaaaacgttagaaatttgtaacatttgcaacatactacaagtctacaatatagcacatacaattaatacattctattatgtatattttattcctttaattcaataatataaacaaaggatgcttgctaaccttgttttcattagcgaattgtcaaaaagcacgagcataatccatcggttcaatttaataacgtaaatgctctaatataacaaaatagatacatatatactattgaagcaatatttcatnatataacaaaaaaaaaaaaaacgttagaaatttgtaacatttgcaacatactacaagtctacaatatagcatatacaattaatacattctattatgtatattttattcctttaattcaatagtataaaacaaaggatgtttgctaaccttgttttcattagcgaattgtcaaaaagcacgagtaaatgctctaatataacaaaatagtaatagatatattactattgaagtaatatgccaagtggcccattagctcagttggttagagcgtggtgctaataacgccaaggtcgcaggttcgagacctgcatgggccaaaatgattcttttttcgtttttctgtttgtgaattgttaagcgaggcatacacacacctttagccttcacggggttctttcatattttttcttcttccagtaaatcaaacttataccagtaaacatgaataatcttaaacatgagtgcataaaaacaaatgatcttttctcaatataaatttttatttattaaataaaaatttacttttaaatattgaaaaatattttttttctttgaataatattttcaaaatgttaagttatgttggattggtggtagaaaattaaatgagattgattgaaaaataatgggatgagatggattgaaataaaaacatcattttattgtttgattttttataatgaaacaaaacaaaaaaattattctattatttgaaaaaatgataaaatggaatgaattataacttttaaattcatattattattcttatactaaagatacttataattaaataattttataatctagaaatattgttctatcaagtgcaccccgaattgggggcgggaggtgggaggattacggttaagcagtgtaatagatcatgatttatcttcttctattatgttttattcctatttttacaaaccaaacattgtttgatttgaaaaaataaaattttattttttaattataaaaatataattttattggttatatttttgtaattaaaagtgataataaaataaaatcttaaatcaaaccacaccctaaacttgtctcatttaccaatcccaactcccacatttatgtctgccaatgtgtttgttttagcagtccaccagtacttctacaatgcactcgatcggctttgtatttgctaaacccaaagacgtcccatgccatcaagaaattaaaaacacacggattttgtgtttcctcatgaaatgtattgtcaaagaggtttccttttgtcatcatggtgtcaaaaatttgaacttttcttaaaggtatgcgaaggcattgattgatgagctctttagtatttattagccgggtctgcccccaaagtgtttggtattaggagtgcagatcaagctacgaataaaataaaatatccaaattggccgggaaacattcttacccaattgcttgagaattcctacttactctatgttaaatgttcaatgcatgctcaacttttacattaaaattaatttgaagatacggatgattatttatatgatatattataccgagaataaagtttctctgttgcccccttggatcaatgatgcgatcacatatcttggctatcagatgcttaggatgcatagagattatggggcagttatttttttttcatcttcaaggacacagattacggtcggaagtaattttttttgtatgatgcaaaaaaaataaagatgtttagattgatctcattaattccatggtattatgatacaccttttacaccttaccaacacctcttttcttcccaattatactttaccgtcgcttcattttatttctcgtcgacccttcatttatagtctccaaccacccctcctaacaccacccccatcattgtcattattttcaatatcaaaactggtgacaattgatagtagtagctacggtggtggagaatcaacgatgtcttgatggtaacgatgtttgttgatttatagatttgagctcgaatcgtctgttgatagtgcatggtgttcaacggtggtgtatcgacaaggaagagcatgatggtaaaactaacgtgcttgagcaagattgcctcccatcaaaacccatcacgaaagcaacaaattcgccatatctacggtgctccacgccgaccaatgccacacaccaccacaaaacccaaactcgaggcaccaccacgaaagccaaatgtggtgtaccaccacaaaatactgtttgacaagatcttttagagatttgccgccaatagacacgaagtggtaatgacataacggtagtttacatgacaaagtgaattgacacaacccagatcatagagctctattttttcttcttcttaaatatggatttgatttttctttctcttcatgttgtaatagttctaaaatttctatttgtacaccatacacaagaatatttacttttccatcataacctgcgccatcttcaagttgttttttgcattgtaatcttaaaagagaaaaaaatcctaaaatattataaacaaatttataacaattttaaatttaaataatatctcaaagataaaataagatttgaaacaaataataagttcttaaaaaataaattaaattctttttctaaactaaaaatacaacactatagacatccacgatcagattcctttatatatctactaaatttgaaaagaaaaaaaaagtttattccccaattacaatagaaaaaaatgtttattgggattgtgccgtggtgaaagtgagtgggtatggaaacgacagaaaatattatttgctacacgtaatatctaaccctgacatgttgcccatctatctcgtgaaccagagtaaaaaaaaatccaagtactttctacgatcgagttacccgaaagaaataagaattttccaagtttcaaacggatacttataaatggtagtcgtgttttaccctaatcacgtgagatatatctgtcagacattgcatgaacaatttaaatattttttgttgcattttaattatttaaattcttttaaaaaattacattgattgcatgaacaagtctgtatcatataatatttgtgtcctgatgtatcgtatccatattttcttggactgttgttcgtctataaaatgaacaactctactcgttatatctaactatctattacctcgagcgggacagctgaaatattttaagatttcagctgtgtttttttttttaagaacttaatctttatatattattctatattatcatttaattataaattattatttgaattattttaagataattaatttaaaaattaataaatttattagaaatgatgagtagttgtgatgtgtaaaatttttataatattaatattttttctttttttaaagaaacatgttgtttgagaaatcatcatgtaggctaattaggctgtgtttaaaggttaattaaccgcatattttaatgggtcaggttttgctttttactataaaaaaaaaggctttaatgggtcagattactagcaaattaagcagcatataccctaattatctgctatcagatatgaattgttgcaaagtttgaaccgatcactgttccaacagccagtaagtttatctttgacaaaaatgtatcgcaagaagaaacaaatctgacactcaaagcttctcttttgtggggcccttaaaatctaattatctcctaccccaccacgctgattctctattcctagatcagattaatcaagatcataatattgctagttgctaccctgttggccaattgacatgtgggtccaaaatggctatgggtctgtgctctttctgctctcacatttacttaatgtacccatcctttgtggctcccctccacagacttatcccacgcgcctccctgttgtcattgatagtgaagtacttgattggctcgtctctcccattgcatccctggcccatcatcaatcatgcacacaaggcaggcttaccttagactcaattttctatcaaatggaaggttttgaattcaaaatcaatcattaaataggtgggaactagtagtaacactttcctttgggagtgactaacgaatatgactaattaagtgcgtgttacgtttttttttttttttgaaaaatatctaacaagtttaagtataattttgttttttctgtaaacatatactataataagtatgaaatatttaaatatttactaattttattaataattattttgtttgaatatttaaccgatcatttttaataaaatcatctttcacaatcatattttttcattcatcaaatttgaacataaagtcttacttaaagattttaaaattctaattgaaaaccaaacatgttatcataaagcatggctgagtttgaatacctaatgaggcaaagtttagttttaaaaggaaaacgtttcctcaaatgaaaccacttcctaagcaagtaacggtgtaggtatacattctcatttattcatttcaaaggaaacatatccatattgaaatatagacaaaatttagataaatctcttcattgcttatagtattattctcttatgaacatcataatgtgtactcatttttatacttacaaagacatgataaggtagttaaaaaataggacacacattatgtttttattacagaataataccataaacactcggcggaaccttatcatcaaaataaccacaaactttaatctttactttatataacgtttataattgagcactacggcnnnnnnnnnnnnnnnnnnnnnnnnntctcaatagtttaatagtagttattacttgtttggtaggataccttttctaggtcagtacctgtgttaactttattatttagattaaattactcaatacatacctcaattatttgtgaatttttaagcaagttcttgtacttttttttttgttaaattggattcctaaactaaaatactagggtcttggatttatttgttagtagtttaaaattgtcacaaaatatgacaattgatgatagtttagaaactaaagggactaaaaaaaatgggggacctatttaaaattttgcatataaattagagatttnnnnnnnnnnnnnnnnnnnnnnnnnnncccccccccccccccccccccaagtaataatacagaaaatgagttgtcaagtattcatttaatcctccttattatacattatatatttcataaatttttctaaacatttattgtatatacttgacaactcattatgagtattatactcataatattaccatgacatgggatacactaatacagtaattaatactaataatactacgtattaggaagtagccggagaacccaccagagagaggtaaacctgactctgtatcactgtcttagcgattttgaaacccggcaccaccgtgaaacccaccctaagctcgccggagctggaatcagaggattccccggaaggcgaaacgggttcttcggtgacactctccatgtacacctcagagaacctcgtgttcttcttgatttgaaagacggtgacataattatcctgaaacgacaatgccaaacaatgcagggtccaaacgcgctttgccatctctgcaaacgcgacgaagaaagaagaatctgggtaccctccagagttcaccaccttcctctggttcaagttgccgaagaaggaacactccattttggcgtgcaccacttgaaggtacttggatttcaggaacttggagaaggaagagtttgggttgtgggttaagtactgttttggattcaacgatttgagctttttgaatttgtcaaagtagaggctttgtgctccttggttatgtaggattttgtcttcttggacgttgaagtttgggttgttgaagccttcaaacattgttatgcaaacaaatgattcaaacgcgaagatttggtgagttggtttggtgaaaaccgcgttaggatggatgaacttaaccgctgcttcgagatcccaatgagcagattccatttccgccatcataatcttggagaagcttctgactgatctcaaagtgtggtgaagaaaatgaacaaaatgtgttggactcaacgatgaaagtgtgaggttatcaaacaacgacaatgagccactcgagttgagtttcttttcaagcgatttgttgaagttaacacagtcgtcgaggtgtttcttgagcgatgagatgttattgtccttgaactcaacctcggcttcgagcctcttgatggtgatttcataggttttcatgagactttgttgttcctgaatctccgcgagcataatagtaacttgaggtgagagatcaagctccttcttcaagaacctgcgcttcaactccgagatggctcgaagttcatccaccacggcttgatccgcagcttgaatggagtcgttgttgtaagggtgctgagccatttggagttctgcatatgctgctttgatggttgtgacgccagcgaagagtctcgcgattagagcctccataactgctctattcttgttgtttccttggtggggtttgttgttctgatcggtgaagcgatcctccttgactttgaggtgggagttgagcatgcaaatgccattgtttgatgcgagtttcgttgcacttcggaggcttatcaccttctggaacgtctttgccagtttcttgctcctaacgttgagtgctgatttgggcttcatggtttccatctcaagacaaatattttcttgtctgaagaagcataagagttttgtgtgttttcacagcaaaaattgatgaaatccaataacaatgggagagaaaatgtttgcagtagcaaaaggagattttggttggaaaagcaggtgcaaatctttgactacaacactttcaaatcagagtctttgagcggaggatagagattggtagtgtggtgatattaatatataaacatagattttatgaaaataatgggagggagattaagtaaataggagtgtgtttaaagcgcgggaaaaggaaaaggacgaatgctttagctttctcatgaaagatgttaaatactccaaggtaggcttgtagtacaagaactttgacatacaagccactgattatctattttttcttttctttgcctacttgtttttggaataatatatctgtatagctacccagagagatgatagtgtggggcatattgccttaattacgtgattgatgggtatgatctaattgtggaccctattagaattcaaaatattgataaaatcataatatatcgtatgctaggaaaaaattataaataatgatatatgtttttattaaagagaaaatagaaaacacacaggcgaattcaaaaaatgtgtgattatttgttaaacatgttttatataaaattaagtgactgaacgtaaataattaatgtgttgaagttaagttgaatcatttgaatattatttgagttaatttttgataaaaataattgttgatcaaattttatttaatttttgatcaaattttagattaataatattttttttcatgatgaattagaatattaaaaaaaacatattttatataacaaattcatcaattaataataaaagtctattaattaaaaaaattataccgttgcaaacttgcaataactgtgaatctgtcatgcttgtgactgatggaggacattatgaaacatgtgagggataggaatccgggagctgttgttttctaatgttcgtaaactagaaggtagatgcatgttaaatatctttttatttgatttggaaaagcaaatgatggttaagcgcgcactctgcaataattaattatttttgcttatgaaacaatggtaatcaaagttttgaaccgttttcgtttttcattattccatatggcaccgcaacaaaagtttcaattaattattggaactggttcattgtaggtatgtgaacatgaacggctacatttgtgtagctaagtagctagcctgaataaagtttaccattatccaggctttatgttaaaaatataaaatgcgtactacagatatagcttttatttgtgggggacactatagtcagaaacattattgtggtttccaaaaagctttttcgacggtaataaaaactcacaagggatgaaggaatattacgtaagcagcactgcggccagcagcagaaacagaagcatggaaaatgctctgcatacattttcttattcaatgaattcaatatcacaactttttaaaagtaaaaaaatgaacaacttatgtaaaaactaaaatattattgagttacatttcttttggtacatatgatcaatgttgtctatcttaattttacgagagaaattttaaatataattattataagtaatatttttaaaaaacatttaatataactttatatattgataggaattctcttcaattaaaaaaacatcatattcatattataagtacgatgattcaaaaaaatattaaatcgaagtacaaaaattctctaaataagaattgttggatcatcacttgttcaatgaatagatataataaaaaaaaattcaaagaaacgtttatccttgatcaaaacaaagataaactctggaaacttgaaagaatgaaaattatttcatttatttttagacttacacttgtaactatttattaagttgaaataacattgtgttaattgattgtgcatttactagtattaagttacattttcatttttgcaagcaatatgatgacaagtttggtaatttaaaaaaatgttttttattgtttaaattattttagtttaattaatgattttaaattcaaattcgaaatttgtaaattaaatattaaagaaaaacattatcatctataatacttttatctaagtaaaagttacatgtaacatatggtccaagtcaaaatgggcaagtaccaagcagaaaatgttgacatgtcataagtacttcgaattcttttcacactaagatatacaataaactttttcgtacaataatttgggttataaatttaaacttcaaaatcattgaaattaatgaataaataaaaattaatttgatagtttctattacttattttcatatgttttattaaaaaattgattaaaataagccaatattttgttataatttaaaataaatttcagtaaacccttccaaatatcactgtttgattttcttttcgtggattattatacttgtttggagttttgctactattaagtattcagagtcattgtctttgctggaaaatactgtgtccaatgcccatgttccgctcaaagcgcgaaactctttgccatagggttcattgtccaatgtccattgtaggcatgtgatcaaagaagctgagcacgagagaagcagaaaataaattgattgtgatgaaaacttttttttttgtttaaatatatatagttgatttttgaaaatattttcagtcaccataattttcccatgaccccttaattaacactgttaatattccaagaaattgaaatccgtagtttatacatagaaagagtcacgttttcttttcagttgtttgagaggagctgtctcttgtgtgtcttcgaatgcgtcaaatgaagaagagttagactttttcttcatgttttcttaataattgcaaaattgttgacagagcaagaaaagaaactaaacgatgtgcttccctttttacgtgaaagaactttggcttttctttgatcgcgatcattgaattaaaatgatacaagattgcaaatattatatacactagtggaatcttgtcttgtattggaattgcaattaatttcaatttgatatgatattatatttttctttagttagttctacttagctgtagttcatgaatcccactgaagttgacaatatgggaccaaggttgcacattggtgggaaaacatcacaaaagagacacagccgaaagaatgatggtgactgaaatatagcctcaggtcttaattaaacttacaggagatggggtacaacatagtcaacttgggacagtaattgtaacatcccaactaattaattaattatttatttgttttattttaaattttattattttatcctttagtcttttaagaaaaaaaaatataaattgagataagaacaagaaaaactaaaattttacaagatcatgtattagtaaaaaaattcgtcgtcataaaatttacaaaatataaaagagtggtacattagtacatgtctctagtataaatatacaagtacaaatttcttttccaaaattctcaactataatttatatattataggacttcaaacattgttatttatacacaagagtcacagcctagtatttacacatagtcttcggtactgtctctgtcactgaaaactattatggggtctgtgactgggtttggatacattggtacaaactgagagaacggatctgcagggttaaaatattcactaaacaccgatactgaaaaatgggtgccaaaataaatatgagcacgcaacacaggttgcatggtaactacatagcagttgcggacttcatccatataccaggcgatatccagagcatcaataaagattatgattgcagccatctaaaacattaaataaaatctaatgagaaataaatttctcagtaggctaatctaaaccaccaaacacgttagaaagttagtaaataaagcaaatttaattcaacatacattttagcagattagtaaataactcaatatatttgaatgaatgcatgattatatgaatgtatggaaatgaatgtaattgtcacaggtgcacatggtctctacatatcgtactgtatgtagctacatctcgtactggatgtagacgctgcgatcgtcttatgcaaacatgcatgaattcccatgtagtagcaccagataagtagcatatgcccagtttcccacatttgaaactcgggtcattctcataacttcataagatatttctctttcataacataagatagatatcattttatgcatcgttcatgtaatagtgtatcccagaataaatttaagagctgctaatgttatgatatatatatatatatgtatatatatatatatatatatatatatatatatatctacttatttttatatatatacgggaataaaaccggaaggatctgcatggcataatttatacgtagaagttatcttaaaatcggagtggtagtattcttatgacgcaaggttccgagataccgatttttgtttagtttatgcatggctcgtagagttgagtgccgaggtgcgtgtaggggtccggggtacatgtatggtgagtggccgaggtccgaggttcatgcttggtgagttgccgaggtctgaggtacaggcatggtgagttgccgaggtctgaggtacaggcatggtgagttgccgaggtccatggtgagttgccgaggtctgaggtacaggcatggtgagttgccgaggtccatggtgagttgccgaggtccgaggtacaggcatggtgagttgccaaggtccatggtgagttgccgaggtccgaggtacaggcatggtgagttgccgaggtatatatatgagatcggcagggccatgtggccgggctacataggtgaccgagatgcatggtggctgaagtgcataggtgggtaagtataatccggcatggctgaggatcgagatgttggcatgggttaagggtatgaccggtcttggtgctgcagccatatatattcgaacgggtatggccgggcttgaagagatgctatccgagttacaagagtgcataaatagttgggatgagtgaatccggaaatgccgagatggattgctcggctcggacgtgcatatactggtgagtgtattttttccggtagtgccaagatgtgtgcatatatatatgtaaagaagtgggtgtttgacaagtgagtggatccggtggtgcagaggtgtagagtaatggtgtagctgagagtgtagtttgccaaggtaatggtgtaataagaaggaaaagccgagatatccgatatatccgaggtgctgtagtgtaaaggttccaaggtctctactaatatttaagcctcgaatttacgtatgtatactattcacctttacttggaaaagctaggccgagataaacaaaagttggactttgcttttggtttgtcattatataaatatatatatattacttagctattacctttggtgccgtgtttaaaatttatggcccggtagtactatttctttaatttaaaacgttagatgcttaatataatattattatcttatagacccaaattactaataatttaagctctacgttattgctagcttttaaaaaaaatcactgcatcctatattacatttctaagcataattttctaagttaattctggttaaataatcatctaaatgaaataactgttaaattaaagattgaagcctagcctaccttggataaatttgatgaatgacttagagaactgccaggataattttgagagagaaggattttacttaagagaagatggtagagaaagtttgggaagactggaagttgttagtgttctatgtatagaatttgatggatgcaggagtatttatactaatttatttggttgaatgacaaccggtaagatttagtttagttaatatgtaactaatttttttggaagatttttatcaaagttaatcattacattcttctcctcattaatgcatggctttacgtggaagcttgatggataaaatttggttctactgatgacacttggactcttaaaagattgtattaaggataggtttcagctgaatttcttcacgtggctggagttgaatactcaagtttggttcttattctaaaaattatctttgatattattatctattctgttattatatttttaaatcacatatatatacatttatatatatttgagggtattacagtaatggtttataataatatcattgctttgtctttaaaatgatctgaacatataactaacaaatttgagttgtacaaaaaaaagtatgatcatttatcacttacatttgactttaagctgaactgtggcgaattaatcttgaatataaagttagggattatctaagacatataactatattcttttacttggattttggagaccagaagatgatagaaattaaaattttccttttatttgatatttaatgtacataactattttgaagaaagactatgaggcccaaatacaccctaaatttatcaagtgtttgatccatctttaatcttaaaatttcctgttcatattaggcacactccttgcaaaaataatgagtcatcataaggtaatgttaacgagtgcctatatcagtttaacatgttaattatttcatttttattcttttttctggagattattgtttttattccttaatatattaaaggtactgttcattaaatttttaataacaataactaaaaatcatagcataaaaaacagtgtgtccaaaatgtttcgctatctaaatgtttactctatgtaactattagattgtataacaaattggaatgttggtgaacacggaggtagtttaatgattcagcaatgaagccatgaaggcatggctttaggtctaagaaaaagatgtaatgcctcaaaatgaatgatattcgtatgtttgtctttaacatctctcaactcattcatagtaattttatggtcttcgtcacgtccgacattcaagttataatattgcaggaatattattagtctaacagtgtccaaagttaaaattatcgcatcttattaagaatagacgaagaagtttcctaatactaattattttatcttttaagatccgtttccacattatattatctgaagtttaatatcattggttactggttagattgttgtattgcagaaaagtgatcgaggtccaggattcagtcaaaggcaccttgatctaattgattcgcatatatatagtacatatttttttttttgggtaagtggcatgaagttgtaaatatcaaaatatgtttgttcatatctcacatagtcacattcatttagggctaaatcaagctttggattagtattattagatttgaataatgcataattatatcattgtttgcttcttgggcgtagcaattgtaatggccgggaagaaaaatcatttgtcctcctagattcaaactttgattgtatggcatgcagctatattatttgcattttgtcgttaatgatgaattctacgtcaagacttctactgttatacttttgtagccttgtagacgtatttagaacctacctggataagttttatatatatatatatatatatatatatatataaaatatttgaataagttgatttaaaaggacttttaaaagaaaaaaaaatgaaattctctattaagtcaaattaacttatgtacatatgatgctagctaaacaaagagcgtttcaacaaataaacaataacaacttatacaaacaggcttaaagcttaattaaaaactaatcaaatgattgaatataagtaagtaatgtactaaaattaaaattaaatagttaaggtaatagttgagttagatttttaatgaaaataatttttgatcaaattttagttacctcttcactcgaatgagacataatctttttctcctaataaacatgaaaacgttaaaaaagctttattaaaagctactcatattagcaattctaagactaggtaaaacacaaaaacattgcctattacaggggacttttttcaagctggacttttttcacttttattctgtggacaatcgatgggttgttccttcctacacctcaaagttgtttcttacattctttttagaatgtctgtttttaccttttaaattgatcattccagaaataaaaatctataatcaattcacaatttaattttacattctaaatggatcattttgggaggaaaaaaaggagtgctgaattttaaagatacaggaaacaacagtccaaccggtgatatggaagaagaataacattagctcaaattttaagttgttcttttcgcctccaactctttaaacccactaagcccaaattcattgtggaagattttactttttttttaacttttttttttatttttattgtattttacttttcttcttgaagcttcctaattctgcaaaacatgctatcacattttttctaaatttctcgcgcataaactaagactggtagaatgggtctacttgttctaggttgttccaccgttgattaggtagggtgagttgccttaggttagtaatgtaggtcaaaaatcctaatacgtccagacatcctatttaacgacattttggcaggttgatgaattcatttgccaaaaacaaataaattgaattggcaaatgggtggattaattaacctaaaaaataataaaaaggatgaaagattataaaaaaataaaaatatagatatacaaatattatctaaaacattttgaataactgactacataaaaaatcataaaatattagatcatcaatatttaaaaacatatcatcaccatacaaacagtaataccgtgttcacaaaaaaataaaaacccagtaatcccttgtctaaaaaatctacaaaataataaaattccgaacaatagtaaataataacatagacacctcatagtacgtttattaccttttccgtctaaaaagaaaaataaagcatgaaaaattcaataagaatactgttatatatattttataatatcttcttaatgctagttagtcaaaattgtcgtcttagagaatgacgtacgaaaaccaacgcataacctaggaataatagaagaaaataaacatgtaacaaaagaagacgaaacatagagatgatgggaagccagaatgatgtgaaactattgagctttgagttgagtccagttggtcatagagttgaatgggctctgaagctaaagggtgttgattacgagtatgtagaagaagatatcttcaacaagaccaatctccttctggaactgaacccggttcacaaaaaggttccggttcttgttcatcaccaaaaaccaatcgctgagtcactcatcatcgttgaatacatcgatcaaacatggaagcagcagtatccgctaatgcctcaacatccttatcaaagagctcttactcggttttggggtaccgtggctgataaggtaatttgtcacaccctctttctattgtaattttttaaatgttttcggttcattttttacgttgtaaatttctgaaagaaaggaaataattgcgaactcaccttcactccttcataatggattaagaataaattcaaatcaaagaaaaatttccttgtttatttatgaattatatttatttaaagaatatatatttttgtatagtttgcttttttatttccttcatatgcaccttactcctcgttgagtgcagagacagtaaaattcccttttccctcttaatacgtataagaatttcttcgcaatgaatgcaaaataacagaccaccggaaaaaaaaaaaaagaagcaaataattaaaatgttttggcctttaaaatgactctttcgaaacccacattgaccaacatagaaattgggcccaagtactcaacaacgaagaattttttcttattattaggtccatgacaatgattttactgtcaatcaaatttggccatgtgcattttatgtagatttacacaactaccattaatcgaaccaaaaaaaaaaaaagtaacttacaatgacttaaaaacaaaactagctgccattaaccaacaaaatcaggtaatggtttaatagtaattagatatttagattttatattctaccgtacgtgcaatatgaagtaagccaaaagaaagaaagaaaaccactccctctagcttttacggtggtatatatacacatacacaagctctattaatttgataactcattttcaacacctgttttatgaatatatatgtaacagcttgcgaagacatcatatgttgcaatgtgtagcagcggggatgaacaggaaaagagtgtgaaggaagccatagaagtaatggataaaatagaagaagagattaagggcaagaaattctttggagggtacaatattgggtatcttgaccttgcatttggatggatcccttattggcttcctgtttgggagaaagttgggtcaatgcaaatagttgacccattaaaacattgcgccatctctgcatggaacaccaattttctcagccaccctgtcatcaagaactgcttacccccaagagacaagatgcttgcttattcccgccgtcgcaaacacgagttttcttttactcttcgtcgttgagtcatgctttttcctcaatatctaattcaataggaaaatgtttggtagatacccaatgtattaactaatatctagagagagtaaaaaaaaaacttatatgtatgattagagcttacaatatgatacgaagaaaaatatacaaagaaaaataagaagtgttattaaaatgtgtaaaataaaagatgatttctgaataattatccaattcaatatgatttaggcagagggaaaaacctataagagtcaattcagagataaaatcgaatagaaaaaataaaatctttcttttcactaacctccagtaaaagaaattaataggcacgctagggattgactcaattgtactgtacgtttaatcttgggttgtgaatcatctgctgttaaataaattatataagccatgaaagacctacttacattttgggttcgtcattcctgcccctgcatatctctcggtattcaacatttaaatacatataaacaaatattcaacatttaaattaataatttgatgaaaaaaatgaacggaaagaaaagttgcctaagttaatgtcaatcaaagatacaaaattgagtactatgtttattagtaaaaacaattttttcaattaagaaatcatattaaagtaactatttttttcatgtgttgaagtaagatagcgtttccttccaaaaaaaaattaaggtggcgttatggactagccaatatttaaattaaatgtaattattcatttaaagaaaaaattgaatgctaatttttaatttcttaagtcaatgtcaaatacagataaaaaaaaggtaaaggtctgattattgaaaactatatgttacagtaacttcttttttttaaaaaataaaaatgcaaatatattacaataggcacaaacatcaacaaggtggtactcctactctcatctatcatttagagcacacttaaaatttactgaataaaagagaacaaaacaaacacggggagcaaaaatcaaactcattgcccaaaaagctaacatctaaaccactatagttaggcaaagctaacctattacattaaatacgttcaacattcaacattcaaaagttctaaatgtattaaatatttatagaattatacaagtcataaaatagttttcataaagcaatggatacatattacaagataaaaacggcatattaataaaagagaaccaggtcaaggtgacaagttaataatttgataattaattttcataaattacaaaaataaccaaccaacacattaaataattaacagcaaaagaagaaacacaaggagaagaatagaaggaggtgaagctctgaattctaaaacaagatgtgtagtgaagatagtgtgaagctggcgaacttttgggcgagtccatttggcaaaagggttgttaaatgggccttgaaactgaagggtttaacgaacggatacaaattatcgaatccgtaagatttttgtaagtttttttttaaagttaaaatatatattttcaaataatttaaaacaatgacacatgtaggactcaaatatatgaccttagatattccaaccaattaagttaataagtcaattatgttaaaaaataattaatgttgatatatataatactaaattttttaatgtatatttaatacacatataagtttacataataaattatgttgaaaatattaaagtaatagcatgagaaataactcaataatcaaaataaaattcaaattaaattaattatatatgactcattaattgataaaactaaaataaaagagaatcctatttaataggatcataactaacaattatcctaattaataaaatgaaactaatatccctaattaataaaataagaatctaaaataagaaaaaataaaaaaattagataaactaaacaattaaagatttagatgtgtattaaatatacctcaaaaaatttagtgttatatatatcaatattaattgttttttagtataattgatgtattaggtcagttggtttgaacatcgtgttaataacttgaagatcacgtgttcgagtcctacatgcatcattattttaaattatttgaaaaaatatatttggttatggagttgaacccgattcacaagaaggtttcagattcttgttcatgcccagaaaccaatcgctaagtcattcaccattcttgaatacattgatgaaacatggaagcagtatccattattacctcaagatccttatcaaagagcactcgcttgcttttgggccaatttcggttagcaaaaggtattttttattccaaattctctatttttttttttgaaggtttgttaaaccaatttggagattccatttgacgagataattcttgtaaaagcattttacatccatttttttacagttctaaattttcttagagagatactaagaatgaggatatatgttttattcgtttctgaatttttagaaacaatttacatatcattaacgaataatcggtggatgacatcaaaaagcactagggcaaatttgggtaatataatgttcatatttcatgcatattacaatgtgatgtttgattaaaaaataggtttattttgtaccattttttcttttttgagatttacaatgccacgtacactttcaacaaattaattatttttcagtgcctcctaatttgtatatatttttatatactagcttatgagtgcagcacgaaaagcaatggcaaccagccgggatgaacgcgaaaaggctagctcttaaggaaacgagagaactaatggagaaaatagaagaagcgattaagggaaagaaatattttggaggggacaacattgggtaccttgacattgcacttggatggatcacttactggcttcctgttgtggaggaatttggatcgatgcacataatagacccattgaaatttccagccatcacttcatggatgaccaattttctcagccaccctgtgatcaaggacaatttgcctccaagagacaagatgcttgtttactaccgcaacttggttaattaaggtttagatggatgtatttgacaaattatgaatttaataaaactactagctcttgtaaaatgtttttcataaattatgatgaatttattaaaaattgctcgtgtaatgtttttcatcaacaattaagactttgttgttaatttctttatagagtgaatttcccgttttaaagagttaattaaatattaatcttttataaagaataatatctttattagttgaataaaagttatataaactatgggagtaggtaatagggaataataaataatttgggtttgtaatatgtagtcgtcatccgattacaaaccctagcctcttcttggttgtattggcgtgtgtaatgcttattttcattaacggtatatacaagatcgagccttataatattggatacaactctatctagctagttagttatgagtgaagttcgtgagtttgatggtcaaattatcttactcgaatacaactaacgatgatggtaacagatcataataaacttatcttcatccatgcaatctagggatggaaataggtcaagttgtctatgaggggcctttgccctggcctggtctagtttgtttattataaatgtcaagtttggactttttgaaaagtctatttaaataaaaaaatcgggctcaagctttacaaaaagcctgttaggcctgccaggctaccctatatatatatatatagatagatattaaaattaaaaagatataaatcaatctttttaaaaaagagataaaataagataagataaaatctaaatagcttatcttactatttaataaaacttacgatattttactttgcttattttgtttacaatattttgttgaatactgtgttatgattataattcttaattgagtttgttgtaattagtgaattttaatctcatattagagtgctctaattaattttaatttttttcacatacaaattaaaagggaagtatgtcaatatgtgtatttctttatattaaattaaaaaaaatattatgcaaattctcgaagtttcactaatatataatatttattgtaaaataggctttttaataggttcataggccaagtcagacttttaaatagtctaagccaagcctaaaaaaataggtaaataggttaggccaggcttgatgtttttaaataagggcaagatcaaaattaggcctaaccaaacctgacctgacctatttccatccctaatacagcctttctaactagcagcaaataaaattataataagttccatctaattaatgtcagaacccatctctaatgtaacattgactattgaatatgctaaatatataaatagttttaaaactaagacaaataactaacgactgaaaacgacccttatagtgcagtccaagcatgatgattacaaaagatagtagtaaaacatttcggacaatgttattatggcagggnnnnnnnnnnnnnnnnnnnnnnnnnnnnnnnnnnatatatatatatatatatatatttttttttttttttcaaaacatgtacctaacatatgtcagtccgtatacatgtttatgtacttaattaacataaacaattaataatacataattgtttgaataattttatttatactattaattatgaagaatataagtaagaacagtttagctaggaaattagaaaaaatcacgttaattgttggatagtgagatgaaggtgccaagtgcaatccaatccaacgccaatattggtcaaatttgtctgccgtaaccaaccaacaaaagataaataactaatttgtgtatgcatattgttgacgagaaacagtgaaacacacatattaaagagacacgtaaactataccaaattaaaaagagaggcgtgtaaactataccaaattaaaaagagagacacatacaactacaaatgtattagagatatagaagaaacaaattaaaggaattgaaattatattttgaaagaagatgggaagcgaagaagtgaagctgttgagcatttgggtgagtccatttggtaaaagggttgagtgggctttgaaactgaagggaatagagtatgagtatattgaagaagatatctcaacaaaagcaatctccttctccagttgaacccggttcacaagaaggttccggttcttgttcatgcccacaaaccgattgcagagtcatttatcatccttgaatacattgatgaaacatggaagcagtatccattgttaccttacnnnnnnnnnnnnnnnnnnnnnnnnnnnnnnnnnnnnnnnnnnnnnttttttttttttttctctttcaaattcccttaatttttcttattgaggttgaaccaacttggagattccatttaacgagataaatcttttaaaagcatattgcatcctttttcgtaatttgtatttgcttagagaacgaggatgctttttttttcctttctgaatttttaaaaccataagaccatgtgtctgtctgtcattaacgaataaaaatttatgactccaaaaaacaccaaagaaattcgactgaagttcagatttcatgcatatgcaatcacaatgtgatgtttgattaaaaaatagcattattttgtacgatgttttttacacaaaaccacactttcaacaacttattattttccaattagtgcttgctctgtatatatttatatataatacaatagcttgggaaggctggatgggtagcaatgtctaccagcggagaagaacaggaaaaggctgtgaaggaagccatagaaatgatggagaaaatagagacgactgagtgaaaaatgtgcatattcgtaggtaagcaaactggattgagatctgatattccaatccaaacccatgtcagtaatctgtgtacattattgatcgagaaaactattttatgtggtcaaagtttatatacttttatatccatgaattttgtccttaaactttaaaaaaataatacgtagatttagtctattctctttaagaatttatcatgctttttaacatattttcttttaagtttaagaatcaaattcatcttgtggtgatttaatatgttctttaccttgttggtgttggttccgtttaatgctgttggcccaaatccctaggtgtgaaagggaattgtgattgggcccaaatcccaaggtgttgaccttggcccatttccatttagggtaaatccctaaatgctgtgcttctctataaatacccccattatagatggaggcaggtgacgcaacagaagattccagagctgacgctaggttgcggcagtgtgaggctgagcgaaaacagagagtgagtatttctccggcattgttggccgtcgagggtgtatctccgagagcttgtgagaggttcttgttgaggggtttcacttctgttgtaggcgaggctgggtggctccggtgagtgaccgttgagcatttgtattcattatttctgaatagtggatcgttttctggacttggtcccgtgggtttttcctcttgaaggttttctcccacgttaagctataatgtgtgttgattctctccctgctcttccctttgttttatgattctgtgtttccgctgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgattttaattgttaattcaagaaaaagattaaaaattacatatttattttttatataaaaatatcgtatgatgcaaatttattctttacatttctaacatagtaaagcgttgaatgtttttttaggataatgaaaaaataaacatataacattatattttattatgaaaaatcataatcaaaaccatcaatttttgtgagttttttaaaagtcacataatctctacatgtgaccccatgactttaaaactttatcacctatgaatggttataagtctcatatttatcattttnnnnnnnnnnctcttccctttgttttatgattctgtgtttccgctgcatattgtgcattctttcgtgttttttgggctgttctgggttgagacattgctccccagtgttatggtttggtagaggaagctcccagtcgaccagaggaacgtggtaccgggcacgttgtatccgggtacgtgtggtgccgagtacgtgaggtgtccgggtagaaattccacgttggttgtggtgccgagccgacttcgtggcatcggattgcaaattccacaacaccttttcataggtgatttacagagcacggttctttcgaccagggattgtgcatgtgaggttagtgtagtttagcactgcttttgttcgggttttaagaattcatattgctctaatgaagaatcaacataactcacagagttggcttggctccacaccctccatttgcacccttcaaaatatttccagtacttcacaagggtttgagctctgagataagcctgaaatcattgcattccaagaagtaatatctctgagataagtctaagtgacccatctcacagtacatgtcaacaagtcctcgttaccatgttttgtgtgctaaataattgaaaaagttacgcatagagagaggtgaaaacaaataccacaaaaggtacctaaaacccccgcatcccatcagactgtctgactgttacataagcctagaataaatccaagtaacttctgtggatatcaaaacataattagaaggatatacttgtgatcatcgacagatattaattagcagttaagttagtagaaaaaagacaagaaacagtacatcgatgcaacaatggttctaattaagtgaaattaacgtgctaacttgaaaatcaaaaggccttaacttcctttcctataatgtgaagtgaatcatctgcacaagagtatgaaaatgacacgttgttggatattcattttgagtcagaggtggaagtgaattttgaaacgaagtccatttggtcaaacttgtccccacatgagaaaaccaaatgaattacaccgataatttgcataaattacgagaataacccagcagacacactattaaaagagaggcacaaagaaggaagtggtgaaacacggaaggaagatgggaagcgaagaagtgaagctgttgagcttttttgcgagtccatttggcaaaagggtagaatgggccttgaaactgaagggtgtggagtatgagtacatagaacaagacatcttcaacaagagtagtctccttctcgagttgaacccggttcacaagaaggttccggttcttcttcatgcccacaaacccatcgctgagtcattcgtcatcgttgaatacgttgatgaaacatggaagcagtatccactgttgcctcaagatccttatcaaagagcacttgctcgattttgggctaatttcgctgagcaaaaggtcatttctaaacccccttttagcttttgttttccgccagtgggtttggcagatggcattttttttcttcataaatattaaagtgagaaactataatttttatttttaatatgtaattaataaataaataaataaaattcataaaaaacttactatgattctttgaaaattaattttaattcattttttcgtaaaacatttttaaggagaaaaaaagaatctaattttatcgagtaaaaaaaaagttttagttatatattttacataaatctttaattctcatgattcatattaaaattaactaaacatatttaagatattgtcaagaattatgattcttaaaatttatatttcctgagtataaaaagtttcttaactaccaaacacctcataaaaacaaacctatagattccaattgaggacccaaatacattcagcttattgcatagtttattttatagaccattttatgaatcaaatttagactacaaagactagataatgtagcaaattctcgaagtctggtttggttttttaatacaattgaaatattgtgacagcatagagtttttgtctttaacaaattatcatattattaaactaattaacttttataaacctaatttaaaagtcatgcatacaatattatctaagggcgtacttagtatgaactttttatacttttgatattttatttcatttgctttttggaatgaaaatgaacatgttattgtttttctatgttactctgtcatttattatctatatatcaagtgagttattcacatcttgttcgaaaatttgaacttaaaacaatataaatcaaagtgaagtgtggtaggccgaaaactcacgggtttcagaatggctcagacagctttagagaagcttcctttgcttcaatgaaagcattgatttgtaagccgtgattttaattcataatatagtagcacaaaattattttttgacttcttttgggatatatatatatatatatatatatatatacacacgttaaactctattcaattaacttgtttttcaatgacatccatgtatgtaagtaataacttatttttcaatgcttgccttgtgtgtgtataacagcttttagatgaagcatggattagtatgtatagcagcggggatgaccagcaaaaagctgtgaaagtagccagagaagcaatagagaagatagaagaagagattaaggggaagaaatattttggaggggagaatataggataccttgacattgcacttggatggatctcttactggcttcctatttgggaggaacttggatcgatacagataattgacccattgaaatttccagccaccactgcatggatgaccaattttcttagccatcctgtgatcaaggacaacttgcccccaagagacaagatgcttgtttactaccaaagtcgcagagatgggctttcttcaacttttcagggctgattcaaggtttaatttagatctattcctattcctctatatgtttcttatggtccatgttataggccatgatattggattgccttagtatcataagaatatgagggaatcatactagctaagtttgtgtgttggggttttttgtgctattattttctgcggatgccaatagcaagattgtggattagtttgatgtcttaagttaaaacttgtggaataattttgtgaattttatttagactttttcttgttatgtagagaagtttctttggttaaattttcaatattaaattatgtctttcttgttatcttttcgttgacgttatttcaataaatttaataaattataaatgagttgatgaaataattagccaccattcactaggatgtaaagcatgggaaatggaataactaaaatcaattgatttgcgttcttgattttaattgttaattcaagaaaaagattaaaaattacatatttattttttatataaaaatatcgtatgatgcaaatttattctttacatttctaacatagtaaagcgttgaatgtttttttaggataatgaaaaaataaacatataacattatattttattatgaaaaatcataatcaaaaccatcaatttttgtgagttttttaaaagtcacataatctctacatgtgaccccatgactttaaaactttatcacctatgaatggttataagtctcatatttatcatttttaatcattataagtctcaaatgtatcattcatataacttcttataagctcacattttttgtgtgagaattcttacttttgtgtaaatataagacttataatgatcattttaatataattctatctcattctttttttttaagactctttatgattgattaaaatttattaaaatcattatatttaataggttttacttcttatataatgatcatttttcttaatttatattaaacgaaaaacaaaatatactaaaattgatgatttatgataaattttgatcaattataaaatgaatctttaaaaaagtgttaagaaaaataccactaacattcctcaatgcattctattgtaaattataatcctcatgcaaacttgtaaaatcgattccaactcatcatccttgggttagtaatttttttttgtcatatccatgtggttcgtatggctaagctgctacgtatatgattcttacaagcttcaatgcttcatagttaagtggttcaatcctaaagcttatttatatataagaattcacttgagcttgtgggaaagctcatgggaaagctcaattagcacgcatgtggagtttgtgataatacatattggattctcataaaatacactcttaaaaagaaataaaaaatattaagtataattaaatcccaaactaaaggattacaattgttattataattacccatataaaaagttcacaaatttaaatttattgactgataaattatacataaccttataatcaatagtcaacaatatttttgtcttttattataatattttatttcatctctattatgcattaattattttttttactaaaatatccttatttatttcaatttataattaaacgctactttaaaatgtcaattttccttattgaagaagataagtaaactctcattaatgttaatgacaaattttaaaatattacaattaaagaaggatttaatatcaatacctatattaactaattttcttaattatgtgttataaataagatgagagagagtatccttttaagtaacatctagtagttgaaacaatcagttttctttcgtccaatttgtcattttatttaaatttttcacaaattaaatcattaaattattttaaacctctttctcttaaaagctactaaccaaaatacaaaattttattttttataataaaacattttttttaaaaaaagtcgaaattttcattcttcaaaccccaatcttatcttttacaatttttgtcttcaaattttatcaaaatttcattaaatttctaacaaataaatttctaaaactcttatcacaaatttattataaactccccccaaatatttgaataaaaagtgaaaatataatgattttcgattaagatcactatttactgcaaccaattacggcctacctaagaatttctcatcgaaggtcaaaagatattatgtccaattaacataatttacaattataatttataaatagaaatagcaatcaagttacggtagtcacctctgccaaaagaagaaatggtataattttacagtgtaatcatacctaagctagggatcattcgtattataaccaaaatcagctaccttacactacaaactatacaataatatgcaatggagacgtgaatatataaaacatcatcacataacatttgcattttaacctactcttaaattaccacgagacggttatattcatcagaagctaaaacctgtttacacttgaaccttaaaaacaaaacttacttaccccactcatgaacagggagaggagttagccttgtctcgttactctcaaaactaatatcatccaaaccacgacgctctgtaaaatttagcggtgactgatcacacaggtctaaattccaaaacaacttgagataattcaggcaggcaacttcagtttcgaattgttcttccagctgaaaaacaaagctccttaaattacctatttgttatatgagtatagtaaaaacaagatggaccttaacagacaataaaattacctgacgaagtaatagtaaaagaaatctgcatacaaagctgtctgaacaacacctgagacacaagctgtaatagtaaaacaatatagaagttagaatattgctaaggttgacataatgtcaaagtaggttttattttcaccctttattacctatccatctagtaaaatgtggctcagtcagatagcggtatatccagttcaggatgtaaaatgcacgatatgcactgcattttaaaaataatcagcacatctttgatcataataatcagtacattctataagagtttactcttatacattctgagacaagttcaaattgaaatgtatgtacaacttactaaatcctcaagtaattgtgcaaacatcaagacaggagacaaattaggaaatacataagcagaagagtccaattcaacccaataaacatcaagatttccaaatcaggtaccacaaaaaagttcgggcaaacatatacctatggagctaatttataatacatcactttcgaggagtttaatttcttagctatttcaagatagaaaatattagtataccattgtcactagaagatatctcaataacttagaaaggactatctgctaatgatcagcataaaggagtgtaagcaagtaagcaaccaaaacataaaggcagatctttaaaagagaactcaacagaagtgtgcatacccaagaaagaatacatattgcccagtcaaattgtccacatttccacttctttgcaacaaaaccaactggggtaatattgcaactgcctccaagtatattgaaaatgcccagaaaacctgtaacagattgacataacatcaactatttatgatgttacaatgtgtaacagaattatcataaaggtaacatgtaatgcaaaaaacaattttcagattggcaatcaataaggaatcaaggataagcaatgtatgtttggacaggaagaacacatgaaaccatgtgatgtatttgctttaacttttgcaatattaacctgaaaaataatgggaaaggccagttacacattttgcagattccataaggaaatagatattcccagaagttttataacacaataagcagcagcctatcgtaccattttatgacttttagcctttcccagttaactatgtatcagagccataagacatgtatgcattgcatttttcaaactatcaagtattaacgacgtatctttttctccaagagttggcatcaatattgtaccaaacttggtcatcctttcaagcatgataccacatgggtccctaacataatgttttttatatttccacctaaaatctgaagagcattcagaaaccaattacattttttggccaatcaggaagagaagcagcgccaaacaatagatttagcactaggcggatttctagataacataacaactagttgttaataaacttacaaaatcatcaggccataatataatttacttcagcttcttatcttggttaaaaaaattggaagtattcattccaataatgtatgacaaattgacaattgacagagtactgaactattggtaaattttcaactactgaaatttatcttagaaagcagcataaatgatccagtttccaggattaaaatacaacaggctcccaaaatttgagacttaaaaaatagagttatgaggtgatttatcatttatagaggctctatatgacatgagtcaaatggtaagacataacataaaaatagagttatgtaagggaagaactacattccttagctgttagcacttagcatcactctgaaacaaaaggcaacatgagtcacatgacacagatcccctcaaagaatcaattgatatactcactaagaaaaacatgttattatcaataacacaattagaagaatatgttcacacagctagcattggttcattagcttaagagctatgccacatcatatggaccatataaatcttactcaaaagtaattgttcaatgaaactcatatatactaaactgtaacccaccaatcaatctcacggagattccaaatgaagaaacacttgagaactttgatcttaaagttttatttttcctcctgttttgtgtaagaacagcatttgaacacataaacatggttttcacgccagaaaacttaaatggatacactactgttcagagaattttggcaataccatcagattcaataatttgacaaaattaaacactcttcaatgaaatattgaaaccttgagttgaatacaatctattgaagctttcttttaaagaagtaaaaattcgaagaaatgcacaatgattaaccatcagaaatcagaaactcaatacaaatgaaaaacaataaaaccccacagctcaaatacagaagaagacaacatgcaaatgcataaccaaaaaatcaatctatgccagtacaacactacttacataacacattcacaatgcaaaactctaaaaaaaaaaaaaagaagaagatatcattcaacacatgaatcattagaaactaaaaccaagctaactagaaagcagagaataataagtgcaaaaaggggagtgagttgaaaaagcaagggacctcttgaacagtgaacttttcatgcaagatgagtgccatagcaaagcttgccccaacaaggaaataatggcgaaaagtgtcgagttccctatcgtaacttctcctgaccatggggtgaaaacgcatacaccaaacaatggctaaggagctggcaatgaacaccaccttcatgaaggtgttgtaaacggagatgaagtccgtgaacagatccaaatagcgtgccacgaacacaatcgcgtagagctcttgagtcttgcgagaaatccctgaaaataaacagttccaatcaatcgatgaaatgatggaaaataaacatagggaattttgtttggcggaggaatgtgagtgacggaatgacactcgagaatgaaaatttggaaaatagagtaaaaaaatagccccaattttgggggaaccacgagaaaagagagagagagagagagaatggagtgaagagacctgagcatgatttggtggcgtagattttgaggaggaggacgagaatgctgagaagatgtgtcatatcaccggcgagcctgaagatgttcatggtttttgccctagcgagacacacagagagaaaacgttacaaagggaacggagaaagaaacgaaatggaaaggaatcgaaaatggagtgtgtggattttattttttttgtttctcttatttatttttttggtcgttttggtaaaagcagaacagtataagcgtgtgttcgtgtgccttccgtgaaaaggaagaagctgacggctgaggtgccactcgccctcgtctcaccgcttccttctttttttcttcttaaaattaatgaaactttaatgatttaatctcgcaataaaattaaaaataaatattaactcaattcattgtattttacaaatcatagtttaacaatttctttaatgtttaaatatgtcgtaactaagattggatagtttagatgttatttaaatttgaacatttgaaaataatttttttgttaaactttccttatttattgatcgtattctaattaaaattcattttcatttataaatcagaagattaagaaaaaaaaaaccatagtttaataatcaaaatttcaatagataaattacactttatctaaaaaataattattaaatattttttcatgagtcaactacagagtcattcagatatttcatggcaatttccctctttcctttattgcttttgccccttttctttgtttctttcactctcggcacttcaaccttcatttcgacaccaaatcaagaaggggagaaacaagcacttctattctggaactgatgctgccagaaaaacataagattccttcgatctgtgcacaaaaggtaatcatagtcaaatgatgcattgataatgtcctgctagttgaaactcaggaagaaaaaaaataatcatagtcaaatgatacattgatactgtcatgctagttgaaacttaggaagaaaaagagaagacaaaaaaaatgtgtagatatgattagatgatatgatgtaataagaaaagagataacagagaattaataagtgttgatagaaaatcttaaaacttcaatttactgttccgttttcctaatggattagtttctgataccgtgtttgttttcagtttcacaagaagactaaggaatatcatagagaaaaaaatgagcgctattgtttccattaccagaaagaaagtttgaggaatacccaattacccgacaactatgtctcatgtttcgcagcaattgcagaatggacgagtgccacaaaaggcgagatggggcaaaggacgaatgtgaagagcctcaggagttactacttggtgcaaaaagtgttagtctgcctatccacataaagcaagcacgctctttgaatggttgtgaggtctctgaatccatgagctcaattttgaatcaaattatgatggctctggcgcaaccacatatcatcattctaggggtgtatggatcaagtaatgcgagaaagcgaacgtggtggagaaaatcaccaggagaattcggagggacaatctgtttgatgtggttgtgatggcaagtttgatgaaaaagccagacttcagaagaattcaagatgagcttgagaacatgctgggtctgcaactccatgagaagactctggagggaagagctacgcgtttgcgtgaaaggataaagatggaggagaagatccttatcatccttgatgatctttgggtggaatcaacttgggtaggataggaattccgtttggaaatgatcacaaaggttgtaagattttgttagtagctgagagtcaagaagggttgtccaaccaaatgaatactcagatagaaatatccgtgtgagtcttcagaaatagaatggaaactagatttgaaaggtcagagttatcaataaaaattttcaatggcaaggattaccatcccctttcttttaaattcccaagttgaaaatctttctataatggtttatgcatcttatcttgaacacactcccttcttaattctgccttttcacatctttgactcaatctaatgtgttattatgatataaataaaatttgatggtgaacataacttattaaatataaaaaatgaacatagaggagataccgagaaattgtgcacggcaccccttataggattaaacacacttcgtacgctgggtggcacacgcatctcctattttgcaatttattttccttagaaatgaagctacataacatttcgtgcatcctgataagtcttctcacgcggcggtggcatacatagcaaatgaagtttgtggcataaattaatcagtattattctctcaaatgtgaaatggtatatgccaccgcctgcagcttgtatataactcgtatttcctttaggccattggggtatatcagcttctgctattggtttcagacctttaattcttcaagcccttctataaacacaacttaatttgattcaatatagcctccccttaacttttaggacagttagtccttcacagcacacccaattaaggaagtagatattattattcaatgggggctgctcttgcaactgctaagaaattaaagaaacaaccttgtcatctcagtgacatgcacaactttgagtcccaagtagaggaactaagaaagagcaaaatgtcaattgcacctcttgcttgtttcttacagccacatcaagcaataatttccaattgttccaaggtctctggattgataaacacagctctggaagagaccatggaagctctagcaaatccaaatattaacatggttggggtgtatggatcaagcactttgcatacgaacaatttaattgaaaaaatttcaagaagagtaaagagagataacttgtttgatgtaactgtaatggcaagtgtcacaaaaaagccagacctgaagaggattcaaggagagctcgggaacaagttaggtttgcaatttggtgaggagactgtggttggaagagttaaacttctgtgtggaaggataaagaaagagcagagaatccttgtcatcctagatgatctttgtgctggaattgacttggataaagtaggaatcccatttggaattgacaataagggatgcaaaatactcttgttatcagggtctccagaggtattgttcaaccaaatgaacactgcgatgaattatttctcgtgagtctttcttctaagaataacacaactttttgcagagagatcagaagacaagagatattagtaaagtaatttaaacaactcagagaaaacaatatctcttttaattgaaagcagttttttttatctattcaagggtatctgaagctcagaaaccatagtgttgtgaagatgaattgtgaagactgaagaaactgtataagccataatagaatattataattaaagaacatggcttctatctggtttgtttatctcacagacagcaacaataaattgacttatgttttattgttccacagggagaagtgaggcatttattagttttcacattttggataattaattgaaacaaatgataaaaaacaaggctttaatagtttatacagcttgcttaattgtgattgatttgatttcaaatctgcttacttgagtgataatagagtgtgtttcctttttctacactagtgtgcatcttttatcagctcacaaccaattgagatctcacttctctatcaactttatctgccttgatataccaccttaatcttcctaactgattgataaaagatatccccacaaaatacaaccgtaagttattttacaactaaaccttgtacctaattaccacccacttgacatctatataagcaccctctccataccaccttctacgcgccaaaacattctttgcaataacgacttccaattcatttgcaatttagcaacaaagcaagccttcaataaccaacaagaagatgaatcagtctcttgttctcactccttctacttgccccatttttctctttcactactttagctcagtcaccagctgcagctcctaaagcccctgcaaaacctgcccccgccacaccggctccagcacccacgaaaccattggtcccggcattacctcagtcaccctcttcagttgttgattcttctagaagccaagaaattgtaaagatcctaaggaaggccaagtcattcaacacactatccggttgctgaaaacaacccaaatcatcaaccaagttaacgcgcagcttgtgacctcgaaaaacggaggcttaaccattcttgcgccagatgatggtgccttttcagaactgaaaacagggtactgttgcgttcacaaagagcgattgcgtaactcacggcaagtatactgatcgttcaagtaataaatttagtaagtagagtatcgtcttcacgaggattgaggcactaaaataattgtaactcttatcttaaaattagaaagaataaaaataaaaggaattgaatttggtaataatgttgtgatttgaatttagataataagacagaatttaaataaaagaaaattataagaattaattatgagaatttatacagtaataaagaataattgtgatgaaaacctaatcacctttgatccctccttatgtaaattgaattgatacttaattacaattgttataattactcaaagatataccttcgtatattggttaaacccagatttcgcggtctttttaaccctttaattctattcaagtgtcctaatgtcttagtaacccctttcagattaagcattaagctattaaactggaatataaaaactttgcaatccttcaatcctatgtctaggtaatgtcaaactgtctctttattgctttcagaaactaaaacctcaatatgtctattgcgaattaaaatcctaagttcttctaacagattgatcagatctattaatggaaattataaattcaagaacaagataaagggaagaaatcataacaatattcattaatcatcaatccaagaaacataagagttcacattggcttttggccttcaccacaatcaaggagtaattagctagacataattatgtctagctcaatacaaagatgagaaattagatgagacagaatacaagatagaaaagtaatcaaacccctcaatcttgacttcttccaattttcaatgctttattgatttcctttaatgtctccgtgtgtgtatctgtgtatttcttcctctgaaagtattttgtggcttccttatttatagttaggtttgttaaccctaaaagctcattgatcttatcttatctttaatctttaatttgaaattcccgtaacgtgcgcccgactggcactaatttcttcctttattgttcctaaaatgcataaaaataacaataattaataatattcaaaaaatactgaacttttggcctaattctattatttatttaacattttctacttaatttttactaaaattatcctaaatttcactatatattagcaatccatcaggtacttcaactcccagggagataagcaacaaaaagcattgatacagtatcatgttcttcctgtttatgtgtccagctccaagtttgatgctctgagcaaccctgtgttcacattggccagtgacagccccacagggtatcagttaaacgtgacagcatatggtaacagtgaaacatttcaactggggtggtgaatgccacattcacaggcattgtgtacactgataaaacacttgccatatatcatgtggacaaggtgctcattcctttggatttctctaagccaaagcctatagctccagtaccagctgtggccaaggctcctaaagctgataaggacaactcttcagcagaagatgatgaccaggctcaggcaaccaaggacagctctgtatccgtcggtttgactagtactcatgagacaaccttggtgtcctttggagttgccaactctttcttttaaatccaaagaaatgtaagagtgaagattaattattgattgatacaaaaataataataggaaaagatcgatgagaagatgtgaactcattataaggggattttttttttttttctctctaaacgccgaccctttgtttgattgatgttgtctttctcttttatcatcatcatcacctaataaaagtaaagttttcgatgataaattcagttattaaaaatattattttatcctttttcctaagtagggtaaaaaggaatcaaattgatcagtgtgtccaaaccaaaacagctaaacaataacaatattatttaacagtcttttagtctttattactattttatcgataatgtgacaaccatctattaaaatacaaacttgtatttcttaaatgataaagattaaaataaagattttttttttcatataaaaacaacgtactatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaagtcataaaaactaaaaaaataacattaaggattaaaattataaaataattaagattgcataaggatttttttttagacagtacaaggactaaattagaaaaaaaattacaataactaaaagcataaaacggatgtattaatttataactacatttcaactttgtttaataaaggtagtttgacaaaaagagctttgttttagtttatttactcatttaattcttataattataaaaaaatttcttttattgtccttatgcttaaaaacatcatctttaattccttctaatcctctcagtaaaagtaaaaatatataggccggccagttatttgaaaggagtctactatctaacctacctgagacatatgattgaacagaactttttaaaaaataaattagataaagacttttattaagaaaacagattcgcatacatatataagctagaatcgtacacttcacgtccatctgcataagtggttagttacgtgtatatttaatacattttaatcaaccatagaatatgtttaaaagaacatattagggcgttcctaccttttctcttccacttttaatccttgcctggcagtttcacgagtcaacaacacagtaatattttaacacttcctagcaatgttgcatagccagaggagcatttcccagaaacttggttcttttctttatttttgcttctataagctaggctttttctttgcatcttccactctcgtacttattaatccttcttttccactccactccgctccaaaccgaatagggagagaagcaagcacttcatatctataaaatcccggaactgatgaaatagcagcaagaaaaacataaggcatgtttgagtaaacattcatagaagaaactcactattttcttgtacgttaataatgcatgagactgaacgcgaacaagcaaccatcacaagcatagcagtccgtcgccgtcggggcaaagtgtaagaaacttttctttactgttctatttcactattagaaactaaatgggagctatatattgagagaaattaagtttcagaaacacccaattgcctgacagctatgactcatatttttcaggaaagtgaggatggatgatagtaatgaggtacaaatagcaataagggccaaattaggacgaataccctccaactgcgcgccctgcaattattttccaacttcggaggatccctatgaggaatcacttaacgcaggcgattgcaattctcctcgttgtgagtactcatttagtgcaggcaaatgcaatcagatttttccgtccgctaaatgcaccttaattgttgatgaaataataactgctctgaggcaaccaaatattaccatagttggactgtatggatcaagttatgcgagaaagcaccaagtggtgaagataatgaccaggagagttgagagggacgggctgtttgatgaggttgtgatggcaagcatgacgaaaaagccagacattaaaagaattcaaggagaatttgagaacaaactaggtctgtgcctccaagaaaaaactctcaagggaagagctacccgtttatgtgaaagtataaagacgaaggagaagatccttattgtcttggatgacctttggggcggaatcaactttggtgagataggaataccgtttggaaatgatcacaaaggttgtaaaattctgttagtagctgagaatcaacaagtgttgtccgacaaaatgaaaacccagaaagaatattctctggacgtgcccgtcaacgttggcctaataacgaggagtttaagttgaaactttctggatttattttatttagactttctcaccgaatttctctcataaggaaaaaaaaaatggacactttggaatgtcattagacacctgatgatagaaaaaaataaaaatattataagatttataatatgataaaaaaataaaaaaaaatattgataaagtgtttaatattgtagaatcctcatgtattactattattgtaaaaaagtttgtttttattaggattcagcgcagagtgcagttttctgcctgatatgtatttccgttgtgtgattaagtattgttagcttattttattaaatttatttcaacaaatttaataaattttaaatgtttttgcattaaatttttattaaataagttgttcatgtaggagaataccaaaaagagagggtggagcgttttagttcgaagccaaacatgtaatcatgaattttggtgagtcatgtaactcatttcctatttatacatgatgtctttgacaatatctttaacgtgttgaaatcttattagatacttttcgccacaccattgtggagcactggagcctatataagtctacgtagtatgtggtgcaagattgtgtgcgtctcacatgtcagtcaaaccctgtcaccacgtctttagggtattatttcgtattgtacctccaatcgcttcatcttctcggtcatggagtgagttaagcgtcattctgatgacccggtgtcattgaggcgagtcggttgttcgagaattcgttttgaatgatatcttgtggcatagatatacataaaaacaagtcatccctcctactagagtcagcatttctgggatattcatcctggatgatgatgtacataagtatttaatgaaaatatttaatcatatttgaacacaacaaaaatcatatttaatgaagatatttactcatcaataactttggaaaaaagaaaaagaaaactaaaacatcaataattttggttcaaaaagagcagaagagttatgtaaaaattagccaccacccgtgaggtatctaaaacatgggaaagggaatatctagtattccgaccaatgaacttgcccttcggtttcggttttcaaaatctggaatattcaattgcagaagcttaaatgcaggtaatgtagtattaattttaaatccttgcctggcagtgacagcttcacgagttaacaactgaggcatctagatacttcctagcaatgctgtttaattagccaatgggtcatttcctggcaacttcttcactcttttgtttattggttttattgttttaagccttttttttatttgttcctctctagtgtcatcatatgtaaagcttcactcttttgtttattggttttattgttttaagccttttttatttgttactctctagtgccataatatgtaaagctgtccatttggatatttaatgtaatgtaagaattgattttgaaatcattacttaaactaaaataatcttgtatcaattgatataggtgttcaataatttcatttttaattattcttcttagtatgattgactcgatcaatgtgttattatgatatagttaagttttatagcaatcataatatgttaaatataaaaagagaaatgttactaaaacattttttgacatactcttttgaacatattatcttttattgattgaaatttcttaaaaattacataagttagtgggtcttatatcatatttaataactctcttttatgattttgtaattttcaataaatttcaactaatgataaatgtatgtttaaaggaatgtgttaaaaagtatcttcctagccctcgtcttatataagaatgaacacaggagagaaaatgtgcccggtactcccatcatatacacacttcatatgtacagtggcgtgtgctctccaatttatatttgcatatattagagtgtgttagaatgttctatttcgccaacatttttctttttttaagtgcttcctaagcaatgaagccacctaacatttggcacttcctggcaagtcctcttacgcggatgtaacatacatagctcatgaagtttgtgaaaataattacccattatttttctctcaacctgcagcttcagcttgtataaaaatcattgggttatatctattggtttcagactttaattcttcaagcccttcgatctataaactaaacttaatttgtttcaatataacctccacttaacttatatgatagttggtgccggaggtaagggatttgatagaaaaagatttagtgttggatgtttgaagtcctataccaagagctatcaaatgtgagcataaagagaatcttagtaatataacaagttattggactccggtctatatagacccatataatcatgcatttaacttattagacttgtatgtgaatatattatttaaatatatattaaatatattcaaaagttggttcttcacagcataccaaattagggaagcagatattaatattcaatgggggctgctcttgcaattgctaaaacttttaagaagcaaacatgtcctctcagtgacaagcacaacttggaatcccaattagaggaaccactcagcaatagcaaaatttggattgttttgtacctcttgcatgtttcttacctctaaagcaagcaataatttccaattgttatgatgtctccggattgataaactgggctctggaagacactatggaagctcttacaaatccaaaataacatggttggggtcatgggtttatggatcaaccagttcgtgcacaaacaatcgaattgaggtctagagtaatgagagataacttgcttgatcttactgtgatggcaattgttacagaaaagccagacctgaagcagatacagggagtgctagcttgggaacaagttaggtttaaatttggtgaggagattgtgaatggaagagctaaacttctgtgtgaaaggataaagaaacagaagacgatccttttcttcctagatgatctttcttctggaatttgatttggacagagtaggaatcccatttggaattgatcataagggtttcaaaatagttttgttctcggggtgtccaggggtattgttcaaccaaattaacactgcaatgaattatttcacgtgagtctttcttctaagcataactcaacttgtttgtatagagatcacaagacgagaaattagtaaaccaatttaagataacaaatagaaaacaatctctcttttaacatctctagatctttccctatgaatagcagcattttttgcttatgttctatttagttgaaacttgaaagcaaaataatctttttttcgcttgtatttatttcataagtacttgaagcttagaaaccacagtgttgtgttgatgaattgttaagaaggaagagagtatataaaccataatagaatattatgattaaggaacctggctttgatatggtttacttatctccctgactgctacaataaattgacttctgttatgattaattattcgacagagggaagtgaggcttttattagtttttccaacctggcttttttatgattgattaaacaaatgataaaaaaaaaaaataagggtttaacagttactacagcttgcttaactgtgattgatttgatttcacatctgcttacccgaatgataatagagggcgcttcctttttctgcactactgtgcatctttcatcagctcagcacaagcacaaccaattgagatctcttttctcattcaattttccctgcatttcaagcaaaaggacaaacaacacagcagccaaatccacttctcaatcaactttatctgcatcgatataccaccttaatattcctaacagatggagaaatggtatccccacaaaatacaaccatatgttattttacaactaaacctttgtacctaatcaccattcacttggcgactatataagcaccctcctccattccagcttccacacatcaaaacattctttgcaatagcaacttccaattcattttcaatttagcggcagccttcaattaccaacaagaatatgaagcaaactctcttcttctcactccttctactctccactattttctcaatcaccactttagctcagtcaccagctgcagcccctaaagccccagcaaaacctgcccctgccactctggctccagcgccggcaaaacctttagtgccttcattaccccagtctccatcttcaggagttgactcttctggaagccaagacattgtgaagatcctaaggaaggccaagtcattcaacactctaatccggttgctgaaaacaacccaaatcatcaaccaagtgaatgcacagcttgtgacctcgaaaaacggaggcttaaccatccttgcaccagatgatggagcattttcagaactgaaagcagggtacttcaactccctgggagaccggcaacaaaaggcactgattcagtatcatgttcttcccgtttatgtgtccagctccaactttgatgctctgagcaaccctgtgctcacattggccagtgacagcccgacagggtatcagttaaacgtgacagcatatggtaacagtgtaaacatttcaactggggtggtgaatgccacgctcacaggcattgtgtacactgataagacacttgccatatatcatgtggacaaggtgctcattcctttggacttctctaagcctaagcctatagctccagcaccagctgtggctaaagctcctaaagctgataaggacaacgcttcagcagaagatgatgaccaggctcaggcagccaaggacagttctggtgccatgagtttggttagtactcatgggacaaccttggtgtcctttggagttgcacttcttgcagcagcagctacaatgtcgtgttgaagaacatccatttctccagagtttctaatatgttttgaggacaagcacgcaactgttgtggagttctgtttttgttgttttcttcttgacctgtgtattgagtagcaaaagtggtgtttgtgagttatgtgaacctttgttctgttcttgttttgtcatcaagcgaaaaaatatgtgattgttttattgtcaaagataaaaggaatatctgcttgtttttgcttagttttgtgctgttcagttatatgcaccgctcggaatcatcttccactccctcgtctatgagttgcatagatcaatattcttacactaggaaatatgtataactatctaataataatcataaagatgtataagtacattttacaagacaaaatccgttgacactaaacgtaaaagctttaaaaacttgtgtctttactaagttttaataaatgtgatatataagaaccatcaaagaattatgccacaaaaactagtcgctagagtctgagagagtttaagtacttgtgaattttatgttagaattccacactttaaatacgagactaatatttttcagtacagcagaatatagtttactcaaaaaaattattaaatgtgtaaatttgctaagtcttaaacgtggttaataaattatcacttacaatttagataaagttcatgagattatttatgttttgacaataataaaaattattttttaaaataaactaaaataaggtataaccgcaaacttaaagaaattaatacttaaaataattatcatgataactcaccaaagaaaaaccattagcaaacatttcaaaatgtttttatcatttaatactattggatctttaaaaaaatttaaaatgttagttacgcatcacttttcttttacatttattaaagatgtctccattatctttatttatctattatgtgatttgtcattttaaggcttttcacttgatggctcagaaaaagttgacaataaaccttttcttatagtaagttggcaataaactaaacttcctgaatcgctttagttgtctataatgttggacgcgtagcattcatttttttatataaaaataaactatgttaaataatcaatacaagtaatgtagcattaaatagtattaggaaaattgcttctcccaattaaaagcaccattgctatatatgtgaagaaggatagacccaaatttgttaagggaaaaaaattatctttataagtaattgaaggtgcacttatacagttatacacatcctcaaaaactttaattcattataagtctttagatcttaggtgcacttattcagttatacacatactcaaaaatatgtgataataaacttactatcctcggaaattattaataaaatttgttttatgaataatatattctccaaactaaccatttatattgttttgggatgatataatcaaatggagagatataggtagtatgacataattcaggtatatgattaggccctccatccttacctaaatctctctcagacaacgccacttaagatttctaccatattgggtttttgttccccctagcggctagctacttgatggaacttctaaacctattatacagactcatcgtcccctttccacctatattttatctcatgcatccaactgattgcaacaatgatgtgaaagcaaaattaatagttcccttgcatgtacactttaacataccatgggttcaaaaatatcccctccccctcaccagttataaatcacactatatatgatgcaccacctttccgtgacaagcaaaggagatttgttctttacaactaggtatacctttccaactaaaccattgcaccttccaatcattgatatcacattcaattcccttccaccctccaaaatatataaaaggcaactccttctcccacttctctcacactccagcactccaaaataagcagtatagtagtcttaaaaaaaaacatcccacacactatcattcaccctagccaaaaccctagaaatgaggatcatgcaagagtctcaatctttcattattcccaccacaattctactactagcactatgctacaccacttcagcccaactttcaccaattcaaccccccacaacatcaccatcacccccatcaccaccactatcccaaccctccccgccgtctccggcactccaatcccctccggcaaccgcgccggcgccagggatcaacactgttcctcttgtcccagtaaccccaagtggggcccccgcacccaccaccatcatccctaagggccccaccattgacatagtccaaatcctaagaaaagccaaaaggttctcagtcctcactcgccttctcaaaaccacacaactcataaaccaactcaactcacagctcgtaacttcaagctcaggagggttaaccctatttgcacccgaagacagtgccttctccaaactcaaagcagggttcctcaactctctcactgatagacagaaggtggagctcttacagttccacactctctcttccgtcatttccatctcaaactttgataccctcaccaacccggttcagacgcaggccggtgatgaccctcagaggctgcaacttaacgtcaccacttacggcggcagccaggtcagcatggccaccggcgccgtcaacgcctccgtcaccggaaccgtttactccgacaataagttggccatataccaggtggacaaggtgcttctccctcttgacctagtgcttcccagcaaggcgccggcaccggcaccggcgttggcgaaaaagggtttgccgaaggctgataaagggaattccacggcggcagacgatggcactgttggcggcgacgatgacagcgacgggaaggccttgccggtgggtgtttctgcagggtgtacgatgaagtcggtgaataacgttgttgttgttggagtggtgggtttggtgggtggagttttgatataaggtgagtgggcatgaataaagggattccataatttttgttgtgattttgtgagtaatatatgtattgattccatcgtgcttaattggggttctggtttgtggtagagggtagggtgaaaatgtatgcatgcatgcatgacaagctgggtttcttttactatgtttcttcttcttttgttttgataagtggtgatttgtgttaatggatttctggctttgtaaccggatttataaaagaaaaagttctgtgtatatatatttttgcttttcaaaatgagtattaattaattgacgatgatttattaatttgctgctgaagagtaattaacgacatgttcgtagttatgattgtctgatatgatgtaataactaattggatgcatggtgcatgaatttcttctttagaggaggtcgaggatcacaaattttatacttctaccaattatataacagatatgattaatgatttacaaagtacataggatttcattgcagtttataattgactcagtgatcacatattatttaacactagctaaggttaactctaaaattaatagaatgaaataaaaaagaaacatgatatgcaagaaatgaaagagttacattttcatagagtactgaatgattatttgttctgtttttttattcatcttctttttttagaaacaggttaatttgaatcttaactaattcaaaactaataaggttatttaaagaaatataaaaaatatatgataattaatagaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaatatttaataaaaataataaaaatattattgtttcattgataataaaaataaatttcaatagagaatacatggtatatatagtaagtttttggaattttttttatttttaagaaaagcttaataattaatttgattaataaatatgtttttagttgtcatttataaatttcttgttatattaatgttaatgaaagaaatttgagtgtcaattttaaaatagtaaaaactcacaaggttcataagacacgttacaaagaaagaaatacatgcatgtataactatataaactaaaattgaaaatacatacatggttttacgataattttaaaattaaaaacgaattctatgtggaaatcgatatttttaatttttttgaattatatatataaaatgataaaaacttgaaacggacaagcaaaatttatgaactttgggctttcggcctacgagctagtccaaaatatatcttgacttgatcaatttattgtttggtagctcaattacatttaatgttttattttgtccacaaaacacatgtcctcaacttcattacttgctaatacgattttttcctttacttattataacattattacagaggatttagcaattttgctggtgaataatatctataaaaaaactaactatttttagtgaaatatctcttctctttttttatttattacataattttacttggaaagaaaattaaaactgtagagtgtgcaatcatagggtattcataacaattgaagcgtaatatgtttaaaatatgtgtaaactaaaaattaatgttatctttatatattattataaattataattttttatcgtcttttacatacgcatttcaaaaatattataaaaaaactagttgtaatttttttcgattatttttttttattgtgggagcagttttagtaaaaattaaagagtacttttgaagtaagtacttttgtcggggggagtaattaaagagtacttttttaaaaaatactactacataaattcatttttaaaaaaaaatacttactgtgattgcacttagtcgctttcttacttacatattattagtagtactgtagaagatcatgcagcaagctatatagatttaattatataaaagattttttagttgccacatttcaatttcttacatctacatatctgtcaaaaacacatttgaaatcttaaactcagccacaccacacaccactgttctgttaagagaacaaaaggctttggtccaaaagtcatctgcatttttcagtcacggaagaggcaattaatgcatgtgctacctagctttaaacaactccttccatcttaattcttagcggtcaaataatagaaacacattaatggagaggataggttactggttagagattattatttgaaaaaaaaaaaaaaacatgtaaaagtagtactactgtgttttaaaagcccgtttgaaaattaaagtgccttagccctgggtgcgtatttgaaagggtgactttatgtggctcttcatcaattcattctgaggagcaacaaatgttatattgttgactggccctacttaattaattactacgtaagaaacaaattaagcagaggaaaagtctaagagatcttccaacatttcccactaattggcaagcaaattaagatagaaatgcacatttcacatgcatgcccatctagtgtatgttcatataatcatgtatggttacggttctaagaaattatgataaaaatgcaaaaccaaagttgaagtgggtgtttgattctgccttgcatcttaatttcgtatgtgcgttttaggtacgataccaaacatacacgaaatgagaacatgaatttaatattgtaaaacatttttaccatttaaacaatatcaatagatgatatatccatgtcatttgccgtaggacatagatgtatctatttttaaataacaataaagtcaaaggaggtgtattaatagttaaatacctcttttcctcatttaaggtttttatttttcttggcattatttttctgttcatgttagagagtttactctgatatattcataattttttaaagttactaatacttattgaaattaataaatttatcttttactaaattcattttctttaatataatattaaaataaaaataaatttaacaatgttttttttctttagaactggatgcgtatttaggttaaaagtttccttttaatagtgacttaatgcacattttatctaatttttaagagaaatatgttttcttataattttaaataataatttgagtgtgtgcttagttgatttttttaataaaaaaatcaatttgtaacatgatttttttttatactaaaaattaaatatttctttaaagaaacgtgagatatgcactaaaaaaattatacttaaaataattagcttaatcaaaattattctttttttaccaaatctttattattaattgttttgaaaaaggacatcacaccctcctttactttgcaaatgaaggtcaaaacccaaacaacctgcattaaacctaaccccttgggagatacccaattcacattataataacaataaaaatatataaacactcttttattttatacatcctctcaataactctcatctatatttttattatatcataattctaataaaagattttttctcattttcttctcttttgccatgtatatcatgggatgttaaacaaacatttttctttcatattatacccactaggccctatttcacaacaaactctgaccactcctcagtctcagggccatgtcttatcaagaaccccaaaactatactgcagaatctaattttcaatttccaaccaaaccctgcttatttttcagactaaaagtaaaaaaaaaaaaaaaaaaaacccgaacccttcaggcttcatcctggtgtccctatgatcgtcatcttccttcttcttttacaagttacagcaaagttaaacaattaaaagaaacaaataattaaatgggccataataatctgaatacaaaatatactccataatcatccgtcaaactaataaggaaggtcattttctggacggctgcattgaatggaatttcctagatagagaaaatgagggaaaaaaatttaattatttatcacccgaaaacaaaagtctttggaaattcagtccctctgttcccaccttttctcattcgtacgcggttcggccgaaattattagcataacttaatccaatcctaacttcatctcttcttgttttcttcacttgctaattttatacccttcaaattttccacagccaaactgtttcatagtatgccaccaccgtttccacacccatatctctcggccttcgaaatttcgctcctttccttcggggaactgctcagttcctgaaaccatcatctgggtaacacaagttttttgaaaacaaaaaagaataatctcagatggcttcggcggctatattctcgtcgctgcggcggcgccggtcgccgtcgctggaggcgtttctggtgccggtcgacttctccgacgtggcgctgctggagactcttatctccatcgccggcgacgtagcgtcctgcttctccggccaccggttccccttccagcgccggaactcgcgtgccctcatcggaaaagttgagattttccggtcaatgttggagtgtctgaaagactccgccggccccggagatcttcccccgacggcggtgctgtgcttaaaggagttctatctgcttctataccgctcaaagattcttcttgattactgtgcccaatcgagcaagttgtggctgctgcttcagaaccattgtgtttctggtcacttccatgatttgagccaagaattttcgacccttttggatgtttttccttttggggaagttggcatcagtgatgatgttagggaacagattgacttgttgcagagacagtccaaaagggctaagttgttcatagataagaaagatgatgttcttaggataaggttcttttggtttcttgaagagtttgagagtgggagggttcccgattctaaggacttgaggtgtttctttgtggataaactgaggattcttgatgctaagagttgtagggtggagattgaagccttggaggagcagattgtgaaccatgagggtgatgttgagcctacggttcctgtgcttaatgggatggtggctatcacaaggtattgcaggtttttgttgtttgggtttgaggaagagttggaagttgagattcaaaagaaggggaggaagaggttgattgctcaggaaattgctgaaacgtttttgactgttcctaaggacttttgttgtccgatatcattggatttgatgtgtgatcctgtgataatttccactggtcaaacttatgataggtggtctatacggaggtggatggaggaagggcattgtacttgtccaaaaacggggcaattgctttcgcataataggcttgttcctaatcgcgctcttaggaatttgattatgcagtggtgcagtgcacatggagtaccctatgatccacctgagggggttgatgcatctgttgagatgtttgtatcagcttgtccctccaaagcttccctcgaagctaaccgagggacgaccacgcttctcattcagcagcttgcggatgggtcacaagctgcacagactgtggctgctagggagataagattgttggccaaaactggaaaggaaaaccgtgccttcattgcgcaagccggggcaattcctcatcttaggaacttgctttcctcacctaatgctgttgcacaggagaattctgtgacggcactgctcaacctatccatttttgaaagaaataaaagcatgatcatggaggaggaagggtgtttaggatcaatagttgaggtgttgcgatttgggcatacaactgaggcaagggagaatgctgctgcaacattgttcagcctctctgctgtccatgattataagaaaagaattgcggataatgtgggagctgttgaagcactggcttggttgttgcaagaggggactcaaagaggaaagaaggatgctgtcacagcattgtttaatctctccactcacactgagaattgtttgagaatgatagaggcaggggcggtgaaagctatggttgtggctttgaggaatgaaggagttgctgaggaagcagctggtgccttggccttgattgttcggcagcctgttggcgccatggcggtggtgagggaggaagcagcagtagccggattgataggaatgatgcgttgtggaacgcctagaggtaaagagaatgcagttgcagcattgttggagctctgcaggagtggaggtgcagctgcaactgaaagagtggttagggcaccggctttggccggattgcttcaaaccttgctctttacaggtacaaagagggcaagaagaaaggcagcttcacttgctagagtgtttcagagatgcgaaaatgcatctctacattatggtggattaggtgtaggttatgtatttgctagcgattcagcttcaaccaggaatactacaacctttgtgagtgatgtttcacttccaatgtccatttctgttcctgttttatagttgtttgttgtgttcccgatttttgttgtaactctatcgattctttcattgaaatttaaagtcatcaagtataggaataccagatatgtattctaaggacttagagaatgatgcgttgttgaacagttagcttcaacccatttgtaatcagttattgcgagaaagaatataaagtgttctaaattggaattattagaccacctcaggcgttttatttcttctgtgctttactcctcccgttggcaatttattggatttttaagagtaatgctacttttttatatgtatgattcatgctccatttatgtttaactcatacaatttaaacttgttttgttaaatttacatggagtcaaaatgtgtgctattgtgctcaatttgttccttgaataaacagcatttttcttttctattttattagagtaacgatacattttggatataaaaacttgcattttcccaatgagggctactggttggttttttttaatttgtaggtcattgatatgtcaactttcttgttaataaagttttttatttgagcatggaaaaggtgtcacaaaatttaaactgatttaaaccgcgggaaagtgtttaaacgttaagatagtttagtttgttataactttatttatctagttgtgaggtgtaatctttgcataaagcggggtagaataaattctctttgttctcatgttttcagtcatcaaatttgtagttttcacttcagataccgtttgttgtgtctaagatttcaatgtgagttagcctcaagcgtgttgcatgcacgattattccgtgttaacattttcagctaattaattctggcccgtgaagtatatgaatgttctattctattatttggacgctatgatgtcactaacttttctgcctaacgtgttagaacgaatgtggatcacacaatagatgctctttcatcttgactcttcctttctttgttccattcctatgtgctaggaaaaaaaacagacatcaatatgtctcgtcataatgggtaggtatcttaaaatattcttaagcatatgatatgaagatagtgagaaaaaagctaaggcaattcaaagatgagtgctatttttggagattaaagtaattgcttgcttccattgagcggtggaggatgatgggcctaacatattattctttggcatagtggcacgtatgaaatgacatgaggggtcgccaaaggaggcgcaatttgatttgttttgattagattattagattattgtcattggttgatggcagcataataatagcaatctaatgtttctttattatatatatgacaataaaaagaatatgaagataaattgaaatattgaatgttccattgaaaaaagaaaatagatggaggttgaaagttttacaagggtgtaaattacccggggattcaataacaatctaaaatgtatgaaaaaaattattaatttttaaaataattttttaaaaataatttaaatagtaatttgtgattagatgataatataatataattttatattattagtgtattaatgttaaactcttaaagtccatcaagtatgataaatttaataattattttaaaataattcaaacgacaattcataattagatgagataacacaattttatactttcttatactttctatatatttagattaaactcttagaagataaattaagtaacaagatgttatttagtatggaatatagaaacatgaaattcataagaatcaaaaatataatgccagaggatagtctcaccattggagggaatagttgggaaaaaaaatctaatatcaatagaacatgtgtttgtacacttttgcatacataaatttcatccgttacatcattagtctcatcatgtgtagtatttaatattaaattttatccgttacttcattattctcatcatgtgtagtatttaatatttagtccaatttattttaggcttttcttaaaaaaagaagaaattgggttaaacaacatataaaagcttttctagaaattagctttatgagttttttacttctattcaaatttcaagatttaatgataatataatatactaaagaaattttatgttaaaaaattatggagtaattaaataattataatttttatctttaatttaaatttaaaataagttttaatctctaaaaaggttagaccaaacaatatttggtttcttttagttttactttctattcccacaccttcgaattccttctaagttcacttaattttgacaacaaaagaaggaaaaaaaaaaacaattttgtgatttttgataattatacgtttctttcttcagttgaagggatccaatcctcgaattatgtttcaaaatggtccaaaaagcccaaaaaataatgattgttatgataagttgtttctatcattcttaatgcaatgatcaaagccactcttgaccgcactattccaagctgttttcattaacctctcttgagaaaggaaaattgcaagtactacacgcacattcatgcttcgttgcttgggtcaattccattacatgaatattcttcatagtggaggcacacagagtgcacacatttaaaaaaataattaattggaggttttgtgagacacttttgttttgagacatggtggtagtcgagcttatcttgtttgatatgatgcgattgaattgttaacgatgacaataacactatatgattctcaattgcttcgttccaatccatccaccatatattttcagcccaagaagtggcacaagttattgtcttgggttctcattgttttctccatttgattgttgtgtaagatttttttatttttacagtgaattgtcactaatattgccccttattgacttgatgtattaagcttaagacctaatggacagagtgttgtgtcgttaggtttctagttaatagaccgtgacaagagagtttgttaagacttagaactaggtgtctatataagctacggttttatttattcattgaaaaacgcaccacaactagaggaacataggacaagacttaataaaagatttgtctggtcattagaaacgttttttcccctcatgtaataatgataaaagtgtcgtgttattttattgtaactcctattttcataaactaattttatgggtaaaaaattgaacctttatgcctaatttgatacactgatccatttgtatctttaattttttcaattttcctatacattaaaccctttcgcatttttaaaactaaaataatttatcggtccttgaaatttctacaataaaattaatttccatacattaacagtcccgttcaattcaaaaaacaagagagaaataaaattcccaaccaatcaacaatttcaaacaatcaattgaacaagttaacaagattgagagaagaaaaaaaaaaatacttttgagtgaacaacaaggacgaatgtcaatgcctaagtagaccagatccaacgatcccctccctcaacctcaagaagcttcggtgattccacctaactcaagttgggccaatgggtgtccagcacaaacctaggaaaacgaaaaaaaaaatctgacccataggcctacaggatgagaagtcagcccattaggaaaacacaaaggaaattatttctcacaccttccatttgcttcctgcacttattccggaatgtaatttttacactcctaaaagatctttctcgaatgtaattttacaatcgagattaggagttccaaaatcttaaaataggtgcaggaagaaacattggaggtataggaagcagccaaaacaaaacctgagcaaagattggtgttcaattactattgatcttgttttcaattagttagatgctcaagagaataaaaatttcaaatggaagcataactgtaatatgtcccctacatgcatattgattgggtttcggtaattcgaattacaatgtataatatcacaactacaaatgtgaaattaaggtgaaactaagtttgagtgtttttttgtttttataaaaaaaatagaaaataagagtgaaaatatatttgtttaaaatttaggaaacattttctctgaaaatattttcaaaaataaacttaaaattgaaaacaataaatcaatattttcaatcttttttgaaaaagttaaaatgcagtggcatcttagagtattttttttctctatacatgttttctaaatcttgaaaatttgaaaatgaagatgaaaaataaaaacagaaaataaacacacaaaccaagcatcacataaactgacttgactagcaaagacgtagcttaaaatagcaatggttttaaaaaaattattgctaaatcaagaggaatatattcacatggaagtgacaataaatagatcctttgctaggagatataagatagattgaatagttaaaaaagagaagaaaagaaaaaagatcatgaattatatcccttttacttaataatttacaactaatatttaccgataaaaaaatagacccctttactatgtttaatcatataattgggaaggggtgcaaagagaggcttcccttcttaagcaacaaaaccggtagaggtaattggacttataagtcttcctattcaaatgattagttgaaacataattattgagaaattcagttaaacaaagaaaaaggagttgcaattttcttcctttataatattgtaataatacccctttttctcttgcagtatcaaatgcatacatggcatttcatgcaataatatggaaatgatgaaaggattctttttcaattcaagttaataaaaaatgcctagatcacgtcagaatgaaaaagaagaatggaatttattgtcgagttgaaggatttattgtgtaagcgtgaaaacgaaataacttgaaaaaaaattgtgtccaaaattattttatgtacgtagttcgtggtttgggccatctatcaaaatcggcaaccgaagaatcaatttgatgacctcttttgttgacaaaatagaacacaaccaatttagaatttcataactaaccgattatttatctaccctatggcttttttggtcttataccttgcttggaaatgaaggttcccctgttgaccctaagaaccttatttcttgtgttggaccttaatagctcatacatcataatttggaggagacaatcagaatcacatgatataataactgctatgacaagggaccattttctaaaatggtagatattgtgtcaagtttcttttgcataatcacatcaatttttcttctaaaatagttcatatgtaatgctggcacagaagctcacagaggatcaacattatcctttgataattgttgaagagggagcccacgccctttgaattgtcattgtttatctacttttgatatgcgtgatttgagtagaacaatatgatcaaaactgtgtatttttcattagaaaattagaagtaaataaagtaaagataaaaagtgtaaatttaaatacaagtaaaaaaaaagtcgctacaaggcatatttttgtgcaactcaatcaataacacttagttacattatgactttttttaatacaaagaatgataaaatacgaagacactcaattactagcagaagttcactcaaaatattattgcagaaagataaatagcaagaagttttacccaatgtttatgatcaatgttatataaatcaaactaaaagttaaaaagaaaattgctttttagtacggcattttcataagaatgctcacggatgacttcataaagtactgcagagtctgcaaattgccttttattttctctctcatgtatggttaacgcattcaaatgattggcaaatttttaaaatattaaaataaggaagtgtgtatttttcttcaaaatataaaattttgatacaggtatatatgactttagtaaaatgagaggatgcatttatccacctttaattacataggtttataggtctatgttcctattaatattgtaattgtgtaacttatttctttataggtcagtcaaatagattgtactttcatggatgataacatggaatttgacatgagcataataggtttgttgacatgatttaatattacttttgattcatgtatcatgagtgtgataccaaagagattaaaagtgtaattaactcacgtcatgtgttaagtaatatatcatcgatcagggtcggttctgggcccattcaaggggctcaaccgcacaggacttcaaaaaataaagggtctcaaatattaattattgtaatatatgttcaatactgaaaactagaggaaatagtaatgtccctgtcatcgatataatattatctaaagtcatgtcaaaataatttattaaatatttaaccataaattaacaagaaagccaaaataccattataatagctagaagatctaatttgcacgattaagatttaggggattaaaatcacaatgagacccgactaataatatgaaggaggtgattgaggaacaagtatcgaaaacacaatatttatgattgagtaaggtgcaaaatttgacaaaaatatcacattttggtcgcctatgaaaggatcattttacacgcctacacagacaggactaaatttggagcaccccaaccgtcaaacattctgcttaatcgtagtagtagtagtgtatgctactaacatgtgtgccagtatgtcacaatagtaatgtccaatgagtctttgaccgagaagaaaaagtggagaaaactgcaaataaataaagccaggaaagaaaaagatgagacaaggattttgctagccagaatcataagaggaaacactcccagtccatcacaatccaaaaagaaactgttttattctttagtcttccaccttttactaatagtgaaaaacaaagttaatattcaaatgaactgcaacatttacattcagctaagtaggaagtaactgctgtacaaaatgacatttactggtctataattctagttcttattgttacaataaagttacagacaacatcttgtataatgttaagtgtccttcaaataaaagctcatacaatgacaatgtacccggttcataataacctataagcaacctaatttctggttaactgcttctattacggtgtatgtgtgggcctaaaaaggtggtccaccccttggcgcaaatctttttttgtgtacaaaccaaaaagcatgaaaagtggcaaaagtggtcacaggaattggggcgggtatctcttttgaaaacatagcagaaaaaaaccagtaagaaacccacgttcctatttaacagcctaaccgtcccactaactgctagaactctctcaactctcactatgcacttcacttctgctctttatcttctctgaagattaataaacccttcaccaccaaatcaagagagtttcaaacaccaaaacaacaagagcagattatgaagtggggtggaaaaaagccttctccttcttcttcttcttctaggccttcttctttcatatctcatgtatctcctttttcatggctttccaagttcaagcagatgagaatcaactcagagccaaaacctggcacactgaagcagaattctactccatctgattatacttcaaccaattatgctaatataaatagaggcaggttttatggaggggatgatgatgaagctttctggagactctcatttggagaagagggtggtaacgagcataggaaaagtgaagatattctgaaaccagtaaagtacaatttggatgctgaacatgccattccatcctcaagtttccccactggattaaataatgctaaaaggcaaggtagtagaaaagaaggcactcagaagatgaagcagaaggacactactggactgagagaagaaacaaaattgttgaatgaagcatcaaagagtataaaggaagttgaatccttaaggagaagatatgagaggaaagcacaaagagttttgcaagagcagctcttgaaattggaaaaggcagaagatgaagctgagtttgcatcaagtccattcttaggaaatgatctgctgcaatttgagtcaccaagaacaattcgcacaccaagaaagcatttttttgtagattcaaagagttctggccttggaagtctcggagaatctcgtgtgtgtagtcctcaattgggttctgagtggcaaagtttgaaacaaactgaggggttgaaattgaaaccaaagggtaaccaacaaaggcaatctcttcatgtgagcagagaaaaccagaggaggaaaccaaagcacaactccaaggttagagtatattctccaaggatgggttccaaggtcgaagtccgcaaaataaaggtcatggaagagaagaagaaagcaaaacagaagatgaagaaagaagaggaaattgtggaggaaacagaagaagggttagatagctttgctgtggtgaaatgttctttggatccacagaaagatttcagagattcaatgattgagatgatcacagagaaacagatcagcgagccagaagaaatggaagatctgttagcgtgctatctgactttgaattctaaggagtaccatgatctcatcatccaagtgttcaagcaagtatggttgtgtatgagccaagccagttcgggtattcaatcagacaagcaatgttgctgttgtgattaacaacataaatgtttggcttgtaggaaaacattggcagaaattgtaaatagttaatcttgttctagttgtgctttattagctttgcttgaatttctttattctcttcacatcttttgtataaaattcaagagaagttgcatcaagatcccaacgaaattcatactttataataataataattataactactagtaagagttctttgtgcatgtatacctatataataccaagttgtttacactcaaaacatgattatcttgttggggttaggattcttgtaagcttgtagcattatgttcattctttagcaatatttttaatataggctctagggaaagaagtctgaagcactgatgagaggtgaaacttgttgaggaaataaggaatctaaaattccaaatggtaaaaatttccaaaaatagagaatgcacctataatacacataagacattgctgctttgcatatcagcatggtcctagacattcacatcagtataatacccataagacattgcccatgccggtggaagaaccggggttaaatgaatgaaagggaaaggaaactattcttcaatccttgtgatcagtatttgacaccaacagatacctttagcatgcatcttattctggcaatacaaataaaataccctaagaatgtgacaaatactaatattctgttatgctcagtgatttgtctgcatccttaaaaatacatggctttaagattagttaggcttaaatttataacttaaaaattaaattctgatatggtaatagattaaaatgttgtgctttttagttaatgagttgaatatgttaaaaggtaaatctggggttctttaacaaatgaacttgaacttttgattcatttagtttttatttattatttattcataaactaaacaagtttgatgagcaggtttcactcattgtaagccctacacaacaaacggcctacttaaataaattagcgtgcctccctttgaagacacccgacacacttcattgaagcctctatgacatttcaaaaaacatatcttagtgactgacccattcttcataaagttgataagctcttgtagcattgatgaaaatgtcatctaagagaaaaatgttagttttactaataaagcttcttataaattctccaactttcataagtgtcagcaggcatgttgggaggcacattaggtgaggccatcaaatggagtcatcgagtgagtgaaaatatttaagagtttgtgagatatatttatcacaaaggtaccctttctgatcatctatgttagggataaataaattatacaacctagctacaatgcaaatactatatatttctattattataatctacatctacagtatggggaaattattaggagaccgaagtgtatatcccaataccttaatttgatgactattatttctattgtgtaaagacccattacctaattactttcaagtggggcatttatgccacatctacacaataccaaattagttaataacatcacaataagtcccaagtttgtatataagatcaaagcaattcttaaagtcaactcggtggttacttgggatacctataaaaaagcacaagcaataaagttaacctacctgctaggggctcataaattggtcattcgactttaatcatgctgctgcaggtaggctttacatgatcaaattaattttttcatttattatttcggcatcgatcattctatatatgcatgtccatattaataactgaacataaataaaactatctagatgtagaattcaatagattttaaactaatcaactaataaagcattaaagttttatcttctaacatctatttcatgaatattggtcactcagagcgttgactagccatccgaaaacacggaaatttttctttgaataaaggcataaaactcatctagaactatagttagactgcggaaaaaggatggaatcaaatcgtactaagttcaattatttggattgttaaaaaagaagataaaatacatccttcctccaattcagatatcgatgatactggaatcatctatttcaatatagaatattcaaataataaaatagtaaagttattttatttcatattattgcactgcatttttcttctataccctattccattctattttaaatttatcattgtatacccaaacttataaactatatttttattgtccatcgtgttttgaagagagtaaaggaagttgtgtctatacttcaattttagtaggctagccttaaacgattacagtcttatcaatcaattcatttaaaaataaattaaatagccctaaagtgaatttgtttttaaagcaagcaaataaaggtttatttattctaaatttttaatatgttgaaatcacaatttattttaattaaatcagttatacatacatttttattaattgactttacagataaaagttttccaaaaaaaatcccttctctagctaggggaatatatatgttcgacacacaattgacatgcttttccacacaacatctgcatacaaacaaatcattaaccagcagttataagtcagagaaaactagtttcaaagtatagtattatatttccaaacattacattcttagaaatattatgtatataaaatattgaaaaaatagaagtagaagaatgaaatgaagacatgtggttactgtattagttgttagtttttttaatactcacaacttctctctttcctcttcttaattgtgtataaaataactttcattctcataaaaatacaatatacatatctttttaccataaaaataagaagacaaatatgaatatttatatttttgataatcaacaatacctaaacatattatttttcaaaacttgtaccatgagaatataataattccaagtcccctcattggaaatatttcttttgcaccactccttttccctttcattcaaacttctttctccctctttctttcatatctctcgattagaaaaatgaaagttttatacattatggaaattaaattacttagctaaacaagaaatttgatacacgagattatgagaatatagaattgcttttttaaaatgaaatattttgaaaataaaataaattgaattgaactaattaaaatgtaatgtcatatatcttaaattcattaaaatttcaaaaatcctttgttctaagactactttaaatatttaggtgaaatataacaaatatgatattattaaaatataacgtctttcaacttgaaaaataaaattattttgagacaaattaaaatatttaaaagaatatatgatataactgaactggttgcttctttgtaaatgtcccacgtagcaaacaaaataattatcgtttagagtcaggtgaagtgttttaaatgtacttgttttattttattttattttattgagacaatgtcattcacaatagaccggctagaccaagtgggtcgcatgctacaatccacaagcattccctatagtctccatataagatcagtgtgctttcattttagtggttcaccatgtacatatggaagaaagagtaactgataattacatgaaattgtgaggaacaaataaatcattattaacattatgtacaaaaagaatatttaaactgtaccaaaaaaaagatcatgattaacatttagaaaaaaaaaattatcttagacatttacattacagcacactgtatacaaacgcaagtatacaagagaagaagtgaagtgatcttggttttttaaaattctatccaaaatagctaaggttgttttccttctcatgataagaaaatcttttctgcgccgccatttgcccactgctcacaggatgaataatttttaatttaacctttgatgatatgaacctaagaaaacaaaaaggaaagaaagaaatcaccattgcaaacagctctcctgagtcatttgaatgattttcattatgacataaatgacaaaaatatatttcattttctatttttatttttaattacaaaaatatcactttatctcttgttttttaaatatttatataagaaacaataaaaaaaagtaaattataatagcatcccctcaagtttacttgaaattaaacataatatccctccttttttatgcttacactaaatttaatttgttttaaacattatattaacacctcttacgcattacattaatttttttaattatttgaaaaatactgcaccttatacttctataatgggttgttataatggtaaaaaaggggtgtgtgtaatttaaaaaaactccaagatgtaatttcaagaaatctcagtaagtcttgctataatttactctaaatataataaaaaattattttcattgttttttatatgaatttcaaaaaatggaaaacaaagtaacattttataactaagaataaaataaaaaaaatattttcttccaaagtcataggttcttatatactttttcttatggccgctaccgctagctattgctacttgtagccgctaaaaggtacttgcagaataacaagtggcagaaagaaatttattaacaagtagacaaaaattaaatgcaaattttaaagagatataaattgtgattgcaaagaaaatgtttaaaaaatcttaaatgttttcaaaagaaaaataaaacttactgcatagaaaaacatttgtaagttaccaacttagatcatgttttagaagatattttaggtagtttttgatttttcttttattaactaaaaaatttgtttgattatttgataaataagttattttagtagtttttatcattttttgaaacactactttaaataatatttttaaaacgctaacttttgatatttttttcatttttattctcaacacatttattcaatttttttattatcttttttaaataaatcatgattttattatttttatgttattttatattttcagctatttcaacaattaattttattaaacaattataatttaataagttaattttcagctattagctcccagcaagtttttcaactaattttatcgaatataaccttaatttcttttatcattgatacaagtccaaattatatttatgtatttcctttcaaaagtaattacatgcaatggaatcccttaagaataaggtttttggaattggaaagaatcattctccatgagattcttagttacattatttataacttttttgttcatagacaaaattaattcaaaattattttccattccaaaacataacttatttccaaacacttcatatttaactagaatttgctcccaaaaatataacccttccccttcatgaaatcccacaagcctcttatccattctcaatcattattcaatcataacatacatacaaataaaactttttagattagatttaaggatgatcagactacaacttataacttccaccacgtcatgttcattcataatttaaaagggaccaccccctaatttgaaagggcaaataaaagatagttccatggcatgtaataggcaaaaacatatcaaatcagtccgtggcatttcatgtgcctcttgctcgttaattatatgttgaacatgaagcagtccaatcaaatgaagagttacatagtatattaaacagcaatacaaattatggatttaatttgaatgagccatcaaagtaatataataaattttgtcacaacatttaattagtttgacctatcatgtatgcatttaattcatgaggtgacaacacaacatcaaataaaatataaaactttattaaacaaagagtacaccaaaatttaaaaacacaaaccaaataaaattattgtaatatacaatttttaaaacaattgtttttatttatgtagttattttcttaaaattacaaaaaattataattattactcaaatatttttcttcaaaaaaaattgaataacaattattttagtttttatatttaactaataatatacattaaatttacatgacaaaattatcacaagacaatgtgttgaatacaaattttatatgttagtacagatgttatatttatcatatatgtatattgttattatatatatatatatattatgatattcaacatatattataataatacaaagagacaaaagaaaaactatcttaccatattttctaactcagctcactctcaagataaaaacaaatactagacacaacaaataactaattgcaacaagggaaatacgaaatataacgttggttgggttgtaaaaggagaacgaaggaaaggagggagaaccaacagatccttaacaaatgtttaatttaaactccttacctgaaagtaccaatgcaaaccataattttgatattaaacgaaggatgaataactaaatccagcagccagtggtaaaattaaaggtatttaacagttcatccgcattacaccagagaatcaaagccccgtggcttacaagttacaacataccatttcaccagatattgcatggacaaattaaagtcaaaaagcacctttatcttagctggtttctgctaggatttccacttgattagtaagtcaaacttggtggttctccccctccccccgagaaaagcaagaaaagctttgccaagttaggatcaattagaaaatttgctttctaacaaatggcatagcaagttagcaaccaaatataatgtggtatgcatcgactttctattctttgcttcagcattagatattatatataatgtggcctaattgcatcgacaagacgcatctcataatgttcgctactcagtaacaacagaaagatgaaatccataaactctaacgcaatcaatatttatcgaaaaggactatttgtgtaacttttccactcaactgaaaacatcaaactgaaccctgatagactgtcactgataggcaccttgtcctcaataaattgcttaccattcaagaatatatgccatatacgagtgacaacttatgatcctgctggtttgatcaaatatttagttttcatttcttatttttataaacaattacaaaaatactactttgttttcacttcatttcctactatcaaagatttgtataagaaatggtgaaaacaattgttttcaacaccatttttgtcaaatctatgaaaacaagaaacaaaatgacaaggcataatttttatatttttttttaaacaaataaaaacaacaaataaaaggttttctcaatccaaacaaatcctaaataaaagctaatttctaactcataatcttagttagccaaatcaaactcaaaatgaccacaagtaactggactggcataattgtttgttgggacttgggagtggttttattaattatactagaactcagcttaaacttaacataatagttgattgtagtatatctgccagagaaacccccctttttgacattaaaagtatgataggttgacaaaaatgaacagctctggccaaacaggaaaggatatatttttcaatatcacaatacatcctcccaccaccctacccagctccctaccttttagccttcgaacactagttcaacacccaagtatatactagaagttcattttccatcataggttctgttcaatccaaggtattttcccttcatcagtttgatgattgtacactagtttaacattacccttctagaatttcttcccatgaaccttgtagtcctctgcttaggctcacacactttgtgcagtttctggctactacaatattatagttgaattgacaagatgtaaatccctacaaaaaattattcagtgaacaaaattgaagtagaagtactatattgcatttcccaaatgggaaatcctagtttccacttcaaatgcaatgtatcaataaattcaagaaaacaacagtctattccattccaggtcagtaagacatactattggtgttcttagtttcaaattatggacgacattattgtggttgcggtaatgtccacaacagcaacagaaccaccctgcaactacaggacaatttccattcacaaaaaatggaggcaaaccaacaaccaaaagatggaaacagagggtatcagttggcagcttctgccatatggtacaagtaacatccagaagggaccaaaggaaaacagaacaaatgtcgactggagataaccataccaaggttctaaattgaggttatgatcacagtcacggttgcggttgtagtgcagtacagaagctgcatgatatggtccataatttaaaagcttgaaccaaacgacagttctgtacaaggcataatagaactctagaagagacaaaagagcggcatacttaactaatgaatcaatgagggatgcaacattcattccacccaaaatatggaatatgtatctattgtagagaaaaatcagaaaactgtgcatacatatatttattacatgtgattgtagaacagtacaagcaagaagaataatcaattgctactatgttttctctgcttgaccaacatgccccatctgttctgaaagattatttgcattccgtttgttccaccaaaatttgttaaggtcgctgggttttccttcattctttctgccatcatattcctttctttctgactccacttcctgtgtttctgatgcaccaggatcctctgtcaagaactgctcccagaatacatcattaacaccagttactgcaacagtggttcccgcaggttgttcttttgatgcaacaggctcagaaacagcagctgtagttggctcagaattcatgtcaattccaggtgacttaggctgaacttcaacatctaattgcgcacaagatatagatggactatcagcacaacttgtagattcatcaaaatccatgtttgactgaatttggacgaaggtgccaccaatatcatgtacaatagcctcccaaaacgccatggatgattcaagctgatccagtcgctccacgtttaatgtcaagacagtgatattgtctgcattttctcttggtaacatttgggaagcttccatagcatcttcaacactagcttcatcataaaagtggccacttctcggcaaccttcgttttctatccatgatttctgtcagaggcaagatatttacagaaatcacaggtttctgcaatacatgagaaacagaagaaaccatcctttgttgattctgttccaacttttccaactgatcttttgagcaatgtatttgtatctcatatgcctgccactcatgctgatatttctgtaattccacgaggagttgctctttatcgtgtttaagtttctctatttcatcagtaaaactctgcctttctgcctcccctagtgggccttgtgcttggagattctgcaaagaatggctatgaaccggcttccgtctatggatgttcttcataagatgaggttgccctctaacaaaatcatcattggcaaattcccattgttctgggtcaacttttctaaatccctgctcaagtaaagatgctaccactaagtttaagaaactaaaagcagaatggggcaacacatacaacaacacaaaacaagtagtattcacatcaacaagaccaagatcaaatttgcttacatatgtgttcagctgcctgatgaaacttgagaagttgttgtgcttaaagaatctaggcagcaaatccctggcaaattcagggggattccatacaatgaaactcttgctagagacactccacgaaacaaccgaatccgtggaaggatcatccaccatctcataagtctttgcaaggaaagggggcagggaacttgaactaccctgtgtatcatccatcactcgaaccaaacctcaatcaaacctactccaaaatctcaacctccccaattcaaaactcaaacaccaatcaatttccaaactttcaaaagaagtcaacccttaattcccaccacgatattcggcagaacatcccacaaaaaaaagaaactttttttctttccaaatctgacctagacaaaaccccaaaacaaaaatttcccacttacagcaaaattaataatagaacaatcatttcaaaaccccatttgcctaaggagagcaaccctaaacccatgaaatcaacaaaatcacaaggcagaaaaagttttcagctttctctcctctcttacctcaaatacctaaacaagcaacgtttacgctgaaacaaatctcacagaatcatgggttgaatttccccaaaaatgttaacgtaggattcttctttccctggacgggaaaaattggagaagcttgcacgtaaagcaacaataattattaattaaaaataaaaatggcagttacgttattgaagctttgcacctgaaaaaggaaagcgaagagtgaaagctgagaaatcgcagagagggaaaaagagtttttttcttcagtttctgggtgattccatatttccaattgttggaatcctttcttcaattttccagttttgttattggggtcaacgcgtggttgatttggaaaggaggggggtggtaccataggaataggattttggaatgaaaataaaagtaaagaattgctattggtgatgtatataaaaattaaaagcaaatttaatactatgagaattagaatgaacgacgatataaaaaaaaaaaaaaaannnnnnnnnnnnnnnnnnntgagctttaaataagtgagatattaactaaatggaaaaagaaacttaaagatacttttaatattattatttaattaaaataaaagttttagttcaataactaatattgatgattctcttttatttactatatattattgaagtaaaaatttaattctaacaatgaagtgcatcaaaagatgtttttatctaaattttattctattaaactttataattattatatgtagggataaatataaaattttcaaacatgagaatggtcattccttaggggaccttgaaaatgatctacaattaaaattgacatttattctaacaacaataatatttggatgccttttaaataagaattaagaattgtcgaaatttaataaagacttaatttttataacatgcaattaaaatttaataatatagaaattaaaattttattatatacaaaaaataatcattggacaaacgtttactgataaaaaaaaaaaaaaacnnnnnnnnnnnnnnnnnnnnnnnnnnnnnnnnnnnnnnnnnnnnnnnnnnnnnnnnnnnnnnnnnnnnnnnagggctttaattatctataacaatttataaataatcactaaaagcaataaaaaaagaaacataatcaattacaaacaacagcttccatgaatgcttttagtaactcaatggtctctgcctatctggttcaccaaatgctgctcccttccattgtgccattaatccattatgatatcgttcacataaatgagcaaacgaagctttatggaaaggttcgcttcaatcgatacaatccaagtgcgagtctcaggaagcaaaatattgatacagcacatgtgaatatagtttttttgtcttttttgggtagcatgttaatatagtatgaaaacgtgtagataccaacaaaatacaaaataaaggggaattttccttccctctagtccctagatggaagaagatacatataatcatattttagttttgaatataataagataaaaagaagcattctgaaccattcaaaagaaaatataggttatctggaccacaaaaaggaaataaagaaaatggtgtgtgaaatgggcttgcttaaaaactacactccagataagaacattgattattagcaaacagtttcccatacccgtctctatcttgtcgttaattggttattttatttattaatcgattgttactttgcttgagatggttatttcgggagatgatgatgtaagaattaactagatctatagtctatattaacctaatggaggggtccattctaacaaaacagtagcacggactgaagccacatccatgaagcaatcgatcaccaatatataagtgagataacgtattcaagcacgcaaaaggtggaagagtaatggttaactgttcattttagacttttggtgatagttgattgtaactaactgaccaaataatgtttgtttgttattgaggataaaaacgttcagtctagaaaaacttccactgaagagctaaaactatatgctcaaagagtaggacttgatatacaagcataaatgaaatcttcactttacttatcagatcgtgtggaggttcacaataatgattaatgacatgttgatctcagtcataccaccaacaccaagaacttgacttctatcttaaatcataaatgattccctttgagccaagtcgccattccagttctttctagtcaaacccattggctaaatgacccttgcaatagaatcctcaacaaagtaactagatccttttagacgttttgcttggtcacatacatagacatatggattgttatatgtggcacaggtatgcaggacaaaacttttcctaatatgtggtaaacttagtcggttcattatttgggatcaaaatttgcttaggaatcgatttctatgcatagactccaataattgaagaggctcattttagaaaactagtcatggcctataattatgtttaagtatattttctgatgctagagtatcccgtatggccaactttttccttctccaagacattgattacatcccatatcactcattcaccctcaggaaaatagccaccgtttgagtgaaaaccttttgcccacactgcactatcgccttccaacataggtacaagtgtagaactgaaactggtatcatccatacttcagtatcttcatacagtggagaatcattatggaaatactttccaagctttccaagagaacttaaatgttccatctcatctttagttactctagatttagtaacatgatccctttctatcaccacccacgccatcaatcagtcaatggcatcaaagcaccacatatcagtaaatgaaaattcaagatgtttgaagtcacaaaaacaccatccactaaaaacacatcatcaaaatcgtgagagaaaaaaatccagtttaccaaacacaaacaaatgtatgtatatctaccaaaggagggttcgaacggagatatataatgttggtgggtggtagctgttgagtcatttacaaacataccaagtcattaagtagtatttaataaataagagttatcgtttctacgaagacttgcacaatacttagtaaatatcaaaagtttttactatttaaactaacaaataaactatgttgatttgaacataatatttaacaataaagataaaacagaacaaaactacaaattatgatatttttgggattttcgacaaacacatattaaaacgatatgaatttcagatcacaaaggttatcagggttagatatcaccgaaccaaactctctttacgctaaaacatgatattcaacttgtaatccaacgttaatatcgaccacaatttaaaaacagtattctaatccctaatttcttaggtgaaaaaacttaagtttctctcttaaatgtcaatcatttgaacaattaacaaaagaacttgctttaagctcgatgacctaaagataaccattatccctcatcatattcctagctttgaggtttaatggccattttatcacagttcaaaataaagaaagtattttctaatagtaatctcatccaagaatcaagctatgagtgaccaaaaacaagaaaaaatggaggaacaatggaagaaaagagttggggaagaataaatttttaaatgaagtgtttttacaaaatgatgaagcgtgccctaaaataaacgagataatctatttatacatttccaaaaaatctacacttaaatgagtgtttaaacagttaatgtagttatacaattctacacatctgtctaaatttagcttaaaccaaaagttatttttatgaagttaattttttttaactttcttttttatcttctacaaaaaaagaattttgatttatctcctcgaatccaaacttaagtacatttgagctaaaattttcactttcagctttcattaaatcttgctccaaaaaattgtaatttgatccaattcaaaatcctacaaaatgatctattaataaagcatgtgaaatctaacaaaataacaaattaaaaagaacaaactataacttaacaatttatatataaaaaacataaataaagtcctaaaaataagaaaaagatgaaataattatctaaatttatatgtctcaagttaaatatttttggcaattattatagtcataagagaaactagaaaaccctttaggataaattttctgctacttggacgtgttccttaaaatctgaattgttaccatccattaaaacaaacaagcaccaaattttaccatttaaattttaagctgtatccaagtgtctctctgtacacagtatcaacataaagatcagccaaaacagtcagaaaaatcacctttgcaaatagctaactaactttctgataaaattcaaattaatgtcagaagaacaaaactttcataatcaaaacggaaagggtctctatttaggtgccttcatgtcaagcagcgaatcttcaactttccaccctggccacatattatccggtttctgtactatataattattgttatatagtcatcataccttgataagacgggtaaactaatgtttggagtagaattacaaaccaaatattatgcaaaattaaattataaaattttacaaattaaatttctgaagaatcttactataatggagtatatttcaaaataactttttctgctattaaaatattaagtgaattttagaaattagtaatctgcactaaattttataaatataataaattaaagcaatccaaacctgaccaaactccatgtaattttaatattctaagatccccacatgacctgacccagtcacgttgcagccaccccccgagtttcaatcattcaaacaaatattgtctttccaacatccttttcctacatctgaaggtccactttccaatatcagctttggttctgttgtaagtaagaaactgaggtggtttagcattaacaaccactttgaaagctgaaatcttttttgaggtttgcatcatccaaaaatggtgttgaagtccaaggcagagttccttgtcctcttggtccttgttgtgtgccaaccctcttgtgggttgggggaggattggtctactaggagactcagtaggcataataataagatgatttctccaagctgtggagagttggtgttgaagtcacagtgctcagagaactcaaaatgcaggtggtgcaccagtgaggaccttgatgacatgtgcttctctaaatctgaggcattgagattgcctcaccaggttttctcttgtgccttcatcccctgagatctattctctcttggatctcaggatctgtgttgcctaccctacactaaccaattttcaaggactacttttattttttgttgtgtttatgtcttgttttttgtgtttttaggtatgacttgatagagggtggcgttgttgttgtatattcagtttatgatttacttcaaatttgagacatggttagggtatatagttgaagatagagaggaaatcgccacattctatccttttgcttcattatctgttgcgaaagcctcattcaaatagctgaatagttcatctcagttcatttacatgccttttgggggcagctcagctaacaatgtaaaagcttcaataaaaacagccaaaaaaattatcatatgtttcatttttcatcttaaattggatgataacatgaacactttagtcccctcccccattgctttgtttttctagctactagaagattacttagccgattttcattattataagaaatacttggtgccattagaaaacctgtttacaaaacaaactccctgataatgttgttctttttggccagaaaagaattttttttttaatgctaatttaacgttttggcttggcttatcaatattgaaggaaactgctgtctcctctgttaataatgctgatggtgcttggtagaattgaaaataggagttctggttttaatgctattttaactcttagatatctaataagataacatcaagatataatgcacaaatgacaagcgcaggaaattccaggtttctggtttcataatagtttaatttgactttgattatcttaacttttatccaggttcatggtgataaacaaagttaagatctcttaaaatgttaatttgttcaaagtcaaacaaagagatcttaattgtcttcctggtagcacaaggaagacaattaacatatcttaaaatgttaagtcttccctgnnnnnnnnnnnnnnnnnnnnnnnnnnnnnnnnnnnnnnnnnnnnnnnnnnnnnnnnnnnnnnnnnnnnnnnnnnnnnngtgatttaaatgtttaaattcattagtcaataagtaagtttagctttgatagctgttaacttatttaattatttgaagccattcatgaaaattcccatgttatttgaaactgcaaactttatcaaatgtttgagctgaaacaattactgacatgtttacactaaacttatttaatgttcaattcaactcatttgttttaataaatattcaaatttaactttgactttgatctttataatctaaatgagtcacgccgcccaatttatagccttgaaattaaaagtctataaataactcgcatgtgcatatatagaatgttacaaaaaaattgtaatttcatatagatatgtttagttaattgtagttttatcttaaatttttatcattttttaatctttatgtctaaatatttttctattctctttctccttttatctttatgaaaatgtttattaaatacttatttaagaaagggattttttatgtacatatatagacgggaaaattgaaactaaaatcttatataaactacctaaatctttctaccgctaatctgaacctggtgataaagggattgttaattgtgtgtttatgaatccccaatagaaaatctaattaataaacttaacaaaaaaaacactctaagaagtaagaatatagttaatatataaaaatagtcatattctaaaaggattgagtaaattaaacgtaaactttgtatattcttaacaaataaattttatattttaaatttcactcgttttaaatgtataaatcaaacttaattatcattttttttcaatcaaactaactagtgtcagctttttttagttgtcttcttataaaaaaactaagaaaagatatccatatcaataagaaacgggccaaaaaagggcccagagaacaatttaaggagtggcccagcagcatacaatcgcttagcgatattttcttcctccagccagcatatttctcttactgtgggtgtatgaagaaatatgatgaatgcagaaagaaaatccctccttagaataggatcataagcactttaatcatttgggccttagattcttataagagcttatagcctcaacagatcatacgcactacatcccaatttacgcaaacacgtaaactttagaaaaaccttaagaaaaagtgaaataagaagactttctagcagaggaaacaaataccatgataagcaacacaaattacactacaagttaattattattttcaaatcagtgtaacttacttttgtgggctccacaaagataatttaaggacgttaatcgaaaaccttgacctgaaatgaatggagttacacttattgaaaccaccccaaacaatcatttaatcaaaagtgacatataagaagctattggaattgaattaatagtgaaaattttaaacagtttatactaaatcaaacttcattgtcgttattaaaaaagcatgacgtgtataagtcattgtctgccacccaaatattaaatttattaaaagttatccacatgtttcaagtttcaacttataaaagatcatctctttacgaatccattgagaaactctttccaaaatgatactgttcagattagtgacgcgttattcctgtcatgttgtaaaggaattggtggggtcaacccttttttttcagtcaatttaattttaactttaaatttagtgcatttagtgtaaaaacaattatattacggcgtatcatctaacgatatgtataacattaattaatacattacagttggcatattattaaatttattgagtaatgtaaaaatgtactattaaagcagtaaaaaaatgttctattaaaagtgtaatttttgtaattcattaaaattaaacactttaacttgttgttcttgcaaacattttttttttcatttcatgatagaaccatagaagaagacttcaacatgaccataatgagatccccgatggtagttacgtgtaaaaactctcacactctagttagtgagagaacgagggaatgtaaaaaatgagattagattcatatttgatgggttagaaacccttatagaacaattgtttaagtagaaagttagtgaatcaacttgataaggttaacgccaataaattaatctaatttctaaaatatcataaatgagtttcttaatatatatatataatttcataaaagcataaaaaacttaaagatgaaaataaaattaactcgatacaaatgtgtacttcaatcactttttcagaagtcttattgatgataaaatttttgagagttcttgtataaaaatggttctctaggctactagacatttcatttctcttcaacggggagaactaaacaaaaataaattcttgtttataagaactcgataaaaactttgtttttggagatggactcaatagccaatgacatcaaacattttaggcatttttgtcatttgcttacattttttttcaggttgtgttcttttttttattattattaaatttagctagatgtttaattaatagtgtcaagatggtagatcttgggctttagcttcacgtgttaaccaaaaagaatttaattgaaaaaagaataattaacaagtgtatttaacatactagttaaaaaaatgtcaataaaaacatctaatatttattttaagtgattaaaatattaaatttaatttaataattagatgtttgttaatcacttgataagacccatgttttaaaagcaatggagtatttaacatgaacagtttggcaaataagggaaatggtgaaaacaaaatcaatatatataacataaaatcggacaaggtcaaaatatgcttggtgttgaccatgtgctcagtagtgggaggttggaaattttttgcatgcgcattcaattaattccttttgcgtcaatgcttggactcgttgctaatttgctattgatgaactggttagaaaagaaaagaagcaggatttaatttttactatagcattcttgtatacttattaaatggaaaagtattgaatatttttttatatacttaagacattaatgcgcatttatttaatttctatcaaattctttgtttagaaaatattgagggaattgataaaaatatatagcagtattaatttttcatctcatacttctgcttcttttttttttttttactgaattacatacttctgctatttatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttactgaattacatacttctgctatttatttttatataactaaagtataaatattaatgaactgcataatgatggcttgacaaagtacttaaatattctccagcttagggatctttttttttcatttttgtctttttgagaagatcaatatgcaaattctcgcgaatattattatatatatcatcatttatgcaagaggacgtatatatatttacatatgttttttcaattattaaaatgttcagttttggaaaaccttgctactatgatctcttttcttttctcatagccttggacagttggactactatcatccacctcgggtaaactaactggttgacatttgaatttctagtttgcctcgtttggtaaaaatattggttctcatttttgttattcaataatttcgtaaaatataatgccttactcatttgcgtggtgtgataatatctaccaaacttataaagttatttttaactattttttttatttaaatgagagaataaaaaaaaattcacaattataattttaataaattatattatatataaagacataatatttggttattttgttgtaccttctttaagagtttggtgatatattgttttcgaaagcaacagattttggggtaattatatagtttttttgtgtgtgatatttttacttcttaaaaataatatattataatttaattaaatnnnnnnnnnnaatttctagtttgcctcgtttggtaaaaatattggttctcatttttgttattcaataatttcataatatataatgccttactcatttgcataagatatttacttcatgcattaattaaaatgatttattttgtattcatgtttttttacaggaattttgctttcatgttaaaatatacatgtttgtttgtttatgtgtggtgtgataatatctaccaaacttataaacttatttttaactatttttttatttaaatgcgagaatagaaataaattcacaattataattttaataatttatattatatataaagacataatatttggttattttgttgaaccttctttaagagtttagtgatatattgttttcgaaagcaacagattttgtggtaattatttagtttttttgtgtgtgatatttttacttcttaaaaataatatattataatttaattaaataaacatatatttttaaaatttgaaattatttacttttcatttttaattaatttttaaataacattgttttgaaaaaataattaatcattttataattttaaacatttaactgaaaaatattagaatttcattataaaattaaaaataaaaagtaaataataataatagtaaaggaagaattctaatgaaataatgacgattaaatgagaaaaaaaaataagttaggaatagacatattttatattatactttctataaattttattattgatattgtacacacacaaaatttatctattccagaccatagaagacggtttttcataaattatttgatttaattcacaaaaaaatatgagtaatttttttattatatcaatttaaagttaaaaaataaattcagataacattattaaaaattaaaagtaaaggtaaatcataacaaaaacatagaaagtacaatcaacctagtaatcttttatagcagatatcgatcctcatagtggataaatcgaattacaaatagccaagtacgttgctatgacagaaatgtgagatcagcctaatgctaattcctaggggtaatgtgaacggagtttatttttttgggtgcatgatgtgaactgaatcctttgacaaacctaagcgtcttcgttggtttttaaaatataagttttatcaagaatttattttcctgaaacaatgtgtaaagcttttgataaatttgtttctcaaaaaatttaaattttagtttccaaataaaaaaagtataataaattcttctatcaattaacttttattcacta

(The sequence listing continues in the following parts.)

The invention claimed is:

1. A nucleic acid comprising a nucleotide sequence operably linked to a heterologous regulatory element, wherein the nucleotide sequence comprises an R-gene encoding a protein having at least 90% sequence identity to SEQ ID NO: 47, wherein expression of said R-gene in a soybean plant enhances resistance to Asian Soybean Rust (ASR) compared to a plant not expressing the R-gene.

2. The nucleic acid of claim 1, wherein said R-gene encodes a protein having at least 95% sequence identity to SEQ ID NO: 47.

3. The nucleic acid of claim 2, wherein said R-gene encodes a protein having the amino acid sequence of SEQ ID NO: 47.

4. The nucleic acid of claim 1, wherein said R-gene comprises a nucleotide sequence having at least 90% sequence identity to SEQ ID NO: 6.

5. The nucleic acid of claim 1, wherein said R-gene is operably linked to a promoter active in a plant.

6. The nucleic acid of claim 5, wherein said promoter comprises a sequence having at least 95% sequence identity to SEQ ID NO: 7.

7. The nucleic acid of claim 5, wherein said promoter comprises the sequence of SEQ ID NO: 7.

8. A vector comprising the nucleic acid of claim 1.

9. A transgenic cell comprising the nucleic acid of claim 1.

10. The transgenic cell of claim 9, wherein the transgenic cell is a transgenic plant cell.

11. A plant or a plant part having stably incorporated into its genome an expression cassette comprising a nucleotide sequence operably linked to a heterologous regulatory element active in said plant, the nucleotide sequence comprising an R-gene encoding a protein having at least 90% sequence identity to SEQ ID NO: 47, wherein expression of said R-gene in said plant or plant part enhances resistance to Asian Soybean Rust (ASR) of said plant or plant part compared to a control plant not expressing said R-gene.

12. The plant or plant part of claim 11, wherein said protein has at least 95% sequence identity to SEQ ID NO: 47.

13. The plant or plant part of claim 12, wherein said protein comprises SEQ ID NO: 47.

14. The plant or plant part of claim 11, wherein said heterologous regulatory element comprises a promoter active in said plant or plant part and having at least 95% sequence identity to SEQ ID NO: 7.

15. The plant or plant part of claim 14, wherein said expression cassette comprises the promoter set forth in SEQ ID NO: 7.

16. The plant of claim 15, wherein said plant is a soybean plant.

17. The plant or plant part of claim 11, wherein the plant is a dicot plant.

18. The plant or plant part of claim 11, wherein the plant is a soybean plant.

19. The plant or plant part of claim 11, wherein the plant is a monocot.

20. A seed from the plant of claim 11, wherein said seed has stably incorporated into its genome said expression cassette.

21. The seed of claim 20, wherein said seed is a soybean seed.

22. An elite soybean plant comprising a nucleic acid comprising an R-gene encoding a protein sequence having at least 90% sequence identity to SEQ ID NO: 47 operably linked to a heterologous regulatory element active in the soybean plant, wherein expression of said R-gene in said plant enhances resistance to Asian Soybean Rust (ASR) compared to a control plant not expressing said R-gene.

23. The elite soybean plant of claim 22, wherein said R-gene encoding protein sequence is set forth in SEQ ID NO: 47.

24. The elite soybean plant of claim 22, wherein said R-gene comprises a nucleotide sequence as set forth in SEQ ID NO: 6.

25. The elite soybean plant of claim 22, wherein said heterologous regulatory element is a promoter having a nucleotide sequence as set forth in SEQ ID NO: 7.

26. A seed from the elite soybean plant of claim 22, wherein said seed comprises the heterologous R-gene.

27. The elite soybean plant of claim 22, wherein said R-gene was introduced by a breeding process.

28. The elite soybean plant of claim 22, wherein said R-gene was derived from *Glycine tomentella* accession line PI441001.

29. The elite soybean plant of claim 22, wherein the soybean plant has increased resistance to any one of the following: soy cyst nematode, bacterial pustule, root knot nematode, frog eye leaf spot, phytopthora, brown stem rot, nematode, Asian Soybean Rust, smut, *Golovinomyces cichoracearum, Erysiphe cichoracearum, Blumeria graminis, Podosphaera xanthii, Sphaerotheca fuliginea, Pythium ultimum, Uncinula necator, Mycosphaerella pinodes, Magnaporthe grisea, Bipolaris oryzae, Magnaporthe grisea, Rhizoctonia solani, Phytophthora sojae, Schizaphis graminum, Bemisia tabaci, Rhopalosiphum maidis, Deroceras reticulatum, Diatraea saccharalis, Schizaphis graminum* and *Myzus persicae*.

30. A method of controlling Asian Soybean Rust (ASR) in a field comprising the step of planting in the field a soybean plant, a plant part or a seed having stably incorporated into its genome a nucleic acid comprising an R-gene encoding a protein sequence having at least 90% sequence identity to SEQ ID NO: 47 operably linked to a heterologous regulatory element active in the soybean plant, wherein expression of said R-gene in said plant enhances resistance to ASR compared to a control plant not expressing said R-gene.

31. A harvested product derived from the seed of claim 26, wherein the harvested product comprises the R-gene encoding the protein having at least 90% sequence identity to SEQ ID NO: 47.

32. A processed product derived from the harvested product according to claim 31, wherein the processed product is a flour, a meal, an oil, a starch, or a product derived from any of the foregoing, wherein the processed product comprises the R-gene encoding the protein having at least 90% sequence identity to SEQ ID NO: 47.

33. A method of producing a plant with increased resistance to rust and comprising an R-gene, the method comprising introducing into a plant a nucleic acid molecule comprising an R-gene encoding a protein sequence having at least 90% sequence identity to SEQ ID NO: 47 operably linked to a heterologous regulatory element active in the plant, wherein the R-gene is expressed in the plant, thereby producing a plant with increased resistance to rust.

34. The method according to claim 33, wherein the introducing step comprises transforming a plant cell with the nucleic acid molecule and regenerating a transgenic plant.

35. The nucleic acid of claim 1, wherein said R-gene encodes a protein having at least 91% sequence identity to SEQ ID NO: 47.

36. The nucleic acid of claim 1, wherein said R-gene encodes a protein having at least 92% sequence identity to SEQ ID NO: 47.

37. The nucleic acid of claim 1, wherein said R-gene encodes a protein having at least 93% sequence identity to SEQ ID NO: 47.

38. The nucleic acid of claim 1, wherein said R-gene encodes a protein having at least 94% sequence identity to SEQ ID NO: 47.

39. The plant or plant part of claim 16, wherein said soybean plant is *Glycine max*.

40. The method according to claim 33, wherein the introducing step comprises crossing a first plant comprising the nucleic acid molecule with a second plant not comprising the nucleic acid molecule.

* * * * *